United States Patent 10,570,408 (TRANSGENIC PLANTS WITH ENHANCED AGRONOMIC TRAITS) - sequence listing, part 2

SEQ ID NO: 3612 - protein, 313 aa, Chamaebatiaria millefolium
GGLGDVLGGLPPAMAANGHRVMTVSPRYDQYKDAWDTCVLVELEVNGRTETVRFFHCHKRGVDRVFVDHPVFLERVWGKTGSKIYGPKAGEDYKDNQLRFSLLCQAALEAPRVLNLNSNEYFSGPYGEDVVFIANDWHTALLPCYLKTIYKPKGIYKSAKVAFCIHNIAYQGRFPFSDFSLLDLPDQLKGSFDFIDGYNKPVKGSKINWMKAGILESDRVVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 3613 - protein, 163 aa, Zea mays
  misc_feature (122)..(122): Xaa can be any naturally occurring amino acid
MKQEYGLGEAAGRTAPLPSSSTAAPATPIRRHAMAKYNVVQKNKRQCNQDRKRAAHGEPGTGKLKQRTAPVSMSGKRKKKLERRLNRKQKEAAMIKALENNMGDVDMISVEGSSEAAKGKSXQVKFSVKKNSRIQIKRLKGKGRKKAKNAKPPAKEKVDAMVE

SEQ ID NO: 3614 - protein, 362 aa, Cryptococcus neoformans
MQPHTQPPQPEASSSRAVHIPSDPAPPRPCLTNDAIVSRWQSSPGFQYFWAWIKRRCDRLKGKEIIRGPFDHSAHGIRSLMNMLDQMTSWVEDATPQPQSNQRFGNLAFRTYNKLLQERLPPLIDSWDIPSNLRSQLLPLFINSHAFGHPTRLDYGTGHELAFVLGLWCCVVPGWVGGDNGTEEEEDELILRVFTRYLELTTFLQKTYNLEPAGSHGVWGLDDYCFLPYLFGSAQLLGSNLTPSASLSLALSHHPSATSPPSAPITDLYTLSLHHLTLFKFGASFSEHSPLLYSLSQMPNWVKPHGGLKKMFLGEVVGKRVVVQGIWVGGWCWGEDVPNVEERGDKNEGKGTDAGTKAPWAR

SEQ ID NO: 3615 - protein, 360 aa, Prochlorococcus marinus
MKTWVVKVGTSILRGTNEKSTEQVIESLCKSLTSFILRGNKVVLVTSGAVGLGCNKLNLNRRPKELSSLQAVAAVGQVNLMTLYDKTMKKLGHNIAQILITKTDFNSRESFNNASKTFKKLIDLNVIPIVNENDSIANEELKYGDNDTLSALVALAINANKLILLTDIENLYSKDPRNNKDAHPIREVNTNELKIIRDKNNKIYNNEWGTGGITTKLIAAEIATKGGIEVQLADGRNENNLIDIFNDKKIGTIFHPLDKPVGNKKNWLSHAIKTVGEITLDEGACLAIVKKGASLLVVGVKEVEGDFTVNQAVRIVNTDKKEVAKGITSMSSDSLKRILNKKETINSSMIVVHRDVLALS

SEQ ID NO: 3616 - protein, 377 aa, Glycine max
MAHLALSQMAVTVPVGSDLSLRRSAVKAPNFNFWDKSWAPVFTLYLKANNSSLRSRHVVFMSVQQASVPKVNVSPLELEDAKEPPLNLHKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFLESVPTYKFGGLAWLFLGVANTDSLLYDEEFSKYLNDYSDNFRYDRALSIEQKNKNGGKMYVQDKIEEYSDEIFKLLDNGAHIYFCGLKGMMPGIQDTLKKVAEQRGESWEEKLSQLKKNKQWHVEVY

SEQ ID NO: 3617 - protein, 236 aa, Vitis vinifera
MTRRYWNINLEEMMEAGVHFGHGTRKWNPRMAPYISAKRKGIHITNLTRTARFLSEACDLVFDAASRGKQFLIVGTKNKAADSVARAAIKARCHYVNKKWLGGMSTNWSTTETRLHKFRDLRTEQKTGRLNRLPKRDAAMLKRQLSHLQTYLGGIKYMTGLPDIVIIVDQQEEYTALRECITLGIPTICLIDTNCDPDLADISIPANDDAIASIRLILNKLVFAICEGRSSYIRNP

SEQ ID NO: 3618 - protein, 417 aa, Legionella pneumophila
MFDESYTIKNFDDVLFKAISDEKRRQEEHIELIASENYVSPRVLEAQGSVLTNKYAEGYPGKRYYGGCEFVDVAEELAISRAKLLFGAHYVNVQPHSGSQANAAVMMALLSPGDTFMGMALPHGGHLTHGSKVNFSGKLYHSVEYGVDNNTGLIDYDALEKLALQHKPKLIIAGFSAYSRILDWARFREIADKVGAYLMADIAHVAGLVAVGLYPSPVPYADVVTTTTHKTLRGPRGGLILCKENEEIEKKLNSAVFPGMQGGPLMHVIAAKAVAFAEALLPEFKTYQQQVLANARTMCSVLQSRGYDIVSGGTDNHLLLVDLINKGITGKEADAALGRANITVNKNSVPNDPRSPFVTSGLRLGTPAATTRGFKEREITLLSNWVADVLDNVHDETNISRVKTQVLLLCREFPVYA

SEQ ID NO: 3619 - protein, 362 aa, Ustilago maydis
MTPPTASFINPATAGPQPGSFKLSKGSLHACSTTAAPKYEQYVPIKTGEEPIEDFNGHYRFAEIKESHTSRAMTARYMADMMDAAVSDVVIIGAGSAGLTCAYTLAKQRPDLRITMLEASVAPGGGAWLGGQLMSGMVIRKPAHNLLVEIGVPFDDEGSYVVVKHAALFTSTLMSKLLAMDNVKLFNATCCEDLIIKKDQTGAQRVNGVVTNWTLVTMAHGLQSCMDPQTITAPVVIGACGHDGPFGAFSVKRLSSAGLIKLGDMRPMDMNKSEAFVIADTRVSLYIFAFHSSDSGLIVNNTREVFPGLIVSGMELSEHDGHPRMGASFGGMIGSGQKAAYEAIKLYDSLEIDDGEVVGLKH

SEQ ID NO: 3620 - protein, 1249 aa, Methanopyrus kandleri
MPGLPIKLRVEKAYPEDVGKRAVRMDKASRDRIGVSEGDLVKITGSKTTVARVLPAKKEDVGKGIVRMDKYERQNAGASVGEPVEVDRAEEKVAKRVELMPTERVVVPVQAGLKEEVEEELTREHEQDILEQIKRYLRSRAQQTPIPATHRDVIPLEVQGKTIAGHVLIKFPDSLLVVGIEPEDATVIGPETEIEVKPYSEDLAKAAEIPDVTYDDIGGLDREIELIREYVELPLKRPELLKELGIKPPKGVLLYGPPGTGKTLLAKAVANECGAKFYSINGPEIMSKYYGESEARIREVFEEARKNAPAIIYIDEIDAIAPKRGETGEVERRVVAQLLTLMDGLSEDERVVVLASTNRPDDIDPALRRPGRFDKEIEIGVPDKEGRKEILQIHTRDMPLADDVDLDKLAELTHGFTGADLEALCKSAGLKALRRAIRKIGAKLAEKGEKEEREVAVKVSELSDEELMEVLEKGLDRARIPEEKKRALRRVLREAEEEEKEEVAYTDALDKVLEAEELPEIREELKVTMRDFMEALKEIEPSALREVIVEVPDVSWDDVGGLEDVKQELKEAVEYPLKYPEVYEKLGTRPPKGILLYGPPGTGKTLLAKAVANESDANFIAVRGPEVLSKWVGESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSEKKIREIFQKARQTAPCVIFFDEIDAIAPKRGTEVGGSRVTERIVNQLLTEMDGIEATEDVFVIAATNRPDIIDEALLRPGRFDRIVYVPPPDEEAMKEIVKIHTRDMPLAEDLTVDDIVEILRRREREEDAKYTGADIEAVCMEAAMLALREVLDELERIEKESETEEELEARKEALLEELRVERRHFEKAVEKVPPSVPKEKLEEYEKLKEEYQRLAG

SEQ ID NO: 3621 - protein, 162 aa, Brassica napus
LLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGS

SEQ ID NO: 3622 - protein, 195 aa, Oryza sativa
  misc_feature (142)..(142): Xaa can be any naturally occurring amino acid
  misc_feature (153)..(153): Xaa can be any naturally occurring amino acid
MAAAARWWVAAVVVAVAAMAGAAKGDFAADKAECADKLMALATCLTYVEEKATARAPTRDCCAGLGQVVAGSKKCLCVLVKDRDEPALGFRINVTRAMDLPSGCSIAATFSDCPKMLNMSPDSKEAEIFQQYAREHESNNGXKPAPAAAAAAXGSAGKATAATGDAGLGRRQRSSLAARAVAAAVLAAVFGLTVA

SEQ ID NO: 3623 - protein, 554 aa, Unknown
  Vibrio sp. Ex25
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGHDEHGNYYVASEMKALVPVCKTVSEFPPGSYYSSKDAEPTRYYVRDWNEYAAVQGNTTSKEELTEALEAAVKRQLMTDVPYGVLLSGGLDSSITSAVAKRFAAMRIEDDEKSEAWWPQLHSFAVGLEGAPDLKAAREVADQIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPESIAWRQKEQFSDGVGYSWIDTLKEVAEQKVTDQQMETAQYRFPYNTPTTKEGYVYREIFEELFPLPSAAECVPGGPSVACSSAKAIEWDESFQNCVDPSGRAVQTVHNDAY

SEQ ID NO: 3624 - protein, 406 aa, Campylobacter jejuni
MLNNTLFFKQSEIHTISSYANRINDEVKSGDIGYYHLIDTSLNLIDESLAFIKDKEHIKNIVLVGMGGSSCGVKALRDMLFNEKSNQRELFILDNTSSHSFNKTLEKIKLEESLFLIISKTGSTIEVVSLFKLLIEHFKLDMQELKKYFVFITDKDSKLHQEGENLGIKCFFIPANVGGRFSILSAVGIVPLCFCGYNAKALLEGAKACFEDFFTHKKDEILQKAYHYCTHKNANINVLFSYSDAFKGFNEWYIQLIAESLGKKQGYKRIGLTPIALIGARDQHSFLQLIMDGPKNKTVTFLKIKDAQKAPIIPDIHFKFLDSLSNKVNLHELLNAQCNATMHALIAENLSVDVIELEKLDAWHAGYLMYYYELFTSTCGVMLGINTYDQPGVEVGKLILKNILNS

SEQ ID NO: 3625 - protein, 490 aa, Debaryomyces hansenii
MKTFPSLSETQETELTENLLQWSLGNGLTMYPVNYKTHSATHAPITIFPTPFAKKAFNNAMDVQKGFNELYASVVSKSKEWLLDILKELAVFDDDFTGKLFEMYNKSIESNGGKVKQPLSLGIFRSDYMLNDVDDDPQIKQIEFNTVSISFGGLSTKVGELHNYLNLKGAYDADYSYKYYDDDEIPISDSINELAKGLADGNYHYNGKQESTKTVVLFVVQPGERNCFDQRHIEYSLLKNHGIKSYRVTLEEVAEKTTINQDKLYIKSTMDEVAVVYYRSGYAPTDYEMAPEATWNARLYLENSLAIKCPSLLTQLSGAKKVQQILTQKGMVEKFLPDISKDELDKLLSTFVAIYPLDDSEDGKTAKKLAFETPEKFVLKPQREGGGNNIYKESIPEFLKSLDESKWGAYILMELINPPHHKNKIIREGEVFHENIISELGVFGTIVFNEESGDVLTNENAGWLLRSKFSSSNEGGVAAGFGCVDNIYLY

SEQ ID NO: 3626 - protein, 328 aa, Aspergillus oryzae
MSTTSSTFKSSSGANCHPTALEIIQNNGLEGKLQDKVILITGCSSGIGIDTARALSVTGATLYLTARDLKKAEQALGDLIEKPNVHLLTLNLNSLASVRACAEEFLPKSSQLNVLINNAGVMATPEGRTQDGFETQFGTNHLGHFTLFYLLKPILLASSTPEFNSRVVNVSSLAHRYGEPVFDNINLEGIYEPWRAYGQSKTANIWTANEIERRYGSQGLHAFSVHPGGIRTGLQQYVPKEQKDAWDQDDAISSVWKTSEHGAATTVWAAVAKELEGKGGKYLEDCQIAEKYDPSTGTAGKGYAPWVYDEAKQAKLWEMSLNLAGLHV

SEQ ID NO: 3627 - protein, 87 aa, Vibrio cholerae
MLTCTDNQSRNPRFGLALVQGKDVDTAQTDIGQVVEGYRNTKEVWMLAKRMGVEMPIVEQIYQVLYQGKDARLAAQDLLARDKKMER

SEQ ID NO: 3628 - protein, 269 aa, Sulfolobus tokodaii
MGLKVELAQIRPKLGDVKYNLEKHQEIISSSSADCIIFPELSLTGYILRDLVYEVYNESEKAIEKLSEENKCIIAGLVKEIRPGILRNTAAIIINHQINYIYKFYLPTYGLFEERRYFQPGDPKRDLKIFEYKGVKFGVIICEDAWHYEPIEALALLGADSIFIPAASPMRRLSTRLGIQDNWEALLKAHSIINGIWTIFVNNVGSQEEEFFWGGSMVVSPNGEVINRAKLFEEDIIITEINLDEVRKNRFFSSFREHNRDFHDVLRSL

SEQ ID NO: 3629 - protein, 351 aa, Prochlorococcus marinus
MQTMTKAPSSTVQSRRILLTGASSGIGYQAAVRMHRAGHQLILPCRDRSTATATLKKLSEETAQHQQERSPVSAPVMDLADLESIKHCADELLRIGQPIDTLILNAGLQYTGAAKAQLSSQGYELTIAVNHLGHQALSIRLLPLLDEGRSPRVVVTASEVHDSNSPGGRFGKPSGLGDLTGLKTGAGFEMIDGSSNFNADKAYKDSKLCNVLFARELARRLSLRSTQIPVLAWAPGLVIPRSSGGFFRYSRRYNEWGQRVFSLVVRDLLRISESTENAGSLLSRLATDQSLSTSPFSYRSNRLDGPGKHRFEEANVSKEAQDNNLAKSLWEVSAELIGLPTELPPASVSQC

SEQ ID NO: 3630 - protein, 624 aa, Unknown
  Nocardioides sp. JS614
MADVDTALFLVALAVAVLAGVVVAGRIGVPAPLLLVVAGVAASFLPFLPEVHLEPDVVLFGLLPPLLYSAAITSSLVDFNANRRPILLLSVGLVVFTTLGVGVLVHELVPGLSWPVAFALGAVVAPPDAVAATSIGRHIGLPRRVVTILEGESLFNDATALVSLQTALGATLVGVELWRVGLDFVVAAGGGVLIGVVVFLVVGAMRRRLSDPMLDVAMSFVIPFTAFLAAEEVHASGVVAVVTAGLLLGHRAPVLQTAQSRIAERINWRTIAFLLENTVFALIGLQARWLFDDLGESTLSPARIIAVSAATLVAVIVLRLVWVFLSRSLLVRPRVDPATGQVPPWSFTLLLGWSGMRGVVTLAAAFLIPPDTRHREVLLVVAFAVVAGTLLVQGLSLPWLTRRLHVPAPDPLDDALARATLLQQASKAAVEELERQEYDDQAGVGDLIRQRLDQRNFAAWERLGTTADQESPAAVYYRIRMAMIAAERRRILEIRRSGTVASEVIAEVLSMLDVEESMLDNAHQERDEAEDYARRRWTLGETCDDLGRYPVVDAEPATYCQACLDEGTRWVALRRCLECGNLACCDSSPRQHATAHFRETQHPVMQSAEPGEDWRWCYLHHLTA

SEQ ID NO: 3631 - protein, 314 aa, Solanum ochranthum
KINFNKVPLYYRNVSGGSRLVSIRAQVTTEAPAKVEKISKKQDEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 3632 - protein, 1093 aa, Unknown
  Shewanella sp. MR-4
MKRMLINATQSEELRVALVDGQQLYDLDIESPGHEQKKSNIYKGKITRVEPSLEAAFVDYGAERHGFLPLKEIAREYFPKGYSFQGRPNIKEVVSEGQEVIVQIDKEERGNKGAALTTFISLAGSYLVLMPNNPRAGGISRRIEGDERTELKEAMADLEVPAGMGLIVRTAGVGKESTELKWDLKVLQHHWAAITEAAQSKAAPFLIHQESNVIVRAIRDYLRRDVGEILIDHPRIFEEAKQHIALVRPDFVERVKLYEAEVPLFTHFQIESQIESAFQREVRLPSGGSIVIDPTEALTSIDINSARATKGGDIEETALNTNLEAADEIARQLRLRDLGGLVVIDFIDMTPVRHQREVENRLRDAVHHDRARVQLGRISRFGLMEMSRQRLRPSLEESAAHICPRCHGQGTIRSTESLALSILRLMEEEAIKENTSQIEAIVPVDVAAFLLNEKRKAIRITEQRHDVEVYVIPDPHMMTPDYRVIRHRTDDEIDESSYKRIEQPEAKLYEPRKLERTAAPAPALKGFTAPQKVEQAAAPVANKVEATEPGFFSKLFSAIGAFFSSSDKPAAEKTTETKKSDSQTANANRRNRRNDTRRTRNNQDADKAKEGTREPRTRNAKKSADAPQAQERPAREKDENAKRTKPEPKSRNQAPKEVVAESQDDTPKQEVARERRQRRNMRRKVRIDNANETTEAPIQEEVVLAEVAAVNAANTDVATEPQAETKAPRSRRQPRKDAAVANETVEATDAASQVEANAEVSAEKPVVENRAEAPADVTEVKTEAETDADNAELSADADDKAKRESRDGQRRSRRSPRHLRAAGQRRRRDEDEQGVSAPAQFVPNDALGDAQDYPAPTAQTAEAAETTEAKATEVAAEPTVTSPAAVVETADVSVVAETNKAVETEVVESVATEQVAKLKAEVAVTEAPADTAVNNKPETSVKAEDVAVEPAKAVEAVTEAIVTPAETPVAQAKTETVAVEAVAPEVEKAEVKDAVKSVASAPMAKPAPIVKPQAKPVVTQAVAAPAAETVVSKPKAASRFGSMVSSEMTKPTVEVRTQVEVPKGREYDNTASAEVTAPKLKQSNSAESDMARP

SEQ ID NO: 3633 - protein, 197 aa, Nitrosomonas europaea
MLMRTAQVTRNTQETQITVTINLDGQGKAELDSGVPFLDHMLDQIARHGMFDLSVAAKGDLHVDAHHTVEDIGITLGQALNRAVADKKGLVRYGHAYVPLDEALSRVVIDLSGRPGLQFNTTFTRAVIGNFDVDLIQEFFQGFVNHAMVTLHIDNLTGKNAHHQAETIFKAFGRALRMAVTTDPRCDNLIPSTKGVL

SEQ ID NO: 3634 - protein, 251 aa, Mycobacterium smegmatis
MTVYFIGAGPGAADLITVRGQRLLGTCKVCLYAGSIMPDDLLALCPPDAKVIDTGPLNLDQIIDELVAADEAGLDVARLHSGDPSIYSALAEQCRRLDALGIGYEIVPGVPAFAAVAAALGRELTVPGVAQTVTLSRVATLSTAMPEGEDLRTLSAPGATLVLHLAAAQIDNIVPQLIEGGYRPETPCAVVAFASWPQEVVLRGTLADIAEQMHAADVTRTAVIVVGDVLAAEGFTDSYLYSATRRRGSRH

SEQ ID NO: 3635 - protein, 180 aa, Streptococcus suis
MLDKDIKKILVSEEEIVAKCKELGQILATDYADKNPILVGILKGSIPFMAELMKHIDAHVETDYMVVSSYHGGTESCGTVKIIKDLDNSVAGRHIIFIEDIIDTGRTLKELKELFALRQAGSIKIATLLDKPEGRVVEIEPDYTCFTIPNEFVVGFGLDYDENYRNLPYVGVLKEEVYTK

SEQ ID NO: 3636 - protein, 640 aa, Oryza sativa
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPESLVHGANICAFLNIAQAMTDQGCV

SEQ ID NO: 3637 - protein, 328 aa, Unknown
  Synechococcus sp. RS9916
MSRVYADNSQAIGNTPLVRLNNVTKGCKATVLAKIEGRNPAYSVKCRIGANMIWDAEKRGALTADKTIVEPTSGNTGIALAYTAAARGYKLILTMPESMSIERRRVMAALGAQLILTEAAKGMPGAIAKAKEIAESDSAKYFMPGQFENPANPEIHEKTTGPEIWNDCDGAIDVLVSGVGTGGTITGISRYIKNSAGKAIESVAVEPSHSPVITQTMNGEEVKPGPHKIQGIGAGFIPKNLDLSVVDKVEQVTNEESIEMALRLAQEEGLLVGISCGAAAAAAIRLAQQDAYAGKTIVVILPDLAERYLSSVLFADVPAGIIEEPVAV

SEQ ID NO: 3638 - protein, 140 aa, Nicotiana tabacum
KEEFHKETCRKIKALHQYDCLRANKSTSAWGLEARVPFLDKEFINVAMSIDPEWKLIKPEQRRIEKWALRRAFDDEEHPYLPKHILYRQKEQFSDGVGYSWIDGLKAHAEQHVTNRMMLNASHIFPHNTPITKEAYYYSM

SEQ ID NO: 3639 - protein, 763 aa, Oryza sativa
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 3640 - protein, 754 aa, Solanum demissum
MRNLIAHFRLKKKTVHPKKENPNFFPPLKHFRNVEQTSLVKCGIFKISQDFELGVVEFAKWKVGLQQKIFPQSEELLLYHSYIPSYLHIGCLSPLLAVLRNGLSLVHFLGWGRGLRSGKSNEVEVQMLKTCDLGSRNQVGIEKPVLSVSPSPYYGDIASCLRLILCCWEVTSIWRNGRGVCKLTPDTRVIKKYELSSRIIRKVEGRLRFNWHPFLRLGCVSILPTVYQLLHASWHYPSDAKPSAFGAVLHVISTSILGITAITITNTIAGEESVHKLASLLLIVLGGSYIILFLCGKGGHSHSHNQPMEKMAVAGLVLVPALSPCATTLPVFLAVGNSSSMMVLAIIVLLFSTITVMTSLVALSFYGASQLKFHWVECYDKLLVGSVLSLVGILTLIFHDHDHEGGSAGGHAAFCPKSETLREFGLFRFKSGYLTPDGKPKKGPTRGSIVVHAMTGTYGINYGKISDNIPAPEDVLRLLRMNKIKNIRIYDADSRVLRAFSGSGIEISVCLPDKLLKDVSQNGSIALEWIQVNLQPYLPGTSIRGIAVGNEILGGDTSISEALVPAVRSVYRALRRLGLTNTIEVSTPHSEAIFSSTYPPSNGIVDPKTKLHYDNMFDAMVDATYVALEKLGYTKMQVIVSETGWASKGDDNEPGADPKNARTYNFNLHKRLMKKKGTPYRPKMMAKGYVFALFNENLKPGPTSERNFGLFKADGSIAYDIGFKGLVSSASSKCKIRKLQIIALFLTNPEQGWI

SEQ ID NO: 3641 - protein, 328 aa, Salmonella enterica
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIVQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLANLEGVLLDPVYTGKAMAGLIDGISQKRFNDDGPILFIHTGGAPALFAYHPHV

SEQ ID NO: 3642 - protein, 85 aa, Unknown
  Polaromonas sp. JS666
MAKEELIEMHGLVDEVLPDSRFRVTLDNGHKLVAYTSGKMRKNHIRILAGDQVSLELSPYDLSKGRITFRHIAGRGPGPAQRPSR

SEQ ID NO: 3643 - protein, 192 aa, Brassica napus
MSSFTTKTPPPYLRRSNDHRRINPLISIICSVGESQQDSFTRRRTLTSLITLTAIGAGAIATSSALAQEKWGTRSFIKEKYFQPGLSPEDAAARIKQTAEGLRDMREMLDHMSWRYVIFYIRLKQAYLSQDLTNAMNILPESRRNDYVQAANQLVSNMSELDYYVRTPKVYESYLYYEKTLKSIDDVVELLA

SEQ ID NO: 3644 - protein, 154 aa, Triticum aestivum
KAVEILMGSAGSKKFQTKVEWGIDLASEHERYLTEVIFKKPVIVYNYPRGIKAFYMRLNDDQKTVAAMDVLVPKVGELIGGSQREERFDILKQRILDAGLPMESYEFYLDLRRYGSVKHSGFGLGLERMLLFATGLDNIRDVIPFPRYPGKADL

SEQ ID NO: 3645 - protein, 173 aa, Oryza sativa
LVSWEKENVSSEALEAARIACNKYMTKNAGKDAFHLRVRVHPFHVLRINKMLSCAGADRLQTGMRGAFGKPQGTCARVDIGQVLLSVRCKESNAKHAEEALRRAKFKFPGRQKIIHSRKWGFTKFTREEYVKLKAEGRIMSDGVNAQLLGSHGRLAKRAPGKAFLAETIQASA

SEQ ID NO: 3646 - protein, 471 aa, Yarrowia lipolytica
MSSYALSNNHKDLIEASLHDLDPEVEGIMKDEIDRQKHSIVLIASENFTSKSVFDALGSPMCNKYSEGYPGARYYGGNQHIDRIETLCQNRALKAFGVTPDKWGVNVQTLSGSPANLQVYQAIMKPHDRLMGLDLPHGGHLSHGYQTDNRKISAVSTYFETMPYRVDLETGIIDYDMLEKTAILYRPKVLVAGTSAYCRLIDYKRMREIADKVGAYLVVDMAHISGLIAAGVIPSPFEYADIVTTTTHKSLRGPRGAMIFFRRGVRSVDPKTGKEILYDLENPINFSVFPGHQGGPHNHTITALAVALKQAADPTFREYQEQVLKNAKALETEFNKLGYNLVSGGTDSHMVLVSLRDKGIDGARVETVCEQINIALNKNSIPGDKSALVPGGVRIGAPAMSTRGFGEEDFKKIANYISQAVDLAIEIQQGLPKEANKLKDFKAAAQAGGNPKIEALKTEISNWAGQFPLPV

SEQ ID NO: 3647 - protein, 304 aa, Oryza sativa
MAHSLMAVGPGRPDWAVGWPTCQARKRRHRCGWLPETSGAFPAAFFLFSHSIRHPLLGGQRDGGGKPRPTMQRLSRFVPSSSSVFPLLRRVTDLKDALWSGSLTFQHALSTFAADENTSGRKFASYTVFKGKAALSMQPILPSFSKLESGGSRVNKNGSVMLTFFPAVGQRKYDYSKKQLFALSPTEVGSLISLGPAESCEFFHDPSMKSSHEGQVKKSLSVTPLGNDSGYFLNITVLNNLQKTTERLSLPISKAEFTVMRTALSFALPHILGWDQALTNHQPSPSPASKPRVERPHPDSEWER

SEQ ID NO: 3648 - protein, 130 aa, Brassica napus
MNRYFGHLKSGGNAYVIGDPAKPGQKWHIYYATEQPEQPMVTLEMCMTGLDKKKASVFFKTQADGHVSCAKEMTKLSGISDIIPEMEVCDFDFEPCGYSMNAINGSAVSTIHVTPEDGFSYASYEVMGMD

SEQ ID NO: 3649 - protein, 610 aa, Zea mays
  misc_feature (146)..(146): Xaa can be any naturally occurring amino acid
LDTSGIVWSVGGHRPAGSGAVACPASGVSGFITSTGGGGEPPPRDATLGRHLARRLVQVGVSDVFAVPGDFNLTLLDHLIAEPGLRVVGCCNELNAGYAADGYARARGVSACVVTFTVGGLSVLNAIAGAYSENLPVLCVVGGPNXSNDYGTNRVLHHTIGLPDFSQELRCFQPVTCHQAVVNNLEDAHEQIDGAISTALRESKPVYMSVSCNLPGLPHPTFATDPVPYLLAPRPSNLTGLAAAVEATVSFLDKAVKPVVVAGPKIRVAKAAAAFVELAEASGYAVAAMPSAKGLVPETLPRFLGTYWGAVSTAFCAEIVESADAYLLAGPIFNDYSSVGYSILLRKDKAVVVQPDRVTVGNGPTFGCVMMRDFLSALAKRVRPNTTAYDNYRRIFVPGGQPPECEAGEPLRVNVLFKHIQRMLSGGSAVIAETGDSWFNCQKLRLPDGCGYEFQMQYGSIGWSVGALLGYAQGAPDKRVIACIGDGSFQVTAQDVSTMLRCEQRSIIFLINNGGYTIEVEIHDGPYNVIKNWDYTGLVDAIHNGQGRCWTARVATEEELTAAIATATGDDRKDCLCFIEVVVHKDDTSKELLEWGSRVSAANSRPPNPQ

SEQ ID NO: 3650 - protein, 473 aa, Mycobacterium smegmatis
MLESRSDLSSSDEPRSGLARSLKTRHMTMIAIGGAIGAGLFVGSGAVIKTAGPAAIVSYVVAGALVLCTLRMLGEMVVAKPRTGAFADYARIGIGPWAGFTLGWLYWYYYVIIIAVEAVAGAQILAVWVGLPLWLMAMLLMAALTLTNLISVRWFGEFEFWFSGIKVAAIVSFIVVGLLWVFGVWPGDTNGLTNLVAHGGFAPNGFGSIFGAVVVVIFAFGGAEIVTIAAAESAEPAKSVARATTGVIWRIILFYVGSIFLVVCILPWNDASVLSSPYVAALEKLQIPGAGLIMNIVILTAVLSVLNSSIYTSSRMLRVLASHGDAPQWLVRTNTRGVPTRAILASTVVGWVSVVLAYIAPDSLFLFLVNSCGVVAIFMYVMIGVSELRVRRAIEREDPAKLTLKMWFFPYLPIAVIACFVLVLVAMLFDADQRVQLLASVVSLAVVLLAYALRKRHGQVPATDTKQAARTDE

SEQ ID NO: 3651 - protein, 658 aa, Pleurotus djamor
MAFNLTSTSLTPSRPAPQAPRRGTEDSFGSSSTLNSSGYSSSFSFTPASPSSSSYAASYSGIGGSPNRHPENNMYGGNQIVRNGVVSVKEDGTFASWMWKAKWLVLTDSELSIHKSEHAPKQTVVNLGDISSIERTDLKPYCLLLETKDKRFYFSLKNDEELYGWQDDVYARSPLMGVSNPTNFVHKVHVGFDPVSGAFTGMPEQWSKLLTKSAITREDYAKDPQAVLDVLEFYTDHQKREMEEMGAKESLPIQAPPPLQPSQSKDRERERERERAEREREREKDLARPGMGAPSKSSPATTQPATQPASGPAGATAGPPPVKPLQPTKKVQIQAEEKPKTTGVAAAAAALEKPKEKEKRISTMTEVQIMEKLRQVVSDEDPKTIYSKIKKVGQGASGHVYVAKTLATGKKVAIKEMDLSHQPRKELIVNEILVMKESQHPNIVNFLESYLVKSNELWVVMEYMEGGALTDIIENNTLEEDQIASICFETCKGLGHLHSQSIIHRDIKSDNVLLDAQGRVKITDFGFCAKLTDQKSKRATMVGTPYWMAPEVVKQKEYGAKVDIWSLGIMAIEMIENEPPYLDEEPLKALYLIATNGTPTLKKPEALSRELKGFLAVCLCVDVSSRATASELLDHEFLKKSCALSGLAPLLRFKTKQQ

SEQ ID NO: 3652 - protein, 135 aa, Ralstonia solanacearum
MPKRRRIALIAHDHKKDDMIAFAQTHKAFLMRCDLLATGTTGGRLQDEVGLSVQRMLSGPWGGDLQIGAQLAEGRVDAVIFLRDPMTPQPHEPDINALVRACDVHNIPCATNLATADLVMIALGLAQPDPKEIHA

SEQ ID NO: 3653 - protein, 606 aa, Lotus corniculatus
MDVKLGSLDTTKPASNDVVSCATANHTTAIQSSIPSTAVSSCDATLGRHLARRLAQIGVTDVFSVPGDFNLTLLDHLIAEPQLNLVGCCNELNAGYAADGYARARGVGACVVTFTVGGLSVLNAIAGAYSENLPLICIVGGPNSNDYGTSRILHHTIGLPDFTQELRCFQTVTCFQAVVNNLEDAHEQIDTAISTALKESKPVYISIGCNLPGIPHPTFSRDPVPFSLSAKLSNQMGLEAAVEATAEFLNKAVKPVLVGGPKLRVAKASDAFVELADASGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNAAYENYHRIFVPEGKPLKSAPKEPLRVNVMFQHIQKMLSGETAVIAETGDSWFNCQKLKLPRGCGYEFQMQYGSIGWSVGATLGYAQAVPEKRVIACIGDGSFQVTAQDVSTMLRCGQNTIIFLINNGGYTIEVEIHDGPYNVIKNWNYTGLIEAIHNGEGKCWTSKVFCEEELVEAIATATGPKKDCLCFIEVIVHKDDTSKELLEWGSRVSAANGRPPNPQ

SEQ ID NO: 3654 - protein, 61 aa, Oryza sativa
  misc_feature (17)..(17): Xaa can be any naturally occurring amino acid
GSIGWSVGATLGYPRAXKDKRCHLCIGDGSFQMTAQDVSTMLRCGQKSIIFLINNGGYTIE

SEQ ID NO: 3655 - protein, 112 aa, Unknown
  marine gamma proteobacterium HTCC2143
MKLVTAIVKPFKLDDVRESLSEIGVQGITVTEVKGFGRQKGHTELYRGAEYVVDFLPKVKIEVAIASASLDQVIEAITSAANTGKIGDGKIFVSSLDQVIRIRTGETGEEAV

SEQ ID NO: 3656 - protein, 472 aa, Prochlorococcus marinus
MSKAHFGLIGLGVMGENLVLNAERNGFSSVVFNRTYSKTEEFLKGRGLGKNIEGAKTLQEFVNKLERPRRILMMVKAGSPTDAVIDNISEYLEEGDLLIDGGNSQFKDTERRVKTLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMSEVFGIWNNTDELASYLVEITEICLNTKDEITGEDVVEKILDKAGQKGTGLWTVVSALELGVSVPTIYASLNARVMSSLKDQRSEIEKTLPIKAFNDFDLGDISNGMKPLFDAVVLATIASYAQGMDILSEASSVYKYDLNMPSIAQIWKGGCIIRSKLLRKIQDAYQKEPNLKNLIFDDWFNMEISSRIDNLANVVSSSTKAGIPVPCLSSTLDYLNSYRTNRLPQNLVQAMRDCFGSHTYERIDKEGSFHTEWMK

SEQ ID NO: 3657 - protein, 431 aa, Prochlorococcus marinus
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKSMAVDTSKFGLTKESALEKPYLASMGIYVFSRKTLFDLLNKFPNYTDFGKDIIPEALGRGDNLKSYVFDDYWEDIGTIGAFFESNLALTRQPKPPFSFYDEKFPIYTRPRYLPPSKLVDAQITDSIVCEGTILKSCSILHCVLGVRSRIESDSVIEDALVMGADFFESQEERVELRKGGGTPLGVGVGSTIKRAILDKNARIGDNVVIVNKDRVEEADKPELGFYIRNGIVVVVKNATIANGTII

SEQ ID NO: 3658 - protein, 112 aa, Unknown
  marine gamma proteobacterium HTCC2143
MKLITAVIKPFKLDDVRQALSEVGVTGITATEVKGFGRQKGHTELYRGAEYVVDFLPKVKLEIAINDDQVETVIEAISGAANSGKIGDGKIFVAPLEHIVRIRTGETNEDAI

SEQ ID NO: 3659 - protein, 439 aa, Polyangium cellulosum
MSAQPEYCIVGGGPIGIGIGKCFAQEGLKFTIVEADEDFGGTWALSQRSGLVYKSTHLISSKKNTQFLDFPMPEDYPHYPSHAQMLSYLRSLATHYGLYDRALFGTRVEHVEPNGAGCRVRLSNGETRTFSAVVVANGRMRTPLIPRYPGVFSGETMHSAAYKSHEVFRGKRVLVIGGGNSGCDIAVDAALAAEQTFHSTRRGYHYMPKFIHGKPTQEWLMDMGSKFRSQDDYWSFVQREFKAAGYDPVDYGLPRPDHAIHEAHPILNSLVLYYIGHGDIHPKPDVRRFEGRTVEFVDGTRAEVDLILYATGYEMDFPFLAEDLRPSDGALELFLSMFHRKADSLVFVGYFNAASGLGNLLNCGGALVTDYLVAREKNTDAFRVLRRLIQGPEPDIGRGRFLNSPRHRVETDLWKAMKVMNFFRSVLNPARAAGDVVRA

SEQ ID NO: 3660 - protein, 1248 aa, Solanum demissum
MFNKLLLVWFFVVTLVLGYVFSETEFEVLLEIKKSFLDDPENVLSNWSDKNQNFCQWSGVSCEEDTLKVVRLNLSDCSISGSISPSIGFLHDLLHLDLSSNLLSGPIPPTLSNLSSLQSLLLYSNQLTGPIPNEIGLLKNLQVLRIGDNVGLTGLIPSSLGDLENLVTLGLASCSLSGMIPPELGKLGRIENMNLQENQLENEIPSEIGNCSSLVAFSVAVNNLNGSIPEELSMLKNLQVMNLANNSISGQIPTQLGEMIELQYLNLLGNQLEGSIPMSLAKLSNVRNLDLSGNRLTGEIPGEFGNMDQLQVLVLTSNNLSGGIPKTICSSNGNSSLEHMMLSENQLSGEIPVELRECISLKQLDLSNNTLNGSIPVELYELVELTDLLLNNNTLVGSVSPLIANLTNLQTLALSHNSLHGNIPKEIGMVENLEILFLYENQFSGEIPMEIGNCSRLQMIDFYGNAFSGRIPITIGGLKELNFIDFRQNDLSGEIPASVGNCHQLKILDLADNRLSGSVPATFGYLRALEQLMLYNNSLEGNLPDELINLSNLTRINFSHNKLNGSIASLCSSTSFLSFDVTNNAFDHEVPPHLGYSPFLERLRLGNNRFTGEIPWTLGLIRELSLLDLSGNELTGLIPPQLSLCRKLTHLDLNNNRLYGSIPFWLGNLPLLGELKLSSNKFSGPLPRELFNCSKLLVLSLEDNSINGTLPLEIGELKSLNILNFDKNQLSGPIPSTIGNLSKLYILRLSGNSLTGEIPSELGQLKNLQSILDLSFNNISGQIPPSVGTLTKLETLDLSHNHLTGEVPPQVGEMSSLGKLNLSYNNLQGKLDKQYAHWPADAFTGNPRLCGSPLQNCEVSKSNNRGSGLSNSTVVIISVISTTVAIILMLLGAALFFKQRREAFRSEVNSAYSSSSSQGQKKPLFASVAAKRDIRWDDIMEATNNLSNDFIIGSGGSGTVYKAELFIGEIVAIKRIPSKDDLLLDKSFAREIKTLWRIRHRHLVRLLGYCNNSGEGSNVLIYEYMENGSVWDWLHKQPANNNKRKTCLDWEARLKIAVGLAQGVEYLHHDCVPKIIHRDIKSSNILLDSNMEAHLGDFGLAKAVHDNYNSYNTESNLWFAGSFGYIAPEYAYSSKATEKSDVYSMGIVLMELVTGRMPTDGSFGEDIDMVRWIESCIEMSREELIDPVLKPLLPNEESAALQVLEIALECTKTAPAERPSSRKVCDLLLHAFNDKVVHSDKMSPDNYV

SEQ ID NO: 3661 - protein, 635 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAVSSVPARAGVSIAHLPMFAAWTDA

SEQ ID NO: 3662 - protein, 257 aa, Oryza sativa
MAGGGDDLKMLGVYVSPFPLRVKLALSFKGLSFEYVEEDLHNKSDLLVSSNPVHKRTPVVIHNGKPISESMVIVQYLDEAFPGAGAALLPSDPLDRAVARFWASYVDDKVIRMITVHQFSHASFSDDFGADRMMQLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 3663 - protein, 392 aa, Chlamydia muridarum
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSEGARQGASKKVHITLSFEEAAKGVEKELLVSGYKSCDACSGSGAKTSKGVKVCDRCKGSGQVVQSRGFFSMASTCPDCSGEGRVITDPCSECRGQGRIKDKRSVHVNIPSGVDSGMRLKMEGYGDAGQNGAPAGDLYIFIDVEPHPVFERHGDDLVLELPIGFVDAALGIKKEIPTLLKEGTCRLNIPEGIQSGTVLKVRGQGFPNVHGKARGDLLVRISVETPQHLSNEQKELLRKFSETEKAENFPKKRSFLDKIKGFFSDFAV

SEQ ID NO: 3664 - protein, 493 aa, Bacillus clausii
MANFEQFGLDASVVQAVTNIGFTEATPIQQETIELVLAGKDVIGQAQTGTGKTGAFGIPLVNRIDSSNPLVQGLVLAPTRELANQVEQALRQFGRVKGVRTTVVYGGEDFGKQIRSLKQRPHIIVATPGRLLDHMRRKTIRLESIETVVLDEADEMLNMGFIEDIETILAETPQETRQTLLFSATMPKRMESLASKFMKNPTRIAVKAKEVTMENIAQQFIEVHEREKFDVLCRLIDLETPDLSIVFGRTKRRVDELAEALIKRGYRAEGLHGDLNQAKRNSVLRKFKEGLIDVLVATDVAARGLDISGVTHVFNFDLPQDPESYVHRIGRTGRAGRSGIAITLATKPEREHVKLIESVSKRRMTQRPKPTYEEALEGQKQSTLNELRELAAKGEQDSYRVAAKELLQETDAVTALAAALKLLTKEPDQTPVKLTSEAPLRTKKRHGNGGRDGRRHNDRDRRPWGQKRGRDGRRSGHQRKWASSNGKAGKRLS

SEQ ID NO: 3665 - protein, 484 aa, Corynebacterium diphtheriae
MTDQTQLAQIGIVGLAVMGSNLARNFAHKGHTVAVFNRSFEKTQALMDQHGDEGNFIPSATIEEFVASLEKPRRAIIMVQAGPATDAVINQLADAMDEGDIIIDGGNALYTDTIRRESEIAQRGLNFVGAGISGGEEGALNGPSIMPGGPDKSWEALGPLLESIAAQVGGTPCVTHIGPDGAGHFVKMVHNGIEYADMQVIGEAYQLLRYATEMQPSEIADVFKTWNQGDLDSYLIEITSEVLAQVDSETGTPLIDLIVDEAGQKGTGRWTVKAALDLGIATTGIGEAVFARALSGATTQRKAAQGNLPAGTLESLASLNIDKDQFVEDVRRALYASKLVAYAQGFDEIIAGSAEHNWDVDPRDLATIWRGGCIIRAKFLNRIVEAYDANPELPSLLLDPYFKTELESLIDSWRRVVVAATQLGLPVPVFASSLSYYDSLRAERLPAALIQGQRDFFGAHTYRRTDKDGSFHTLWSGDRSEVEA

SEQ ID NO: 3666 - protein, 182 aa, Arabidopsis thaliana
  misc_feature (121)..(121): Xaa can be any naturally occurring amino acid
  misc_feature (135)..(136): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGTXWTMWKLPLFGAPDXXQVVEREWEKCQERSTPMPLFRIIGFDNTRQVQCISFIAYKPPSFTG

SEQ ID NO: 3667 - protein, 311 aa, Corynebacterium diphtheriae
MAKIYDSILDTVGNTPLIKLNRLDKYLPGNVVVKVEFFNPANSVKDRIGKAIVDAAEASGDLKPGGTIVEATSGNTGIALALVGAARGYNVVLTMPETMSLERRVMLRAYGAEIVLTSGAAGMQGAVDKANEIVAERDNAILASQFKNAANPEIHRRTTGEEIWNDTDGQVDIFVAGVGTGGTVTGAGETLKKHNPEIKVYAVEPAASALLTTGKAGPHKIQGLGANFIPSVLNQKVYEEVITVTNEDAISTSRQLAAQEGILGGISAGANLKAALELAALPENEGKTIVTVVPDYGERYVSTVLFDDIRD

SEQ ID NO: 3668 - protein, 491 aa, Bifidobacterium longum
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 3669 - protein, 399 aa, Debaryomyces hansenii
MDDFDRDVDNELEFSAKSTKNIKVHATFESMNLKTDLLKGIYGYGFEAPSAIQSRAIMQIISGKDTIAQAQSGTGKTATFSIGMLEVIDTKSKDCQALILSPTRELAQQIQSVVKHLGDYMNVHTHACIGGTHVGEDIKKLQQGQQIVSGTPGRVVDMIKRRNLATRNIKMMILDEADELMTKGFKEQIYEIYRYLPPGVQVVVVSATLSREVLEVTGKFTTDPVKILVKRDDITLEGIKQYHIQCEKEDWKFDTLCDLYDSLTITQAVIFCNTKVKVNWLTDQMKKANFTVVAMHGDMKQDERDSIMNDFRTGNSRVLISTDVWARGIDVQQVSLVINYDLPTDKENYVHRIGRSGRFGRKGVAINLVTKEDVDELRDIERFYRIRIKEMPVNVNDIM

SEQ ID NO: 3670 - protein, 396 aa, Desulfitobacterium hafniense
MSFKINDTITYVGKIDWELRNFHGEEYSTQRGSSYNSYLIRDEKTVLIDTVWEPFGREFIAKLKQEIDLNEIDYIVMNHNEVDHSGALPFLMEEIPNTPIYCTANGKKILQGSYHQDWNFVEVKTGDRLNIGSRELIFIEARMLHWPDTMFCYLTGDNILFSNDGFGQHFASEHMYNDLVDTGELYAEALKYYANILTPFSKMVTAKIQEIVKMELPISMICPSHGVIWRDNPLQIVHKYLEWAAEYQEEQVTILYDTMWNSTRKMAESLARGIRLANPNLTVKLYNTARSDSTEVIAQVFRSKAIAVGSPTVNNGYLSSIAAILEEIKGMKFKNKKAVPFGSYGWSGEVIKLLNEELKKAGFEVVDDGVRALWTPSEENLLECVELGKRLAASLQ

SEQ ID NO: 3671 - protein, 267 aa, Triticum aestivum
  misc_feature (251)..(251): Xaa can be any naturally occurring amino acid
  misc_feature (257)..(257): Xaa can be any naturally occurring amino acid
NKFVQKSRLVPVRNSRDIVDPRVRETTTLEDVDKLFKVFSGGKPVDLTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGTLTLRELRKLLKATGHLSALMVTYPXTHGVYXESIDEYAGYS

SEQ ID NO: 3672 - protein, 314 aa, Solanum pimpinellifolium
KINFNKVPLYYRNVSGASRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 3673 - protein, 166 aa, Lathyrus odoratus
GYYDAGDNVKYGLPMAFTVTSLSWAAIFYKAELEATKEMGNIQEAIRWGTDYFLKCSSKKNRLYVEVGEPHEDHQCWAPPEKMKTKRSVKVIDTKTPGSEIAAETAAAMAASSIVFRSTDRKYARRLLNKAKLLFTFAKSYRGTFDGTCPFYCSYSGYNDELFWAA

SEQ ID NO: 3674 - protein, 591 aa, Rhodospirillum rubrum
MCGVCGEIRFDGQFAGTTAVDRMTAKLAPRGPDDGGILVHGPVALGHRRLSIIDLSPKAAQPMVDSDLGLSIVFNGCIYNYPALRSELEALGYRFFSGGDTEVILKAYHAWGTACVKRFNGMFAFAIHERDSGKVVLARDRFGIKPLYLAEVDGGLLFASSLPALLATGRVDKAIDPLALRFYISFHAVVPAPRTILKGVRKLPPATLRVVSADGSSFDEVYWRLDFRALPGEDGRSAKDWEDGLFEAVRAAVARRIIADVPVGVLLSGGLDSSLIVGLLAEAGQRDVETFSIGFEEANGEKGDEFFYSDLIAERYATRHHKIFIPEADMIAALPGAIAAMSEPMVSYDNVAFYLLAREVSKRVKVVLSGQGADEIFGGYHWYRPLVGSTDPVADYAAHFFDRTPERLARHLSPAWLGTTDEARAFVAAHFAEDGAPDPVDKALRLDSTVMLVEDPVKRVDNMTMAFGLEARVPFLDHQLAEFAGRIPSSLKLAQNGKGILKEVARRVVPAAVIDREKGYFPVPGLKYIEGSRLDYVRDGLSSRAARQRGLFREDYLASLYENPRDAITPLRGSELWQVGLLELWLQEHGI

SEQ ID NO: 3675 - protein, 308 aa, Zea mays
MGGGTPRSSIGHILPGAGFLAVGLWHLFNHIRLFSLRPDAYVAPVWFPAPRVRHLELILVIAGSAVEFSMEMFVDHSTFLPFDADGSIPSDRLHNHEHAIICLALLVYAASALHLDRARARCRDALSLLLVAAVFAQELLVFHFHSTDHAGLEGQFHWLLQLVVAACLATALLGIGFPRSFAVSLVRSACVTFHGVWFMVIGAMVWVPSRVPKGCSLVEEDGRNTVRCHSEASLHRAKALANLQFGWYLSSMTVFVVVLYVNVCKWYPAETAYVRLPPEAGEEEEHLKRKCGIVCSGDHGFTPLEIEV

SEQ ID NO: 3676 - protein, 494 aa, Vibrio vulnificus
MTIHVKNNIHWVGQRDWEVQDFHGTEYKMTKGTSYNSYLIREEKTVLIDTVDHRFSQQFIQNLQMEIDLQSIDFIVINHAEEDHSGALSALMEKIPNTPIYCTEAAIDSIVGHHHHPEWNFKTVKTGDSIDIGNGKQLVFVEAPMLHWPDSMMTYLTGDAVLFSNDAFGQHYCDERLFNDEVDQAELMEQCLRYYSNILTPFSALVTAKIQEVLSFNLPVDMIATSHGIVWRENPTQIIEQYLAWANNYQEDRITIFYDSMSNNTRMMADAIAQGIHDVDPSVAVKVFNVSKQDKNEILANVFRSKGILVGSSTMNNVMMPKIAGMLEEITGLRFKAKKAAAFGSYGWNGGAVDRIHARLTDAGFETAISLKTKWRPDGKAMRECREHGQQIAKLWAVKDKSTLSTPVNAFQSATPIEGIEAQQPLTETTPTADAAHSADCQCMVCTVCNWVYDPAKGEPNQGIEVGTTWADVPDYFLCPECHLGKDVFVEYQG

SEQ ID NO: 3677 - protein, 383 aa, Vibrio vulnificus
MMSDPIIIIGSGFAAYQLVKSVRRLDAHIPIQIFTADDGAEYNKPDLSHVFSKRQTAADLVVKSGEAFATEHNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTVQGQTLAIALHDGREFAVDAVLCAAGLKANTAVAREAGLSVERGICVDLQLNTSDPHIYALGDCAQIEGRMLPYLQPIVLSANVLAKQLVGQEARLTLPPMMVKVKTPSYPIQLAGDFSPESHWQVQLSPEGIVAKAQSSLGDFTGFVVTGEYVTQAFPLLRELSQRANG

SEQ ID NO: 3678 - protein, 489 aa, Ralstonia solanacearum
MSEDILVNITPQETRVAIVQQAAVQELHIERTLTRGLVGNIYLGKVVRVLPGMQSAFIDIGLERAAFLHVADIWHPREAKDAPAAPHVAIEKTLFEGQALTVQVIKDPIGTKGARLSTQISIAGRTLVYLPQDPHIGISQKIGNETDREALRQRVTRMVPADERGGFIVRTIAEEATDEELANDVAYLRKIWATIRHNATTLPAPSILYQDLNLAQRVLRDFVTDDTRSIQIDSRENYQKLIEFAQEYTPAVVERLTHYTGERPIFDLYNIEAEVERALSRRVDLKSGGYLMIDQTEAMTTIDVNTGGYVGARNFDDTIFKTNLEAAHTIARQLRLRNLGGIIIIDFIDMESGEHRDAVLAELRRALARDRTRITVNSFSQLGLVEMTRKRTRESLAHVLCEQCPVCQGKGQVKTPRTVCYDILREIMRESRQFNPREFRILASQSVIDLFLEEESQHLAMLGDFIGKPISLQVESAAASQEQYDIILM

SEQ ID NO: 3679 - protein, 545 aa, Aspergillus oryzae
MSHTSAKSSSDLSSFLQPLRIGIDTLYDLSYRLSLTYKKLAASPEHFFPTPITRLPTGLETGRYLAVYVGLSYLRVAFIDLLGDQQRVRRTLEKAWPIEEHLRRDRAPDLFTFIGDCIADVVRDSLNSPSEEVPRELTTGISFCFPIRQKCLNEAILMPTGKGFALKTDLNLHQALLDGYERHTWSPGEDEQRMPVKRRKLFNLPKLRIAAMTNDTSSTLCSLAYTIHSFPNTRAVMGFIVGAGSNATVPIKIADLHERKIQHIREKDPSAQEALVSTEWTLSSASAPIFELNLRTKWDTELDKHCQRPGFQPLELMVGGRYVGELVRLIAFDWFHGVLGIPRSALPANLVAEYSLSTDFLSLKVACNQSDERLAMELSHELPPPSMSDWRWTPDSSRDLRVIASYVQDRATSLVAAVIVGLLVCAGEIALQPPHNHRDLSAPNASNGKARTDESTTRWKNGPEELAVAVSGGVMQHYPYYKEKTQRYIDQLLIRAGPQEGGKSIFLRDVNDGGLIGTGILAGTTAGEIGGIIGSTFEVSSFNSI

SEQ ID NO: 3680 - protein, 591 aa, Unknown
  Mesorhizobium sp. BNC1
MCGICGEVRFDGRTPSVSAISGMMEALAPRGPDGAGIVSHGNAGFGHRRLRIIDLSEKAQQPMVDSALGLTIAFNGCIYNYPELREALEAKGYSFFSHGDTEVILKAWHAWGETCVERFHGMFAFVIQERDTGRIVMARDRFGIKPLYLAEKSGVLRFASSLPALVKAGDVDTSIDRVALHHYMTFHAVVPPPRTILNGVRKLPPATIRVIEADGRSTERRYWDPPYRRDPADAGVSAEEWRDRVHEALRLAVKRRMVADVPVGVLLSGGVDSSLIVGLLAEAGQTGLMSFSVGFEEANGEKGDEFVYSDLIAKEFGTDHHKIFVPSDRLMDALPGTFAAMSEPMVSYDNVGFYLLSQEVSKHIKVVQSGQGADEVFGGYHWYPPLARSNDVVADYAKVFFDRSHETLKRQLGANWINGEDYSRGLVAAELMRPGADSPVDRALRLDANVMLVDDPVKRVDNMTMAWGLEARVPFLDHELVELAARIPPEEKLKDGGKGVLKDVARLVVPHEVIDRPKGYFPVPQLKYVAGPYLEMVRDALGSQRARERGLFRQDYLDRLFAQPADHITPLRGSELWQAGLLELWLQTHGI

SEQ ID NO: 3681 - protein, 1053 aa, Unknown
  Burkholderia sp. 383
MKRMLFNATQQEELRVAIVDGQKLIDIDIETAGREQRKGNIYKGVITRIEPSLEACFVNYGEDRHGFLPFKEVARQYFKEGIDMRSARIQDALREGQELIVQVEKEERGNKGAALTTFISLAGRYLVLMPNNPRGGGVSRRIEGDERQELRETMAQLQIPDGMSMIARTAGIGRSAEELQWDLNYLLQLWRAIEAASQSGNAGQPMLIYLESSLVIRAIRDYFQPDIGEILIDTNEIHDQARAFMDIVMPDNVAKVKRYHDDVPLFSRFQIEHQIETAYSRTVPLPSGGAIVIDHTEALVAIDVNSARATKGADIEETATRTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRQEINKIESRFKVGIVLIPNKHLDTPHYKLERLRHDDARLDDPRASWKMAEEAARELESETGYSKRAAEVKPKQEAAVKGITPERPAPSPAPQRPVEPVAAPTPVAPASGGFIGWLKGLFGVSPAPAPAPVAPAPAKEQAARPARGERTEKSEQRGERGGDRNRNRRGGAQQAQGGRDQAVAGRGQPQRQEREGKEVREPREAREPREGREPRESREPREPRENREGREGRGPREGREPREGREPREPRENREPRERIEQPEGVEAAGRGERQERGERRERGERRKPTQHAATLETVNRGEAHPEPEADKALAEALPDAELAADAEAGARDGEERRRRRRGRRGGRREREEDGAVVDHAEQGAEGEVAVHAVTPEAPAAAEPAHTAAPAVAVAAAAASAVVVEAVVEHHAEPAAPATVEPQPAPVHVEAVAVEAAVVAQAAEPAPVAPAVATEAGPAPVAVSPTDAFEVPAAPVAVEAPQPAPVEQAAPAVTTEAAPVAVEPVHVEAAPVEAVAAPAPAPAPAPAPAPAQPAAAPASASLDTVLEQAGLVWVNTDAGKFAAAQEAASRLPRPARVQRERKALPPVDTAPMQQVETTHH

SEQ ID NO: 3682 - protein, 1230 aa, Yersinia pseudotuberculosis
MKRMLINATQQEELRVALVDGQRLYDLDIESPGHEQKKANIYKGKITRIEPSLEAAFVDYGAERHGFLPLKEISREYFPNNYSSHGRPNIKDVLREGQEVIVQVDKEERGNKGAALTTFISLAGSYLVLMPNNPRAGGISRRIEGDDRTELKEALSSLQLPDGMGLIVRTAGVGKSADALQWDLSFRLKHWDAIKKAAEGRPAPFLIHQESNVIVRAFRDYLRPDIGEILIDNPKVLELAKEHIAALGRPDFSSKIKLYSGEIPLFSHYQIESQIESAFQREVRLPSGGSIVIDTTEALTAIDINSARATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTVRDNESLSLSILRLIEEEALKENTHEVHAIVPVQIASYLLNEKRESVNAIEKRQGGVRAVIVPNDQMQTPHYSVLRVRKGEEVPSLSYLLPQLHEAEMAQPLEEATIERKRPEQPALATFSLPTEVPPEEAPTVAKAKPAVATPAAVSTDVEQPGFFSRLFSGLKNMFGASAEAEVQPAEVVKTDASENRRNDRRNPRRQNNGRKERNDRTPREGRDNSSRDNTNRDNTNRDNTSRDNTNRDNTSRDNANRDGANRDNSNRDNSGRDNVSREGREDQRRNNRRPAQPTTTSQGQTEVVEADKAQREEQPQRRGDRQRRRQDEKRQAPQEIKADVAEAPVIEEVQPEQEERQQVMQRRQRRQLNQKVRIQSANDELNTLESPVSAPVAQVVVAEVQEEVKLLPQITAQTDDDSANERTTNNENGMPRRSRRSPRHLRVSGQRRRRYRDERYPAQSAMPLAGAFASPEMASGKVWVRYPVTPVVEQVVVEQVVVEQIAIEQTTTVEQTAIVEQVSVANIVTAQLPVEQVQNTVAEQESSATPSVMTTPTVAVTLAPQHKPGGSSSSAAAVPGRAPIVAAVPVVAETTAAETVVAKTEAAIDAVAVVESIAAVETATVEPVVTEEPNVTEPAVAEPAIETDPVEETTSVVEIAPTVESTPMIEDTAVVVAATVVDTTPETASTVQDDIVEETVVGETAVEAVNISETVAEETAITEPAAEAIATQQTTIAQETIAEPTVETAIDVVAVVKQPAVAHPEGVVFKHFASAPMTKAPAPDYAPESPTKGHWERPTFDFSGKGSAGGHAAATQATAPATKPQSVE

SEQ ID NO: 3683 - protein, 457 aa, Solibacter usitatus
MVIVPGVVLYFNPLPGMNAGQEHLFAFFVATIIALVAQPVPMGVSVLLAMTLVVVTGTLTAAKVLSGFGNVTVWLVFTAFLFSRAVTQTGFGMRVGYLFIERFGKTPLRLGYALAGADLVLAPFIPSDTARGGGVVFPVTRSVAKAFGSEPGATARKMGSFLMLVSFHTTYTASAMFLTGMAANPLIAEFAYKIGHVELTWGRWLSGSILPGMLTLAFVPWLLFRLARPEIQDTTAAREMARKELARRGPMGREEKWLVAIMGAVMAGWVTSPWHGLPNTFVALSGLCALLLARVIAWEDLLAEHRAWDALIWFAPLVMMADAMNENGAIKILSGGLFGLVHGWPWLMVLLLLVTAYCYVHYGFASMTAQVTALYPGFLAAALAGGVPPMMAALPLAYFSSLNAAMTHYGTGSAPVFFGAGYVRQGEWWRLGFLISVVNLVIWLGIGSLWWKLVGIW

SEQ ID NO: 3684 - protein, 220 aa, Oryza sativa
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEEEKAEAVKQMLAAIENLETAFKELSKGKPFFGGDTAGYLDVTLGAVVGWARAGEVLFGRKLFDATRSPLLAAWMERFVALDAVKAVLPDNAELI

SEQ ID NO: 3685 - protein, 250 aa, Arabidopsis thaliana
MTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 3686 - protein, 408 aa, Arabidopsis thaliana
MKSTPKLLLLLLFIINHHVDSGSIVKFLPGFEGPLPFELETGYIGIGEEEDVQLFYYFIKSERNPKEDPLLLWLSGGPGCSSITGLLFENGPLALKSKVYNGSVPSLVSTTYSWTKTANIIFLDQPIGAGFSYSRIPLIDTPSDTGEVKNIHEFLQKWLSKHPQFSSNPFYASGDSYSGMIVPALVQEISKGNYICCKPPINLQGYILGNPITYFEVDQNYRIPFSHGMALISDELYESIRRDCKGNYFNVDPRNTKCLKLVEEYHKCTDELNEFNILSPDCDTTSPDCFLYPYYLLGYWINDESVRDALHVNKSSIGKWERCTYQNRIPYNKDINNSIPYHMNNSISGYRSLIYSGDHDLVVPFLATQAWIKSLNYSIIHEWRPWMIKDQIAGYIIYFCVIHENLFQ

SEQ ID NO: 3687 - protein, 440 aa, Unknown
  Nostoc sp. PCC 7120
MSNQGAFDGAANVESGSRVFVYEVVGMRQNEETDQTNYPIRKSGSVFIRVPYNRMNQEMQRITRLGGKIVSIQTVSALQQLNGRTTIATVTDASSEIAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 3688 - protein, 440 aa, Cellvibrio mixtus
MVAESNSAVAPTANVATSPAHEHFVRVNGGHFELQGKPYVITGVNMWYAAYLGAPNEVGDRDRLAKELDNLKAIGVNNLRVLAVSEKSEINSAVKPAVTNGFGNYDETLLQGLDYLLVELAKRDMTVVLYFNNFWQWSGGMTQYMAWIEGEPVQDPNVTNEWEAFMAKSASFYRSEKAQQEYRKTLEKIITRVNSINGKAYVDDATIMSWQLANEPRPGNSQTTAEEKQIYIDWVHAAAAYIKTLDAHHLVSSGSEGEMGSVNDMQVFIDAHATPDIDYLTYHMWIRNWSWFDKTKPAETWPSAWEKAQNYMRAHIDVAKQLNKPLVLEEFGLDRDMGSYAMDSTTEYRDNYFRGVFELMLASLEQGEPSAGYNIWAWNGYGRTTRANYWWQEGDDFMGDPPQEEQGMYGVFDTDTSTIAIMKEFNARFQPKLEHHHHHH

SEQ ID NO: 3689 - protein, 243 aa, Oryza sativa
MAAEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMELVPNKGGKPLLRAATPSGFLDVALGGLLSWLHGTEELCGAKILDAAKTPLLSAWARRFGEMDAAKVALPDVCKLVEFAKMKRVQLEAAMAATTVSRN

SEQ ID NO: 3690 - protein, 386 aa, Arabidopsis thaliana
MMNPPVDLPYIPDDLLLNCLARVSRLYYPILSLVSKRFRSLVASLELYEIRKLLGHREKCLYLNLRFSSESEPRWFTLCRRPTRSPNPNFNSGWFASCFIPHTMKKEKKSSDNNLMVPVPTSNFITPPSELTRITNGSNIYIVRVFTNGAFSSRFLFMDCRSHTLHEVPRMDKTKKKPFMIRVLDGKIYVIEGCKNPDYSNLIERFDLKTQTWEHVPSPSAEIRGSYITGSLVYDGKLYLFGDKRVVYKPKENKWDVVGLEMPLRWTPSYISCVVDNVIYSYGRSRVLMWYNTEERLWRYLKGLKKLPKLPKDCTCVRLLGYSGKVVVLWEKNVGGGDPQKKMIWCAEIALERRSANKIYGKIEWCDVVLTLPRSCSLLNFAAVTV

SEQ ID NO: 3691 - protein, 465 aa, Bradyrhizobium japonicum
MQHDAIAERRNNIAPIPFEADAPFLKIIGELPRELNGTLYRNGPNPQFDASGAHWFVGDGMLHAFHLENGRASYRNRWVRTPKWLAEHDAGRALFGGFGRKLPDAPADLTDGGVANTNIIFHAGKLLALEEAHLPTEIEPGTLATRGYHNYQGRIASSFTAHPKIDPVTGEMLFFGYNAAGPLTPALSFGSIDACGKATRFERFEAPYASMVHDFIVTANHVLFPILPIAGSMERAMSGRPPYAWEPDKGAYVGVMKRNGTAKDIVWFRGEACYVFHIMNAWEEGNRIVADVMQFEEAPLFPHPDGRPTDPEKSRARHCRWTFDLSGNTDRFQQTYLDDLTGEFPRIDDRRAGLKSRHGWYACANPKLPMFGALSGIVHVDGNGKRLGHYLLPAGDTISEPVFVERSSDAAEGDGWLLAVVWRARENRSDLAVFNATDIEAGPAALVQLGHRVPDGFHGNWVGAA

SEQ ID NO: 3692 - protein, 324 aa, Triticum aestivum
MATLVLYQFFLKLLLLISVFQLSFAARRLNQLVQDQSQLLHYHNGPLLYGKIAVNLIWYGHFKPSQKAIITDFVTSLSSPSSQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGIVINLASLLAGTATNPFGNGYFQGPAEAPLEAASACPGVYGKGAYPGYAGNLLVDSATGASYNVEGDNGRKYLVPALYDPSTSSCSTPV

SEQ ID NO: 3693 - protein, 388 aa, Methanosarcina barkeri
MATTRDYYDILGLSKDASSEDIKKTYRKLALKYHPDRNKEPGAEEKFKEISEAYAVLSDDEKRAQYDRFGHAGINGQYSAEDIFRGADFGGFGDIFEMFFGGGGRRGPMGPRRGSDLQYDLYITFEEAAFGVRKDIDIPRTERCSNCSGTGAKPGTSPKRCPTCGGTGQIRTTRSGLGMQFVSTTTCNTCHGRGQVIESPCPVCSGTGRVRNTRKITVNVPAGADSGMNLRLSGEGDSGEPGAPSGDLYVVLHVMEHPYFKRVDYDVISELPISFAQAALGTDIMVDTLHGKVKMNIPAGTQTHSVFRLKDKGIQRLHGSRKGDQLVRVVIKTPKKLTHEQKELLRQFEALSNGKNPNEDEKDRNEKSTEKSRKSKGFFEKVKDAFEG

SEQ ID NO: 3694 - protein, 339 aa, Unknown
  Bradyrhizobium sp. BTAi1
MLRLDKFKKYPLTFGATPIEHLPRLTAALGGKVQIYAKRDDCNSGLAMGGNKLRKLEYIVPDAIESNADTLVSIGGVQSNHTRMVAATAAKIGMKCVVVQESWVPHEDAVYDRVGNILMTRLMGADSRIVPDGFDIGIRKSWEDAIQSVKDAGGKPYGIPAGASVHKFGGLGYVGFAEEVRAQEAEMGIKFDYIIVCVVTGSTQAGMIVGFAADGRADRVIGIDASGTPEQTRTQVRQIVDNTAELVELGRKVRDDEIVILEDYAYPAYGVPSAETNEAIRLAARTEAMITDPVYEGKSMQGMIDLVKKGYFPEGSKVLYAHLGGAPAINGYSYTYRNG

SEQ ID NO: 3695 - protein, 252 aa, Prochlorococcus marinus
MNPISIVGAGPGALDLMTIRAQQRIKSADVLLWTDSLIPIQITNFVKDDCEKIKTSSLTLEEILLILIKKHKEGKKIVRLHDGDPCLYGAISEQICRLNDEGIEVEVVPGVSAYQATAATLGFELTVPDLTQTIILSRADGRTGKPERESLQKLASIQSSLCLYLSARHVEEVQSILIKYYPANTPVAIAYRVTWPDEWIKVIPLNEMAKTSQEQNLIRTTLYIISPTLKIGNNRSKLYNPTHSHLFRSSSR

SEQ ID NO: 3696 - protein, 263 aa, Campylobacter jejuni
MVSMRDLLECGVHFGHQTRRWNPKMKKFIFGERKGIYVIDLQKTLRYFRYTYNIVRDAAAEGKTILFVGTKKQAGGAIKEYAEKCGMPYVNHRWLGGMMTNFGTIRQSIRKLEVIEKMEEDGSIKLLTKKEALMLTRKKEKLLAYLGGIRYMKTQPDMIFVIDTVKEKIAVQEANRLRIPVVAPLDTNCDPDLVTYPIPGNDDAIRSVQLFCQEMAEAINEGKALREQDGEALVNEEKEITDEEKKEVLDEAMSEEDFGEEQE

SEQ ID NO: 3697 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFALLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKDEFHQETCRKIKALHKYDCLRANKSTFAWGLEARVPFLDKDFIRVAMNIDPEYKMIKKEEGRIEKWVLRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 3698 - protein, 320 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 3699 - protein, 715 aa, Actinobacillus pleuropneumoniae
MNPIVKQFKYGQHTVTLETGAIARQATAAVMASMDDTTVFVTVVAKKEVKEGQDFFPLTVDYQERTYAAGRIPGGFFKREGRPSEGETLIARLIDRPVRPLFPEGFFNEIQVIATVVSVNPQISPDLVAMIGASAALSLSGVPFNGPIGAARVGFINDQFVLNPTTSEQKISRLDLVVAGTDKAVLMVESEADILSEEQMLSAVVFGHQQQQVVIENIKEFVKEAGKPRWDWVAPEPNTALINQVKALAEARIGDAYRITEKQARYEQIDAIKADVIAQLTAQDETVSEGAIIDIITALESSIVRGRIIAGEPRIDGRTVDTVRALDICTGVLPRTHGSAIFTRGETQALAVATLGTERDAQIIDELTGEKSDRFLFHYNFPPYSVGETGRIGSPKRREIGHGRLAKRGVLAVMPTAEEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKGARMHILSVMEQAIPAPRADISDFAPRIHTMKIDPKKIKDVIGKGGAVIRALTEETGTSIDIDDDGTVKIAATDNNAAKAVMARIEDIVAEVEVNAIYKGKVTRVVDFGAFVSILGGKEGLVHISQITNERVERVADYLSVGQEVTVKVVEIDRQNRIRLTMKDLNNDTPVAENVTEEAEVSSEQQAEI

SEQ ID NO: 3700 - protein, 467 aa, Actinobacillus pleuropneumoniae
MSKFPTVSEILSGKVAVGEEVAVRGWVRTRRDSKAGLSFLAVYDGSCFDPIQSIINNDLANYNDEVLRLTAGCSVIVTGKVVESPAEGQAVELHATHVEVVGWVEDPDTYPMAAKRHSIEYLREVAHLRPRTNLIGAVARVRHCLAQAIHRFFNEQGFYWVATPLITASDTEGAGEMFRVSTLDLENLPRTEEGKVDFSQDFFGKESFLTVSGQLNGETYACALSKVYTFGPTFRAENSNTTRHLAEFWMVEPEFAFATLADNAKLAEDMLKYVFKAVLEERKDDMQFFAKHIDKDVITRLENFIAAPFAQVDYTDAIEILLKSGKEFEFPVSWGIDLSSEHERFLAEEYFKSPVVVKNYPKDIKAFYMRLNDDGKTVAAMDVLAPGIGEIIGGSQREERLDVLDTRMVEMGLNPEDYWWYRDLRKYGTVPHSGFGLGFERLIVYVTGLQNIREVIPFPRAPRNANF

SEQ ID NO: 3701 - protein, 420 aa, Bradyrhizobium japonicum
MSAVGNEPLARQALAFVLAGGRGSRLLELTDRRAKPAVYFGGKSRIIDFALSNAVNSGIRRIAVATQYKAHSLIRHLQMGWNFFRPERNESFDILPASQRVSENMWYVGTADAIYQNIDIIESHNARFIVVLAGDHIYKMDYEVMLRQHVDSGADVTVGCLEMPRAESSGFGIMHIDENGWIQEFLEKPADPPPMPGKPDVSLASMGIYVFDAKFLFDQLKRDAEDPSSNHDFGKDIIPYIVKNGRAIAHQFSTSCVRSGDDPRAYWRDVGTVDAYWAANIDLTDVVPELDLFDRAWPIWSYSEITPPAKFVHDEESRRGQAVSSLVSGGCIISGASLRRSLLFTGVRINSYANVENAVIMPYVNVGRGARLKNVVIDRGVEIPEGLVIGEDPELDAKRFRTTEQGISLITQPMIDRLNT

SEQ ID NO: 3702 - protein, 390 aa, Gluconobacter oxydans
MSQTISASSAAAESTSPHTDRVIAPDIGEYSPVEDVVRKTGDLRRVLSNPDYWYPVAWSRELKRGKTIGTRYAGQPIALVRPMDGSVFALEDRCAHRQVPLSLGKVSGEAVQCCYHGWAYGRSGRCIDVPYLGKGKLPNGVRTYPCREEGGLIFIFPGDPAKAESTPFPQLGSVGNPEYKTRRFGETVACHYSFMHENLMDMNHQFMHMKQMGQMKPRFLGGRDEPTLVEARYSFARTGGKQPWGETFIFGERRDASEKYAHKDVMTIRTEYPYQTLRIATGDEPPVMDLWIVYVPQDAEEKTCRVFGLLSIRRPKAKLVLDIAWPFLVAFTERIFKEDRDIVELEQAAWNELGGDHNQEVFPVINMLRRLLVRCGVPADKPAADQVSSS

SEQ ID NO: 3703 - protein, 279 aa, Exiguobacterium sibiricum
MEQKLKLWFTEHQTEDYGITFRVNHVYESEQTEFQRLEMVETDEFGTMLLLDGMVMTTDRDEFVYHEMVAHVPLFTHPNPKSVLVVGGGDGGVIREVLKHPSVEKAVLVEIDGKVIEYSKKYLPNIAGGLDDARVEVIVGDGFMHIAEAVNEYDVIMVDSTEPVGPAVNLFTKGFYSGISKALKEDGIFVAQSDNPWFTPELIRDVQRDVKEIFPITKLYIANVPTYPSGLWTFTIGSKKHDPLAVAPERFHEIETKYYTPELHTAAFALPKFVKDLTI

SEQ ID NO: 3704 - protein, 234 aa, Prochlorococcus marinus
MAVVSLSEMMEAGAHFGHQTRRWNPKMSKYIYCARNGVHIIDLVKTALCMNNAYKWTRNAAKSGKRFLFVGTKKQASDVVAQEAVRCGAAYVNQRWLGGMLTNWSTMKARIERLKDLERMESSGAIAMRPKKEAAVLRRELERLQKYLGGLKGMRRLPDVVVLVDQRRESNAVLEARKLDISLVSMLDTNCDPDLCEVPIPCNDDAVRSVQLILGRLADAINEGRKGSNDQRKV

SEQ ID NO: 3705 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISMIYILISTGNLRWLARIIEKLEHKIIMQRRKKQRGQRNYRRRNNHF

SEQ ID NO: 3706 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIMQRRKKQRGQRNYRRRNNRF

SEQ ID NO: 3707 - protein, 1128 aa, Pseudomonas syringae
MCAERRFRQPGNRRYYMKRMLINATQPEELRVALVDGQRLYDLDIESGAREQKKANIYKGRITRIEPSLEAAFVDFGSERHGFLPLKEISREYFKKAPEGRVNIKDVLSEGQEVIVQVEKEERGNKGAALTTFISLAGRYLVLMPNNPRAGGISRRIEGEERNELREALNGLIAPADMGLIVRTAGLGRSSEEMQWDLDYLLQLWTAIKEASLDRSAPFLIYQESNVIIRAIRDYLRQDIGEVLIDSVEAQEEALTFIRQVMPQYASKIKLYEDSVPLFNRFQIESQIETAFQRVVELPSGGSIVIDPTEALVSIDINSARATKGSDIEETALQTNLEAAEEIARQLRLRDIGGLIVIDFIDMTPAKNQRAVEEKVRESLEADRARVQVGRISRFGLLEMSRQRLRPSLGESSGIVCPRCNGTGIIRDVESLSLAILRLIEEEALKDRTAEVRAQVPIPVAAFLLNEKRNSITKIELRTRARIIILPNDQLETPHFEVQRLRDDSPEAHNSQTSYEIAAAAAEVEEIAPLAAATRTLVRQEAAVKTAPARANAPVPVEVAAPAPTPAPVAHEPSLFKGLVKSLVSLFATKEEPVVAPAVVEKPAAEQRPARNEERRNGRQQSRGRNNRRDEERKPREERAPREERAERAPREERAPREERAPREERAVREPREAREESAPREERPARTSRERKPREAREDRPVRELREPLDAVATAAQAGPAVNLAREERPERAPREERQPRAPREERQPRAEQAAVAVSEEEEVLLNDEQANDDNQDGNDGSEGDRPRRRSRGQRRRSNRRERQRDANGNVIEGSEENGSEENGAEETVNDEDNSATDLSAGLGFTAAAASGVISATAEADAHQQAERANSTTQSAPAAEPVQQAAVAHAPVVETPAVEAPVAETSAVETPAPQAPAAEQTAEVPAVEAPVADDAPVAQPAPEVEVQPAAVEAPAIAAQTELFEAPHAERVVPFTPTPAPAPQAPVEAAAHEQVPATESSELPTPVEAPAAEPAAFVKDEPAPYIAPQAAVEEQASAPAEQEPVIVETPAVPVSSTGRAPNDPREVRRRKREEEARRQQETTAASAQAESAQPSQATEEKTDVATTEQPAVQPHHEAEKETEPKPLV

SEQ ID NO: 3708 - protein, 415 aa, Chlamydomonas reinhardtii
MALNMKQQQAGLSRKAARSVSSRAPVVVRAVAAPVAPAAEAEAKKAYGVFRLSYDTQNEDASLTRSWKKTVKVAVTGASGNIANHLLFMLASGEVYGKDQPIALQLLGSERSKEALEGVAMELEDSLYPLLREVSIGTDPYEVFGDADWALMIGAKPRGPGMERADLLQQNGEIFQVQGRALNESASRNCKVLVVGNPCNTNALIAMENAPNIPRKNFHALTRLDENRAKCQLALKSGKFYTSVSRMAIWGNHSTTQVPDFVNARIGGLPAPDVIRDMKWFREEFTPKVALRGGALIKKWGRSSAASTAVSVADAIRALVVPTAPGDCFSTGVISDGNPYGVREGLIFSFPCRSKGDGDYEICDNFIVDEWLRAKIRASEDELQKEKECVSHLIGMMGGSCALRGAEDTTVPGEN

SEQ ID NO: 3709 - protein, 390 aa, Triticum aestivum
VIRTQLKRKATREENNAAESSDCMIVTTGVTGNPLLTPVSGKAVKNSKSKTKNNKAGPQTPTPNVGSPLNPSTPAGTCRYDSSLGLLTKKFINLLKQAEDGILDLNNAAETLEVQKRRIYDITNVLEGIGLIEKTLKNRIRWKGLDDSGVELDDGLSGLQTEVENLNLQEQALDERISDMREKLRGLTEDENSQRWLYVTEDDIKGLPCFQNETLIAIKAPHGTTLEVPDPDEAGDYLQRRYRIVLRSTLGPIDVYLVSQFDDGFENLGGAATPPRHTNVPKPGPCEDLHATNATQSSKSINVEYNIQHRQNTPQDPSSSNDYGGMTRIIPSDVNTDADYWLLTEGDVSITDMWETAQVQWDTAVFLPEDVSTPHAHHRPRMQVPSMDQP

SEQ ID NO: 3710 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 3711 - protein, 107 aa, Unknown
  Saccharum hybrid cultivar SP-80-3280
MTEKKNRREKKNPREAKVTFEGLVTEALPNGMFRVRLENDTIILGYISGKIRSSSIRILMGDRVKIEVSRYDSSKGRIIYRLPHKDSKRTEDSKDTEDLKDTKDSKD

SEQ ID NO: 3712 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEVEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 3713 - protein, 264 aa, Oryza sativa
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNVSTVLYTVLAMAMSPKLFDEQLLVISLVVLQMFPGMAGVLFAATEEERAAKAEETLAALAQLEKAFAECAGGKAFFGGDSIGYVDLALGSNLHWFEALRRLFGVALLDAGKTPLLAAWAKRFVEAEAAKGVVPDAGVAVELGKKLQARAAAASTAA

SEQ ID NO: 3714 - protein, 236 aa, Oryza sativa
MAGSGELKLLGVWSSPYAIRVRVVLNLKSLPYEYVEENLGDKSDLLLASNPVHKSVPVLLHAGRPVNESQVIVQYIDEVWPGDAGGRPSVMPSDPYERAVARFWAAYVDDKVRPAWLAILFGSKTEEERAAAVAQAVAALETLEGAFGECSKGKPFFGGDGVGFVDVVLGGYLGWFTAIDKLIGRRLIDPARTPALAAWEERFRATDAAKGVVPDDADKLLEFRQTLLRWSASKAK

SEQ ID NO: 3715 - protein, 444 aa, Oryza sativa
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 3716 - protein, 483 aa, Burkholderia xenovorans
MMERGGDMQRSTETTELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 3717 - protein, 265 aa, Unknown
  Nostoc sp. PCC 7120
MPVVSLAQMMESGVHFGHQTRRWNPKMSPYIYTSRNGVHIIDLVQTAHLMDEAYNYMRSQAEQGKKFLFVGTKRQAAGIIAQEAARCGSHYINQRWLGGMLTNWATIKTRVDRLKDLERREESGALDLLPKKEASMLRRELAKLQKYLGGIKTMRKVPDVVVIVDQRREYNAVQECQKLSIPIVSMLDTNCDPDVVDIPIPANDDAIRSIKLIVGKLADAIYEGRHGQLDVEEEYEDYEGSEEDYDYDETEYADSVIPEDGEEAE

SEQ ID NO: 3718 - protein, 458 aa, Unknown
  Acinetobacter sp. ADP1
MTDQHAHELKKGLSNRHVQLIALGGAIGTGLFLGISHTIQLAGPAVLLGYAIAGMIAFLIMRQLGEMVVEEPVSGSFSYFAHKYWSSMAGFMSGWNYWVLYVLVSMAELSAIGIFVQFWWPQIPTWLTALVFFVLINAINLINVRFFGELEFWFSCIKIIAIISMIGFGAYLLLSGTAGAHAGIANLWQHGGFMPNGWTGLIIAMAFIMFAFGGLELVGIAAAETKNPTQTIPKATNQIVYRILIFYIGAIAILLSLYPWNQVAQGGSPFVMIFQSLNNTGVAHVLNMVVLIAAISVYNSCVYSNSRMLLGLAEQGNAPKLLKRVNARGIPVYAVYASVMVTALCVLLNYVMPEKAFNLLMMLVVAALVINWLMISITHLKFRQYMLEAGRKPIFRSLGAPFTNYITIAFVFFILLIMSYTSEMRIAVFLVPVWLGILYIFYRFKAPASKMTESVLDQ

SEQ ID NO: 3719 - protein, 312 aa, Aspergillus oryzae
MSTPGDYDAVRRDIVAQLKKPDYDDGSAGPVFVRLAWHSAGTYDAESDTGGSNGAGMRYEAEGGDPANAGLQHGRAFLEPVKERHPWITYSDLWTLAGVVAIKELGGPEVEWKPGRTDLVDDSKVPPRGRLPDAAQGAEHLRFIFNRMGFNDQEIVALAGGHNMGRCHMDRSGFHGPWVNNPTRFSNQFYNLLLKLEWTPKTLENGIQQFVYVDPDAEEGDEQLMMLPTDVALITDPKFRVWVERYAQDKELFFDHFAKVFAKLIELGIKRDAKGVIINSDNVKGGYVSAPKKSNVPTGLSQRGGGCPMARL

SEQ ID NO: 3720 - protein, 351 aa, Chlamydophila caviae
MAMHLLEKFKAQRVSLLSRELVSCCDSSIASSDAGHVYQLFFNTTNSNLSYKVGDSLGIFPKNSLSVVGKILECLGYSPKQLVQTRESSHITFYDFLRCHANIDKIPAKLKSFFPDVEDSTSLYDAIQKYQPTISLELFTQSVLPLLPRFYSIASAPHPTEGKIELLVRLVSYSGEYEQRHGVCSFFLCKELEIGEECYAFVQPTKHFTIGDHVQNKPIVMIGSGTGIAPYKGFVQQRIYNNDPGMNLLFFGERFEKANFYYQNFWKKAIKNELLKLFLAFSRDGDQKIYVQDLLRKERELVLRACEEGAHFFVCGSKTLGSEVKKTLEDILGKDKLSQLKEERRYVIDVY

SEQ ID NO: 3721 - protein, 324 aa, Unknown
  Cymbidium hybrid cultivar
MESGSFPVINMELLEGSSRPEAMAVLRDACQNWGFFELLNHGISHELMNRVEAVNKEHYRRFREQRFKEFAAKTLASGEEVDSDNLDWESTFFLRHLPTSNISEVPDLDDDCRSTMKEFAREVEKLAESLLDLLCEDLGLEKGYLKRVFCGGSDGLPTFGTKVSNYPPCPKPELIKGLRAHTDAGGIILLFQDDKVSGLQLLKDGEWVNVPPMRHSIVINIGDQLEVITNGKYKSVLHRVVAQTDGNRMSIASFYNPGSDAVIFPAPALVEREAEEKKIETYPKFVFQDYMNLYVRQKFEAKEPRFEAMKSMESVSSSQLIPTA

SEQ ID NO: 3722 - protein, 873 aa, Cylindrotheca fusiformis
MCKTTESGAEAMYGPYPSAVPVPHIDKDGNTPPLDDVKGAKSYKDLDKYPDHRDLKTPDEWIPRDGRLVRLTGRHPFNVEPPMSELRKTRFITPSSLHYVRNHGACPRLTWEDHTLLLGGDVTHKMELTMDELVASGPHREIPVTLVCAGNRRKEQNMIRQTIGFSWGPCGVSTNVYKGVLLRDLLIKAGVSDKHMRGKHVEFIGVEDLPNKVGPGPFPDEPWGKLVKYGTSIPLSRAMNAAYDVMVAWEANGERLLPDHGYPVRLIIPGYIGGRMIKWLKEINVIDHETKNHYHYHDNRILPPHITAEESLKGQWWYKPEYIFNELNINSAIASPLHDEELPIAKNIDKSYNVSGYAYTGGGRMITRVEVSTDGGIHWELATLDRKEMPTEHDMYWCWVWWDYELKVADLVGCKEIWCRAWDESNMCQPIHPTWNLMGMGNNQVFRLKVHMDKKASGQHVFRFEQPTQPGQLAGGWMTKLAGKPISAGFGRLLDLAGDSVPSCPPSDAEKKDTSGKKTFTMEEIRKHNTEEDCWIIVNNRVYDATEYLELHPGGTDSIVINAGEDATEDFVAIHSMKATKMLEKYYIGDLDTAAASVNKREEEDLVDSKGNKLALNPRRKTQFRLQNKIVLSRDSFMLDFALPTPQHVLGLPTGKHMFMSAVINGETVLRRYTPISSNYDVGCVKFVIKAYRPCERFPSGGKMSQYVDNLKIGDVMDFRGPVGEFEYVADGNFLLDGEECHGTKFNMVAGGTGITPCMQIAAEILRHPLDNTQISLIFAAREEGDLLMRSTLDEWAANFPDKFKVHYILSDSWPTDWKYSTGFVDRKLFSDRFFSAGDGVYNLMCGPPVMLDRGCTPNLTALGHKKSSIFSF

SEQ ID NO: 3723 - protein, 290 aa, Mycobacterium smegmatis
MTQWTSADLPSFRGRTVVITGANSGLGLVTARELARVGAKVIVAVRNLDKGTAAAETMPGGIVEVRKLDLQDLASVHEFADTVETVDVLVNNAGIMAVPLARTVDGFESQIGTNHLGHFALTNLLLPKISDRVVTVSSMMHWIGRINLRDLNWKARPYSAWLAYGQSKLANLMFTSELQRRLVASGSSVRALAAHPGYSATNLQGHSGNRFGTAAAALGNRHLATDVTFGARQTLYAVSQDLPGDTFVGPRFGQWGPTGSVGRSPLARRTDTQRALWELSEQLTGTTYPL

SEQ ID NO: 3724 - protein, 829 aa, Vibrio vulnificus
MKMTRRAFVKANAAASAAAVAGITLPASAANLIASSDQTKITWDKAPCRFCGTGCSVLVGTQNGKVVATQGDPEAPVNKGLNCIKGYFLSKIMYGQDRLTQPLLRMKDGKYDKEGDFTPVSWDVAFDTMAEKWKASLAKKGPTSIGMFGSGQWTVMEGYAAAKMMKAGFRSNNIDPNARHCMASAVVGFMRTFGIDEPMGCYDDFEHADSFVLWGSNMAEMHPVLWTRITDRRLSHPHVKVNVLSTYYHRSFELADSGYIFKPQSDLAIANFIANYIIQNDAVNWDFVNKHTNFKQATTDIGYGLRDDDPLQKQAKNPNSGNMTSISFEEYKKSVAPYTVEKASEMSGVAQDKLIELAKQYADPNTKVMSLWTMGMNQHTRGVWMNSLVYNIHLLTGKISTPGNSPFSLTGQPSACGTAREVGTFAHRLPADMVVANPKHRAIAEKIWKLPEGTIPPKPGFHAVLQDRMLHDGVLNCYWVQCNNNMQAGPNINGERLPGYRNPENFIVVSDPYPTATAQAADLILPTAMWIEKEGAYGNAERRTQAWYQQVGTVGEAKSDLWQVMEFSKRFKMEEVWPEELLAKAPQYRGKTMYDMLFANGQVDKFPLSEARQLNDDSHHFGFYVQKGLFEEYAEFGRGHGHDLAPYDVYHTVRGLRWPVVDGKETLWRYKEGSDPYAKKGSGWDFYGKPDGKALIISAPYEAPPESPDAEYDMWLCTGRVLEHWHTGTMTRRVPELYKAVPDAVCYIHPEDAKARGLRRGDEVLISNKRGEVRVRVETRGRNRPPQGLVFVPFFDARILINKLILDATDPLSKQTDFKKCPVKITKVA

SEQ ID NO: 3725 - protein, 85 aa, Glycine max
  misc_feature (37)..(37): Xaa can be any naturally occurring amino acid
  misc_feature (52)..(52): Xaa can be any naturally occurring amino acid
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 3726 - protein, 112 aa, Haemophilus ducreyi
MKKIEAIIKPFKLDDVREALTDVGITGMTVNEVKGFGRQKGHTELYRGAEYAIDFLPKIKLEIIVTDEQVESCINAIIETAQTGKIGDGKIFVYDVERVVRIRTGEENEEAL

SEQ ID NO: 3727 - protein, 55 aa, Adenia gummifera
WEYQVGPSVGIEAGDHIWCSRYILERITEQAGVVLTLDPKPIEGDWNGAGCHTNY

SEQ ID NO: 3728 - protein, 238 aa, Actinobacillus pleuropneumoniae
MAQVSMRDMLNAGVHYGHQTRYWNPKMKPFIFGARNGVHVINLEKTLPLFNEALAELTRISSNNGKILFVGTKRAASEAVKAAAVDCQQFYVNHRWLGGMLTNWKTVRQSIKRLKDLETQTQDGTFDKITKKEALMRTRELEKLELSLGGIKDMAGLPDAIFVIGADHEHIAIKEANNLGIPVFAIVDTNSTPDGVNYIIPGNDDATRAIQLYLDAAAAAVKEGRGSNVEAELEATAE

SEQ ID NO: 3729 - protein, 499 aa, Glycine max
MEFLTLSVTVAAAAFSILFFFLRHAGAGAGSLPPVPAVPGLPVIGNLLQLKEKKPYKTFTQMAHKHGPIYSIRTGASTLIVLNSPLLAKEAMVTRFSSISTRKLSNALKILTSDKCMVATSDYNEFHKTVKRHILTNFLGANAQKRHHIHREAMMENILSQFSEHVKTFSDLAVNFRKIFVTQLFGLALKQALGSNVETIYVEELGSTLSKEDIYKILVVDIMEGAIEVDWRDFFPYLKWIPNRRLEMKIQNLYVRRKAVMKALMNEQKNRMASGKEVNCYFDYLVSEAKELTEDQISMLIWETIIETSDTTLVTTEWAMYELAKDKTRQDRLYEELQYVCGHENVIEDQLSKLPYLGAVFHETLRKHSPAPIVPLRYAHEDTKLGGYHIPAGSEIAINIYGCNMDNNLWENPNEWMPERFLDEKYDHMDLYKTMAFGAGKRVCAGSLQAMLIACTAIGRLVQQFEWELGQGEEENVDTMGLTTHRLHPLLVKLKPRIK

SEQ ID NO: 3730 - protein, 477 aa, Zea mays
MRGSMFCGGDLRWWMLAIFFLCTLIAAAEERVVTHLPGFQGPLPFQLRTGYVEVDEDNGVRLFYYFTLSEGSSADDPVMLWLSGGPGCTSFTGLVYQIGPLSFDLDSYMGGLPKLVYRPESWTKVSNIIFLDSPVGAGFSYSVKEQGYNSSDTKAVSHILVFLKKWFDEHPEFLSNPLYIGGDSYAGMIVPTVTSEIAKGLKIVGSKPTMNLKGCLVGNPFTDQSNFDGPSKIPFAHRMALISDQMYKSYKKSCRGGDNRHQSIQCRNSLDAIDECVKDISEFHVLEPRCAYASPHQYNVLKLKTSLGVQKMQQLPDFTAEGLHLSEISTECRTMLYTLSRIWANNATVREALGIHKGTVPLWLRCNTDIPYLKDIKSSVKYHLDVTTKGYKSLVYSGDHDMGVPYIGTQSWIRSLNFSIVDDWRPWYVDGQVAGYTMLYSNNLTFATVKGAGHTAPEYMPRQCLAMLSRWLAGDTL

SEQ ID NO: 3731 - protein, 214 aa, Oryza sativa
MGRRPARCYRQIKNKPYPKSRYCRGVPDPKIRIFDVGQKKRSADDFPLCVHLVSWEKENVSSEALEAARIACNKYMAKHAGKDAFHLRVRAHPYHVLRINKMLSCAGADRLQTGMAGAFGKPQGVCARVRIGQVLLSVRCATRTAAHAQEALRRAKFKFPGRQRVIFSVQVGFTRFKRDEYLKLKSEGRIVPDGVDRKSRERGSSHPPFAGSAA

SEQ ID NO: 3732 - protein, 910 aa, Desulfotalea psychrophila
MSLRNFFLALFFAVLFFFSSAIAFAGWQEAPVVLILNSYHQGFGWGDAEVEAEIDVLRENFPEMSLYIEHMDQKRFPGEEGERHTLQQLEFKFAKFSPDIIIANDNIAFAFALRLRDLLWSDIPIVFSGYNGDDRLLDSLGSGVTGVFEEIDAVGTINMALKLQPGIKHVFVVVEDTITGRAVLTNVQPKLRQFGDRLRFEYLAEKGLPEILARLRLASDESIVLLLPYATSQPGTHMDARSLADLIIETSPVPVYTPYDFHLGLGALGGYVLEGKEQGQLAAELAVKILTTGNIPAPVKEELHFSPVFDNEVLNRFSIEVSELPPGSEVINQLSLGFYEQNTTFINLIALIAILLVSLLLTLLINIHLQRNAERKFVEIFDATSEAVLVCDIDTLQVLEFNRSSELLLGAEEQLVKLTDLRWNFCGEEPYDDQAFQQLIERTVRDGSLTVDWQMKRYSGEKFWAGMTLNYMQIKDVDCLLVVIRDVEQRHQLAGELEAYKFHLEELVDQKTADLQRFQQDLITAKDEAERANQAKSTFVANMSHEIRTPLNGVLGLAQLLEKTSLSVDQRSYVRRILDSGQQLLTTVNDILDFAKMEAGRLEIEESGFSLHALLQPVIDSVFVEEESSPKFCLDVAPGIPENLIGDRFRIGQVLINLLGNALKFTKEGHVSLHVVSMGLGEKGVILKFSIIDTGVGIALDVQKQLFVPFTQADSSVTRNYGGTGLGLTICKKLVVAMGGDIGLESSPGAGSTFWFTLDLGVGQEGDAQNTEAVQVNSVDRKSLLEGLKILLVDDNEINLYMMEAILLAAGAEVTLAENGQECLERLEESSYDLILMDVQMPVLDGYETTRRIRKDEKYRALPIIAITANALSDDIEKCFEAGMNDHVAKPFKIEELDASIAKCLLASRS

SEQ ID NO: 3733 - protein, 951 aa, Vibrio fischeri
MKLTKRSDSVQKQENQLGITRRMFMRTSTIAAGAVASASMFVPSMMKKAQAKEVPVDAPTEVKRTICSHCSVGCGIYAEVQNGVWTGQEPAFDHPFNAGGHCAKGAALREHGHGERRLKYPMKLENGKWKKLSWEQAIEEVGNKALEIRKESGPDSVYWLGSAKHNNEQAYLYRKNAAMWGTNNIDHQARICHSTTVAGVANTWGYGAMTNSFNDMHNCKSILFIGSNPAEAHPVAMQHILIAKEKNSCKIVVADPRRTRTAAKADHYVALRPGSDVAFIWGVLWHVFANKWEDQEFINQRVFGMDEIRTEVAKWNPAEVERVTGITEAEVYETAKLLSENRPGCVVWCMGGTQHTTGNNNTRAYCILELALGNMGKSGGGANIFRGHDNVQGATDLGVLSDTLPGYYGVGEGAWKHWSKVWELDFEWIKGRFDQGKYNGKAPMNNFGIPVSRWVDGVLEDKANIEQNDNIRAMFYWGHAVNSQTRGTEIRKAMSKLDMMVIVDPYPTVAAVMNDRTDGVYLLPATTQFETHGSVTASNRSFQWREKIVEPLFESKPDHEIMYLLSKKLGYADQLFKNIQIDENNQPVIEDITREFNKGMWTIGYTGQSPERIKAHTQNWHTFHKTTLEAEGGPVNGETYGLPWPCWGTPEMKHPGTHILYDTSKPVAQGGGNFRTRFGVEYEGQSLLAEDSYPVGCEIEDGHPEFTDKLLKQLGWWDDLTPEEKVAAEGKNWKTDLSGGIQRVAIKHGCMPFGNAKARAIVWTFPDRVPQHREPLYTPRRDLVADYPTWDDRAANFRIPTLYKTIQDQDKSKEYPIILTSGRLVEYEGGGEETRSNPWLAELQQEMFVEVNPKDANDIGFKDGDMVWVEGAEKGRIHVKAMVTRRVKPGLAFVPFHFGGKFQGEDLRNKYPEGTDPYVIGEAANTATTYGYDPVTQMQETKVTLCKITKA

SEQ ID NO: 3734 - protein, 1399 aa, Vibrio vulnificus
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADEHGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAIRLVADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYALDKVELVTGVKADDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVVDITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 3735 - protein, 350 aa, Triticum aestivum
  misc_feature (74)..(74): Xaa can be any naturally occurring amino acid
  misc_feature (102)..(102): Xaa can be any naturally occurring amino acid
MDMDSVECLSLPDASMDVDDVDSHQHQQHHHSIPIHPVHLAANGGVGGRRVREDECRGRGPRPGEWVLTGGPPXAGPPATSVHELLECPVCTNSMFPPIHQXCQNGHTLCSTCKARVHNRCPTCRQELGDIRCLALEKVAESLELPCKYFSLGCPEIFPYYSKIKHEGQCSFRPSNCPYAGSECAVAGDIPFLVAHLRDDHKVDMHSGCTFNHRYVKSNPREVENATWMLTVFHCFGQYFCLHFEAFQLGMAPVYMAFLRFMGDENEARNYTYSLEVGGNGRKMVWEGTPRSIRDSHRKVRDSHDGLIIQRNMALFFSGGDRKELKLRVTGRIWKEQPNPEGTCIPNLCS

SEQ ID NO: 3736 - protein, 133 aa, Agrobacterium tumefaciens
MSSETVTLYEAIGGDATVRALTRRFYELMDTLPEAARCRAIHPADLSGSEAKFYDYLTGYLGGPPVYVEKHGHPMLRRRHFVAPIGPAERDEWLLCFRRAMDETIENAKLREIIWAPVERLAFHMQNQEADNP

SEQ ID NO: 3737 - protein, 198 aa, Drosera rotundifolia
RYIAVGNEIRPNKYGSEISQYVLPAMQNIQNSLHQLGLSQVKVSTAWDMAVFASTYPPSQGTFDPAIESYTLPIVNFLVSNGSPLLLNCYPYFVFKDTPSLDINYALFTSPGVVVQDGPYGYQNLLFAMVDAAYSALEKAGATEVPIVLSETGWPTEGDVGTSVSNAQTYNNNLIQKVSQGTPKRPGQAIETYIFDMF

SEQ ID NO: 3738 - protein, 639 aa, Solibacter usitatus
MCGIAGFTRLNKYASRGVAQRITEALSHRGPDQQGVFEGSEATLCAVRLKIIDLAGGDQPILSDDGDTAIAFNGEIYNHREVRGELEALGHRFRSNCDTETVLRAFLQWDTAAFQRLRGMFAIALWTESRKRLLLVRDRMGIKPLYYYRSGDDLYFGSELKAILEHPDVPRTLDLSALDTYLSVNYVPGPQTLIRGIRKVPPGHLLEWRHGKAWCEAWWKRPDSGTRRISLGAAKEQLDVLMKDSVREHLVSDVPLGVWASGGLDSSAILHYAAAQTAGRLKTFSVSFEGRSFDESRYFREIAQVYGTDHHEFDLNPDVELQSAIEDFAYYSDEPSADAGALPVWFLSRMSRRHVTVALSGEGADELFGGYLTYQADRLARPFRMVPAGLRRLMRGALDRYMPVSDDKISLEYKLKRWIDGSLLNADEAHFFWNGTFSPEQLRQIRPGTNGNGLQRMVEGLNGPREVVQRYLDVDQSFYLPDDILYKTDRMSMAHSLEVRPPFLDHRIVEFAASLPQRLKIRGAKQKHVLRELMRGKLPESVLTRKKSGFDIPTHDWFRGTLRGMLMDTLTPDAIAATGVFDANAIDGLIRDHMERRINVGYHLWGLLTLFLWMKRWKVEALPPEEEMRQVPARVLATR

SEQ ID NO: 3739 - protein, 426 aa, Lactuca sativa
MPTDIEDEIKDEKNPRPLDEDDIALLKTYGLGPYSNSIKKAEKDVKEMAKRINDLCGIKESDTGLATPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVQLGIDPPKGVLCYGPPGTGKTLLARAVANRTDACFIRVIGSELVQKYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDMESRTQIFKIHTRTMNCERDVRFELLARLCPNSTGADIRSVCTEAGMYAIRARRKTVTEKDFLDAVNKVIKGYQKFSATPKYMVYN

SEQ ID NO: 3740 - protein, 269 aa, Aspergillus nidulans
MEQAQQTSGQQQGRQQPVYDTRQGGHYGASAALAAQGFAPVAELYTGTWANVNQGLQGTARDILTTYWQHVINHLESDNHDYKIHQLPLARIKKVMKADPEVKMISAEAPILFAKGCDVFITELTMRAWIHAEDNKRRTLQRSDIAAALSKSDMFDFLIDIVPREEATSHAKRSSQSAGAPAGPGGPTAAGQLPQTQHGVQHHPHHMAPPDYGALGQHPLQDQEYRQQTMYGGAVQSDPTAAYAQPQTQMFEGMYTAYPHLPPQQVRIG

SEQ ID NO: 3741 - protein, 885 aa, Oryza sativa
LRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 3742 - protein, 542 aa, Aspergillus oryzae
MRVLPATLLVGAASAAVPPLQQVLGRPEEGMSFSKPLHAFQEQLKTLSEDARKLWDEVANYFPDSMDHSPIFSLPKKHTRRPDSHWDHIVRGSDVQKIWVNNADGEKEREIDGKLEAYDLRIKKADPSALGIDPNVKQYTGYLDDNGNDKHLFYWFFESRNDPKNDPVVLWLNGGPGCSSLTGLFMELGPSSIDENIKPVYNDFSWNSNASVIFLDQPVNVGYSYSGSAVSDTVAAGKDVYALLSLFFKQFPEYAEQDFHIAGESYAGHYIPVFASEILAHKNRNINLKSVLIGNGLTDGLTQYGYYRPMGCGEGGYKAVLDEATCESMDNALPRCRSMIESCYNSESAWVCVPASIYCNNALIGPYQRTGQNVYDVRSKCEDESNLCYKGMGYVSEYLNKAEVREAVGAEVGGYDSCNFDINRNFLFHGDWMKPYHRLVPGLLEQIPVLIYAGDADYICNWLGNKAWTEALEWPGQKEYASAELEDLKIEQNEHTGKKIGQVKSHGNFTFMRLYGGGHMVPMDQPEASLEFFNRWLGGEWF

SEQ ID NO: 3743 - protein, 603 aa, Solanum tuberosum
MATTTSHATNTWINPKLSMPSSKEFGFASNSISLLKNQHNRKSLNINSSLQAPPILHFPKQSSNYQTPKTSTISHPIQENNNSSSISKWNLVQKAAAMALDAVEGALTKHELEHPLPKTADPRVQISGNFAPVPENPVCQSLPVTGKIPKCVQGVYVRNGANPLFEPTAGHHFFDGDGMVHAVQFKNGSASYACRFTETERLVQEKALGRPVFPKAIGELHGHSGIARLMLFYARGLFGLIDHSRGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITEKFVIIPDQQVVFKMSEMIRGGSPVVYDKNKVSRFGILDKYAKDGSDLKWVEVPDCFCFHLWNAWEEPETDEIVVIGSCMTPPDSIFNECDEGLKSVLSEIRLNLKTGKSTRKAIIENPDEQVNLEAGMVNRNKLGRKTQYAYLAIAEPWPKVSGFAKVDLFTGEVEKFIYGDNKYGGEPLFLPRDPNSKEEDDGYILAFVHDEKEWNSELQIVNAMTLKLEATVKLPSRVPYGFHGTFINANDLANQA

SEQ ID NO: 3744 - protein, 87 aa, Unknown
  Nostoc sp. PCC 7120
MVRVQEIPLNQIRRPLPRGNDPYKVQALMESIAAIGQQEPIDVLEVDGQYYGFSGCHRYEACQRLGKETILARVRKAPRSVLKMHLA

SEQ ID NO: 3745 - protein, 362 aa, Saccharomyces cerevisiae
MTTAVRLLPSLGRTAHKRSLYLFSAAAAAAAAAATFAYSQSHKRSSSSPGGGSNHGWNNWGKPAALASTTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 3746 - protein, 156 aa, Corynebacterium diphtheriae
MSILDTEVTLINGEKASMDQWAGHCLLIVNTASECGYTPQLETLEELYEDYAMRGFFVIGVPCNQFGEEEPGKDAQVARRYEEKFGVRFPLLAKSDVNGPNTIELYKKLKGDGPDIEWNFEKFIVAPSGEVVGRFAPSLDPDDMKIINVLEEYLPI

SEQ ID NO: 3747 - protein, 427 aa, Unknown
  Nostoc sp. PCC 7120
MTRTNSDFLTNSDPAIAGLINQELQRQRDHLELIASENFTSAAVLAAQGSVLTNKYAEGLPGKRYYGGCEFIDKIEQIAIDRAKQLFGADHANVQPHSGAQANFAVFLTLLKPGDKIMGMDLSHGGHLTHGSPVNVSGKWFQVCHYGVSQQTEQLDYDQIRELALRERPKLLICGYSAYPRIIDFEKFRSIADEVGAYLLADIAHIAGLVATGLHPNPLPYCDVVTTTTHKTLRGPRGGLILTRDAELGKKLDKSVFPGTQGGPLEHVIAGKAVAFGEALKPEFQGYSAQVIDNARTLANQLQTRGLKLVSDGTDNHLMLVDLRSVNMTGKRADQLVSEVNITANKNTVPFDPQSPFVTSGLRLGSPAMTTRGMGEAEFTEIGNIIADRLLNPDSDTVAQDCKRRVAALCDRFPLYPHLEIPVPVLA

SEQ ID NO: 3748 - protein, 55 aa, Unknown
  Adenia sp. Gilbert 9135
WEYQVGPSVGIEAGDHIWCSRYLLERITEQAGVVLTLDPKPIEGDWNGAGCHTNY

SEQ ID NO: 3749 - protein, 104 aa, Zea mays
  misc_feature (11)..(11): Xaa can be any naturally occurring amino acid
  misc_feature (16)..(17): Xaa can be any naturally occurring amino acid
  misc_feature (19)..(19): Xaa can be any naturally occurring amino acid
  misc_feature (32)..(32): Xaa can be any naturally occurring amino acid
  misc_feature (36)..(36): Xaa can be any naturally occurring amino acid
  misc_feature (38)..(38): Xaa can be any naturally occurring amino acid
  misc_feature (48)..(48): Xaa can be any naturally occurring amino acid
  misc_feature (62)..(62): Xaa can be any naturally occurring amino acid
  misc_feature (71)..(71): Xaa can be any naturally occurring amino acid
MPAPDGWTKKXTPQRXXRXEIVFVSQLAREIXKQRXLXQYLRAHLGGXCCFKFDWGTGDTPXRSARINKKXRFFDSPKGGKNPKPKRNSGGRKGRQGKKGTPWK

SEQ ID NO: 3750 - protein, 298 aa, Campylobacter jejuni
MMRIAVIGAGKWGSALHLALKENHNCFISSLHQRDLEDFVSIKEALECEYLVFALSSQGMRAWLKENFINKGQKILIASKGIEDQSCQFLDEIFLDFVPKENFCVLSGPSFAAEVMQKLPTALMISGINQELCKKFASFFPDFIKTYIDNDVRGAEICGAYKNVLAIASGISDGLKLGNNARAALISRGLIEMHRFGKFFGTKEETFLGLSGAGDLFLTATSVLSRNYRVGLKLAQNQKLDSILAELNEVAEGVKTAYAIEKLAKMKGIYTPIVNEVVAIFKGKSVQEATQNLLKQND

SEQ ID NO: 3751 - protein, 60 aa, Unknown
  Dilkea sp. Gilbert 9246
SPMGGVMPGQWEYQVGPSVGIDAGDHIWCSRYILERITEQAGVVLSLDPKPIEGDWNGAG

SEQ ID NO: 3752 - protein, 294 aa, Oryza sativa
MAAATSTAAYWLAEHPAIVSFRWSPTGLWFSTWAFLLGFLASYVALCLALDAILAALLRRRRPLPLGPLPAAHALLMAAVSAAIFAGTLLSALAEIRDTRWSWRGRSRTTPFRWLLCFPPGTRSSGRVFFWSYAYYLSRYLHAARGLFAVLQRRRGAAARVFAHAASVAMAFLWLEFSQSFQVLAILASTLAHAVAFGFRFWVGAGLPAARGAPVALACQCALLGCNLLCHVGVVWMHFGGVAGGGCSGIGAWVFNTLLNAALLWVFLHCYGKRGVCDDDGGATAASARHNKDL

SEQ ID NO: 3753 - protein, 211 aa, Triticum aestivum
MLSTSVPNNCTFSPASATPHLTINHDVAADLDSTNAFEGPEKLLEVWFAPSPSTLPPTAAANGLKAVPADTWVPMLDMVNCKVLSVLESDNMDAYLLSESSMFVFPHKIILKTCGTTTLLLGLQRMLHIAAKYGFPYHNANSPDDIQAAATPYRVFYSRKNFLFPEKQQGPHRSWKQEVKYLDDMFDGGSAYMVGKMNGDHWYLYLTSPNQ

SEQ ID NO: 3754 - protein, 58 aa, Passiflora adenopoda
WEYQVGPSVGIDAGDHIWCSRYILERITEQAGVVLTLDPKPIEGDWNGAGCHTNYSTK

SEQ ID NO: 3755 - protein, 55 aa, Passiflora aimae
REYQDGPSVGIDVGDNIWCSRYILERITDQAGVVFILDPNPMEGDGTGAGCPPNS

SEQ ID NO: 3756 - protein, 827 aa, Haemophilus ducreyi
MELSRRDFMKANAAVAAAAAAGIVLPVKNVQADDSGIKWDKAPCRFCGTGCSVLVGTKDGRVVATQGDPDAEVNRGLNCIKGYFLSKIMYGADRVQTPLLRMKDGKFHKEGDFTPVSWDQAFSIMAEKVKATLKAKGGNAVGMFSSGQTTIFEGYAKVKLWKAGLRSNTIDPNARHCMASAAVAFLRTFGMDEPMGCYNDIEKTDGFVLWGSNMAEMHPILWSRISDRRLSDNNVKVVVMSTFEHRSFELADTPIIFKPHSDLAILNYIANYIIQNDKVNWDFVNKHTKFKRGETDIGYGLRPEHPLQKAAKNVKNAGKMHDSSFEEFKKIVEPYTLEKAHEISGVPKHQLEALAKMYADPAQKLVSFWTMGFNQHTRGVWVNHMIYNVHLLTGKISTPGCGPFSLTGQPSACGTAREVGTFVHRLPADMVVMNPKHVEICEKAWKLPKGTIPTVPGYAAVMQSRMLKDGKLNFLWQMCTNNMQGGPNINEEIFPGWRNPENFIVVSDPYPSVSAVAADLILPTCMWVEKEGAYGNAERRTQFWYQQVKGPAQSKSDLWQIVEFAKYFKAEEVWNEELMAQMPEYRGKTLYEILYLNGEVDKYQVPTNIPGYLNDEADDFGFYIQKGLFEEYAQFGRGHGHDLADFETYHQARGLRWPVVDGKETLWRYREGFDPYVKAGEDFRFYGYPDGKAIILGVPYESPAESPDEEYDLWLSTGRVLEHWHTGTMTRRVPELHRSFPNNLVWMHPSDAKKRGLRHGDKVKVITRRGEMISHLDTRGRNKCPEGLIFTTFFDAGQLANKLTLDATDPISGETDFKKCAAKVVKA

SEQ ID NO: 3757 - protein, 311 aa, Desulfitobacterium hafniense
MSKIARSLTDLIGNTPLLELSNYNRTTELEAKVIAKLEYFNPLSSVKDRIGYAMIKDAEEKGLLNKDTVIIEPTSGNTGIALAFVSAARGYRLILTMPETMSVERRNLLKALGAELVLTPGPAGMKGAIQKAEELAAEYKNSFIPQQFNNPANPEIHRQTTAEEIWRDTDGEVDIFVAGVGTGGTVTGVGEALKQKKPGVKVIAVEPADSPVLSGGTPGAHKIQGIGAGFVPGVYSSEVIDEIFQVKNEEAFETSRKLSKTEGLLVGISSGAAAYAATQIAKRPENKGKNIVVLLPDTGERYLSTVLFQEG

SEQ ID NO: 3758 - protein, 75 aa, Passiflora alata
GTNGEVMPGQWEYQVGPSVGIDAGDHIWCSRYILERITEQAGVVLSLDPKPIEGDWNGAGCHTNYSTKSMREDGG

SEQ ID NO: 3759 - protein, 511 aa, Glycine max
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 3760 - protein, 356 aa, Glycine max
MSALADLINLDLSDSSEKIIAEYIWIGGSGLDMRSKARTLPGPVKDPSELPKWNYDGSSTGQAPGDDSEVIIYPQAIFKDPFRRGNNILVMCDAYTPAGEPIPTNKRHAAAKIFSDPTVAAEETWYGIEQEYTLLQKDTKWPVGWPVGGFPGPQGPYYCGVGADKAFGRDIVDAHYKACLYAGINVSGTNGEVMPGQWEFQVGPTVGIAAADQVWVARYILERITELAGVVLSLDPKPIPGDWNGAGAHTNYSTKSMREDGGYEIIKKAIEKLGLRHKEHIAAYGEGNERRLTGRHETADINTFLWGVANRGASIRVGRDTEKDGKGYFEDRRPASNMDPYTVTSMVAETTILWKP

SEQ ID NO: 3761 - protein, 412 aa, Triticum aestivum
MAAAGGATTSTRRGPGGGGRPMDDENLTFETSAGVEVVGSFDAMGIREDLLRGIYGYGFEKPSAIQQRAVIPIITGRDVIAQAQSGTGKTSMISLSVCQVIETNVHEVQALILSPTRELATQTERVMQAVGNFMSVSVHACVGGKSIGEDIRKLESGVHVVSGTPGRVCDMIKRRTLRTRAIKLLVLDEADEMLTRGFKDQIYDVYRYLPPELQVVLISATLPHDILEITSKFMTDPVRILVKRDELTLEGIKQFFVAVEKEEWKFDPLCDLYDTLTITQAVIFCNTKRKVDWLTERMRTNNFTVSAMHGDMPQKERDAIMSEFRGGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 3762 - protein, 397 aa, Oryza sativa
MRHYLICSYAREKLQAVLFLSIRPFSKSLYRRINRFLAELLWLQLVWLVDWWAGVKIQLHADDETYKAMGNEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATGTFDEEIRPIGRPVKSLLAVWGLSGLKLKTWVEAPSFVRAKSEDQGRCFAGTTVTLFWSCLLLYGAVKLFLWTQLLSTWKGVGFTGLGLALVTAVMHVFIMFSQSERSSSAKAARNRVKKD

SEQ ID NO: 3763 - protein, 326 aa, Brassica napus
  misc_feature (312)..(312): Xaa can be any naturally occurring amino acid
MVLMDGRDGSSPPQPKMDAVDSYNQESPSDSFSDAEKVEKKRGGWRAVTFILGNETPERLGTIGLLSNFMVYLTRVFHLEQVNAANVINIWFGFTNLTPLVGAFISDAYVGRFKTIAFASFATLLGLVTLTLTASLPQLHPATCISKDSVSCSGPNKLQFGTLFLGLVFLSIGTGGIRPCSIPFGADQFDQRTEEGVNGVASFFNWYYLTFTVVLLITQTVVVYIQDQVSWIIGFSIPTGLMACALVIFFAGMKLYIYVKPEGSIFSGIAQVVVAARKKRKMKLPAEDDGTATYYDPPVKDSVLPKVHRSNXFRFLNKAAVIKKGT

SEQ ID NO: 3764 - protein, 380 aa, Eremothecium gossypii
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGG

SEQ ID NO: 3765 - protein, 304 aa, Aspergillus nidulans
MQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGG

SEQ ID NO: 3766 - protein, 398 aa, Zea mays
MSRRLYQHAAVMSAWAPAAYTLVLLLYLLAGAVVTAKTNNGVDPGPRQQEPSMPVDSSGDEALSALTCTEPSRARQLAVLSCGPYDVFIYGRRLRLHSPPKEARSPEGMATGSEASKAAEAVVDWHKQDSKRMLHAVYRVGDLDRTIKYYTECFGMKLLRKRDVPDEKYTNAFLGFGPENTNFAVELTYNYGVDKYDIGTGFGHFAIANDDVYKLAENIKSKGGKITREPGPVKGGSTVIAFAQDPDGYMFELIQRADTPEPLCQVMLRVGDLERSIKFYEKALGMKLLRKKDVPDYKYTIAMLGYADEDKTTVLELTYNYGVTEYSKGNAYAQVAIGTNDVYKSAEAVDLATKELGGKILRQPGPLPGINTKIASFVDPDGWKVVLVDNTDFLKELH

SEQ ID NO: 3767 - protein, 317 aa, Arabidopsis thaliana
MSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 3768 - protein, 411 aa, Zea mays
MNALAATTRNFRRASKLLGLDSKLEQSLLIPFREIKVECTIPKDDGSLATFVGFRVQHDNARGPMKGGIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLGSTELLVHDCDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 3769 - protein, 351 aa, Mycoplasma hyopneumoniae
MLEFPYYAKKYKKGNSITVNFKNFKHDFIKHISSESYAKILTIYSEINFLTYKWMRDNNVKIVNCPITTQSISSPMGLGSDSLPYKVISKNNPNFEFYLADSMQFHLELFLRTKNVESVGYIAPTFRGENVDERHLHQFNHFEIETKKPLVETKKMIINYLKYLVKNLVKTHSAELNYFNENNVPRLLKWLNFDQYNLLFTNAIKILDEKFKEGIDRTELLLNINSKGEKFLINYFSDKILWLDNFPEINVPFYQKSKDGFAINSDLLMGIGEIVGSGERCFDYNETLKSLLNHKNNPQNYKWYLEMKEKTPMITSGFGLGMERLMLFLIGKNDIREVQLIPRETDKEILP

SEQ ID NO: 3770 - protein, 497 aa, Xylella fastidiosa
MSEEILVNVTFGETRVAVVENGLLQELHIERDGCRGVVGNIYKGRVQRVMPGMQAAFVDVGMERTAFLHVNDVVRSAPADSSVIDTDETTVPPLSEIPIVELLRDGQELMVQVLKEPIGTKGARLTTQISIPSRYLVLLPQSKMVGVSLRIEDEAERARLKAVVTDLAAQYGDYGYIVRTNAEGQSADVLVEDIAYLSRLWGVVERRGRELPVCSLLYEDLSLSLRSVRDLIRKDVEKIKVDSKEAFAQLQGFVTKYMPVLADKLELYVGDHPIFDLYGVEDEIGRALDRQIPLKSGGYLVIEQTEAMTTVDVNTGSFVGKRTLEETVFRTNLEAAQALARQLRLRNLGGIIVIDFIDMQDAEHRCQVLRVLEKALIRDHAKTTVYDFSPLGLVEMTRKRTVESLQRQLSETCQTCGGRGTIKTVETVTYEIFRDITRAVRQFDAVRLLVIASPNVVSRMTDEESAAVAELEAVLGKAIRFQADPHYLQEQYEVVLL

SEQ ID NO: 3771 - protein, 694 aa, Chlamydophila caviae
MTFETIFVTLEEGKTLVFETGKIARQANGAVLARMQETWVFSSVCAANLEEPVDFLPLRVDYQEKFSSIGKTLGGFIKREGRPTEREILTSRLIDRSMRPSLPNRLMQDVQVLSYVWSYDGVTLPDPIAICGVSAALAISDIPQISVVAGVRVGFVNNSWVVNPTKAEMDVSRMELVLAGTENAILMIEGHCDFLTEEQVIEAIEFGHKHIATICRAIKDLQQKVGKKKNSDAIVPLPEEVQSSVNTFVEGKFADLLKIKEKKAFEAASKQLEKEIVEKFLEENEIFTALNIKTAFKQAKSDYMRALIREQSVRSDGRAITTIRPISIDTSFLPRTHGSCLFTRGETQTVAVCTLGSEAMAQRYEDLNGEGLAKFYLQYFFPPFSVGEVGRIGSPGRREIGHGKLAEKALSHTLPDPAKFPYTIRIESNITESNGSSSMASVCGGCLALMDAGVPIKTPIAGIAMGLILDNDHVTILSDISGLEDYLGDMDFKVAGNTEGITAFQMDIKVEGITPTIMQAALAQAKAGRQHILDIMKEALAAPKTDLSQYAPRIETMQIKPNKIATVIGPGGKQIRQIIEEAGVQIDINDSGLVSISASSPQAIEKAKSMIEGLVGEVEVGKIYEGRVTSIVPFGAFVEILPGKEGLCHISEFSKQRIENVGDFVKQGDILAVKLLSINEKGQYKLSHKATLSE

SEQ ID NO: 3772 - protein, 456 aa, Cryptococcus neoformans
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGG

SEQ ID NO: 3773 - protein, 295 aa, Unknown
  Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPLGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 3774 - protein, 911 aa, Magnaporthe grisea
MGTIVGLPPIPTEAPPSYTTVKKLDIFPPSPPDTAKESRQHSRRSSISVGTGLVEDVDCAVVNDEASRPYPLPPPTRQNNVLPQDLKTPDSHVERDPRLIRLTGIHPFNTEAPLSDLFDEGFINSKDLHYVRNHGAVPRVEDADMMDWEFTVEGMVESPMKLTLRTLMKDFAQATYPVTLVCAGNRRKEQNVVRKTKGFSWGAAGLSTALWTGVPLGDLLARAMPKRGARYVYFEGADKLPNGYYGTSIKLNWVVDPNRGIMVAHRMNGEALHPDHGKPLRIVIPGQIGGRSVKWLKRIVVTSEPSDNWYHIYDNRVLPTMVTPEASADLPDTWKDERYAIYDLNTNSATCYPAHDEKVPITAGAGVYKFRGYAYAGGGKRVTRMEVTLDKGKSWRLAKMIYPEDDYRLASVDDTLYGGKVDLSWREASFCWCFWELDIPTTDLVAADDVMIRAMDDSMMVQPRDMYWSVLGMMNNPWYRVMIHKEGHDLRFEHPTQPALIPGGWMERVKKAGGDLSNGFWGERVAGDEEESAAVAEEPANEICMTNPSVNKTITLDELKAHDSESQPWFVVDGQVYDGIKFLEGHPGGAASIIGAAGQDCSEEFLTIHSENAKAMMPEYHIGSLDEKSRSLLAEPESTQPESTEPRPVFLQSRTWSKALLQEKISVSGDSKIFSFKLDHAEQAIGLPVGQHLMMRLRDPATREAIIRAYTPLSDCVVEKGLLRVLVKIYYKSAGMEGGKMTQALDHLPVGHWVDFKGPVGRFEYLGKGKCRVSGKERSVRRFIMICGGSGVTPIFQVFRAVMQDKEDQTRCLVLDGNRTEEDILCKDELDKLAVGNEDRCRLVYSLSKPSESWTGAKGRMDRALFEKELGVSGSNSQDMVLICGPESMEKSVKQILTQELGWKDDDLLFF

SEQ ID NO: 3775 - protein, 580 aa, Solanum tuberosum
MTSTIANYGVSHSFSPSTSYSLDFTLPSKSISMKNHTTKTKIHSALLTFPKQNNTPKKQPQFQTPDWNFFQKAAAKALDIVESALVSRELQNPLPKTADPRVQIAGNFAPVPEQSVRHNLPVIGTIPNCINGVYVRNGANPLFEPVAGHHLFDGDGMVHAVTVENGSVSYSCRFTETERLVQERELGRPVFPKAIGELHGHSGIARLLLFYARGVFGLVDHSHGTGVANAGLVYFNNRLLAMSEDDVPYNVQVLPSGDLQTVGRYNFDDQLKSTMIAHPKIDPVSGELFALSYDVVQKPYLKSFKFSPDGEKSPDVEIPLDVPTMMHDFAITENYVVIPDQQVVFKLQEMIKGGSPVIYDKNKKSRFGILPKNAKDSDNIIWVESPETFCFHLWNAWEEPETDEVVVIGSCMTPPDSIFKECSENLKSVLSEIRLNLKTGESTRRQLLSPSDQVNLEAGMVNRNKLGRKTQFTYLAIAEPWPKVSGFAKVDLSTGEIKKHIYGDKRYGGEPLFLPRNVNSEKEDDGYILAFCHDEKTWKSELQIVNAMTLELEATVKLPSRVPYGFHGTFISSKDLQNQV

SEQ ID NO: 3776 - protein, 99 aa, Unknown
  Nostoc sp. PCC 7120
MATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEEDLY

SEQ ID NO: 3777 - protein, 352 aa, Pseudomonas fluorescens
MYPKNAWYVACTPDELQGKPLGRQICGEHMVFYRAHEGRVTAVEDFCPHRGAPLSLGYVENGNLVCGYHGLVMGCDGKTVEMPGQRVRGFPCNKTFAAVERYGFIWVWPGDQALADPALIHHLEWADNDQWAYGGGLFHIQCDYRLMIDNLMDLTHETYVHASSIGQKEIDEAPPQTTVDGDQVVTARHMHNVMPPPFWRMALRGNQLADDVPVDRWQICRFSPPSHVLIEVGVAHAGHGGYDAPAQYKASSIVVDFITPESDTSIWYFWGMARNFNPQDPALTESIREGQGKIFSEDLEMLERQQQNLLAQPQRNLLKLNIDAGGVQSRRVLERLIAQEREPREPLIATSR

SEQ ID NO: 3778 - protein, 326 aa, Chlamydia muridarum
MFSQTVSVAVTGGTGQIAYCFLFALAHGDIFGPDTGIDLRIYDIPGTERSLSGVRMELDDGAFPLLQRVQVTTSLHDAFDDIDAAFLIGSVPRGPGMERRDLLKKNGEIFATQGKVLNTAAKREAKIFVVGNPVNTNCWIAMNHAPRLLRKNFHAMLRLDQNRMHSMLAHRAEVPLSAVSQVVVWGNHSAKQVPDFTQALIHGRPIVETIADRDWLENIMVPSVQSRGSAVIEARGKSSAASAARALAEAARSIYQPKEGEWFSSGVCSDNNPYGLPEDIIFGFPCRMLGTGEYEIVPGLPWDAFIRGKMQISLDEILQEKASVSL

SEQ ID NO: 3779 - protein, 525 aa, Zea mays
RREFPNLIHCNEVLQYLGLRSNSLEGSLSPDMCQLTGLWYFDVKNNSLTGAIPETIGNCTSFPVLDLSNNHLTGEIPFNIGFLQVATLSLQGNKFSGPIPSVIGLMQALAVLDLSFNELSGPIPSILGNLTYTEKLYLQGNRLTGLIPPELGNMSTLHYLELNDNLLTGFIPPDLGKLTELFELNLANNNLIGPIPENLSSCANLISFNAYGNKLNGTIPRSFHKLESLTYLNLSSNHLSGALPIEVARMRNLDTLDLSCNMITGSIPSAIGKLEHLLRLNLSKNNVAGHIPAEFGNLRSIMEIDLSYNHLSGLIPQEVGMLQNLILLKLESNNITGDVSSLIYCLSLNILNVSYNHLYGTVPTDNNFSRFSPDSFLGNPGLCGYWLHSASCTQLSNAEQMKRSSSAKASMFAAIGVGAVLLVIMLVILVVICWPHNSPVLKDVSVNKPGDTSFWFPVCCSNKKKKKKKKKKKKKKKKKKKKKKKKKKKKKKKKKKKKKGRAVLKDQSLLPRACKVKVFFWGPQI

SEQ ID NO: 3780 - protein, 126 aa, Oryza sativa
  misc_feature (44)..(44): Xaa can be any naturally occurring amino acid
  misc_feature (70)..(70): Xaa can be any naturally occurring amino acid
  misc_feature (90)..(90): Xaa can be any naturally occurring amino acid
  misc_feature (117)..(117): Xaa can be any naturally occurring amino acid
IGSKQTWVSCGGNNGVLGGAVRFSEENEALVIKSWYIMIKDSGXLDSELFLKIFDVVPSSTNMFSFLRKXSTLLLDKNPMLITQGMYVFXMKCEVADRVPESGVEFTARDTRMNRFXSTHFKYGVR

SEQ ID NO: 3781 - protein, 426 aa, Mycobacterium leprae
MVAPLAEVDPDIAELLGKELGRQRDTLEMIASENFVPRSVLQAQGSVLTNKYAEGLPGRRYYDGCEHVDVVENIARDRAKALFGADFANVQPHSGAQANAAVLHALMSPGERLLGLDLANGGHLTHGMRLNFSGKLYETGFYGVDATTHLIDMDAVRAKALEFRPKVLIAGWSAYPRILDFAAFRSIADEVGAKLWVDMAHFAGLVAVGLHPSPVPHADVVSTTVHKTLGGGRSGLILGKQEFATAINSAVFPGQQGGPLMHVIAGKAVALKIATTPEFTDRQQRTLAGARILADRLTAADVTKAGVSVVSGGTDVHLVLVDLRNSPFDGQAAEDLLHEVGITVNRNVVPNDPRPPMVTSGLRIGTPALATRGFGEAEFTEVADIIATVLTTGGSVDVAALRQQVTRLARDFPLYGGLEDWSLAGR

SEQ ID NO: 3782 - protein, 517 aa, Anabaena variabilis
MTQQNGKVYLVGAGPGDVAYLTVKAYNLLATAQVLVYDALVDEQLLQCVSPDCLKLDVGKRGGKPSTPQADINHLLVKYCQEGALVVRLKSGDPFIFGRCTSEIEALKAAGCKFEVVPGISSSIAAPLLAGIPLTDPVMSRCFAVLTAHEPEVLDWEALSRLDTLVILMGGKNLADIINELLRRGQSHLTPIAIIRWAGTPSQQIWTGQLGDILEQTRGLSLSPAVIVIGEVVGLRKYLQPEKIFPENSTTPMSSNQPLTGKTILVTRSSGQSSQFSDRLTTLGATVIEMPALEIGSPSSWEELDQAIANLSQFEWLILTSTNGVDYFFERLNLQGKDTRALAGVKIAVVGEKTSQSLKQRGIQADFIPPNFVADSLVEHFPESLLNKKILFPRVESGGREILVKELSAKGAEVIEVAAYQSCCPSSIPPAAELALKNHTIDIITFASSKTVQFFHQLVDNIFPHNIPNTLAGICIASIGPQTSKTCHTLLGRVDVEAEEYTLDGLTQSIINWALKV

SEQ ID NO: 3783 - protein, 310 aa, Mycobacterium tuberculosis
MSIAEDITQLIGRTPLVRLRRVTDGAVADIVAKLEFFNPANSVKDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 3784 - protein, 58 aa, Passiflora allantophylla
WEYQVGPSVGIDAGDHIWCSRYILERITEQVGVVLTLDPKPIEGDWNGAGCHTNYSTK

SEQ ID NO: 3785 - protein, 556 aa, Oryza sativa
IEPQNRREKKISPRSEASNRLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 3786 - protein, 262 aa, Oryza sativa
MAAAAAAAKRKPVFVKVDQLKPGTGGHTLVAKVLSSKTVVQKGRAAAGAGPAARPTRIAECLIGDETGCILFTARNEQVDLMKADSTVIIRNAKIDMFKGSMRLAVDKWGRIEVTEPASFNVKEDNNLSLVEYELVNVEGSYVFQAYLVKFYLLSWLKKVKDEGDSEHLIYSTLQSSNKQMRSITQSQCTAIGKAVNGIEIREKLLPSESQPKLLHAGAARSDVMSADAVALCMGISVSKQTLLISTGDLQNPKGNKKKHKH

SEQ ID NO: 3787 - protein, 59 aa, Passiflora alnifolia
WEYQVGPSVGIDAGDHIWCSRYILERITEQAGVVLTLDPKPIEGDWNGAGCHTNYSTKS

SEQ ID NO: 3788 - protein, 60 aa, Passiflora ambigua
VMPGQWEYQVGPSVGIDAGDHIWCSRYILERITEQAGVVLTLDPKPIEGDWNGAGCHTNY

SEQ ID NO: 3789 - protein, 80 aa, Glycine max
  misc_feature (73)..(73): Xaa can be any naturally occurring amino acid
MLEFNFMQHILYRQKEQFSDGVGYGWIDGLKAHAEKHVTDRMMLNAANIFPFNTPTTKEAYYYRMIFERFFPXVNLINHA

SEQ ID NO: 3790 - protein, 390 aa, Chlorobium tepidum
MHIGVLTGGGDAPGINACIKTIVTISTEKGYRVTGIRRGWNGLLAFDPDDPASRTEHIVDLDSELVRRIDRTGGTLLHTSRINPGNLKKKEIPPFLRNSPHLLRTGLHHSGNFDLTDHVLRSIDALGLDVIIVIGGDDTIGYADHLAKAAVKVIGVPKTMDNDVYGSDYCIGFGTAVTRSVQYIHQLRTSSGSHERITIVELFGRSTGETCLVSAYLAGVDRALIPEVPFDPETLADYVIQDKAANPSQYAMIAISEGARMIGSKMIEYCGRRYDEDGHEPAGIGQLTRETISMLTGQDVICQQLGYLMRSGIPDALDLMVGFNFAQLAVELIAEGTFGVMVALQKGIYTCLPLAEVSSNTKQVDISELYDPRYYRPKMRSVMGKPMFLY

SEQ ID NO: 3791 - protein, 65 aa, Passiflora amethystina
GTNGEVMPGQWEYQVGPSVGIDAGDHIWCSRYILERITEQAGVVLTLDPKPIEGDWNGAGCHTNY

SEQ ID NO: 3792 - protein, 129 aa, Gluconobacter oxydans
MSTFLHTMVRIRDIDRSLAFYKLLGMKELRRKEVREGRYTLVFIGFDDNEHGQAEIELTYNWDQETDYEVGTGFGHFAIGVPDVAALVETVRSGGGKVTREAGPLKFGTIIIAFVEDPDGYKIELIEKK

SEQ ID NO: 3793 - protein, 726 aa, Escherichia coli
  misc_feature (282)..(282): Xaa can be any naturally occurring amino acid
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVXPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKYTASRADLVFGSNSVLRAVAEVYASSDAHEKFVKDFVAAWVKVMNLDRFDLL

SEQ ID NO: 3794 - protein, 1355 aa, Clostridium perfringens
MQSFNKRGTALGAAIAFALTLAPTLVMAETRQIPESETVNVGFIKDGERSTIFNQNWKFFKGDPSGAEGVDFDDSSWRGLNLPHDWSIEGDFTVEGEAESGFLLGGTGWYRKAFVVPEKYNGKDFTLNFDGVYMNAEVYVNGKKVGEHNYGYTSFAFDITEALICDGQTENIIAVKVSNPVPTSRWYSGSGIYRDVTLSVTDSIHVAHAGTTVTTPKLEEQKDGDVDVAIETIVENESKDNSMVTVKSTVVNSKGEEVSESVINEKSIGANESYTFNQTAIVNNPGLWSVDNPNMYKVKSEVLVDGNVIDTYFTDFGFRYYNFDKDTGFSLNGENIKLKGVCMHHDQGALGAASYYRAVERQMEKMKEMGVNAIRVSHNPASEMLLEICNRLGLLVINEAFDTWTNPKNGNVNDFSKYFNEVIGEDNEILNGSPEMTWGEFEARSMVKNSKNNPSIIMWSIGNEVLEGISGSASNYTNVAQNIIDWIKDEDETRHVTIGDNRTKNGDRTAEAISEVVDDNDGLVGFNYANEAQVAQQRANHPDWTLYASETSSAIHTRGYYKTKGIDYSNHRISEYDNNQTRVGWGHSASDAWKFVIKNDYNAGEFVWTGFDYIGEPTPWNGTGTGTVGGGNGAAPKSSYFGIVDTAGFEKDIYYLYQSQWNDDVNTLHVLPTWNREDIVIENGNVEVNVFTDAHKVELYLNDEKIGEQTSTEHTTDAGYKYYTFGNDSLYPVFNVPYKEGTLTARAYDKEGNEITNTEGRNTVKTTGEASTVRLSADRDTIDSDGYDLSYITVDIVDENGNIVQNADNRLNFELEGNGKIVGVDNGDQTDTDSYKPTSDTEASRKALSGKALVIVQSTKDAGNIRLNVSGEGLQSQSIEINTVNNAGEDKFLESYEIVKDYYVNLNEKPELPSTVEGRYSDGTTETFNISWNDYDESQLNTPQVFKINGKLEGTDVAVNVNVHVIGDVVSMENYSTFTYAGQTPTLPKTVKGYLADGNESEEFKVDWNLEGVDFSEPNTTVEVLGEVSLLGKTYTVTSTVRVVEALKAAANLAINKDTNKDVPALSQSCVSQADNLNSINNGITNNGTDTRERWTNWNERDLTVNGEPKGAYVQLDWENKYNIDRLDLWLFTDNIYGRIPKKVEISYKNEAGEYEVVTHSNTTEVSYLAGETTYFLDKVINTDSIRVYMQQPEVGKCIGLSEVAVYEYVPQVSANEGNKLSEIKLDGEALEGFNPDTNEYTVNLKELPKTVEASGEENVAITILPVHNNKSIIIARSESGAKNIYTVNYVLEESEGSADINEDGSINVGDLSIVSKYQGEIISGNALSEKSDINKDGVVDKADIQIVMGKILGE

SEQ ID NO: 3795 - protein, 176 aa, Brassica napus
MRMSMLCIWVWSFVKVLSCLIGMWREGITLRELLLLSLRPSWQLFRDELGRFVSNKGNESVLKNFWHHTDAIICCSMKAMPVFIFANQAGLDMLETTLVSLQDISLEKIFDDNGRKTLCSEFPQIMQQGFASLQGGICLSSMGRPVSYERAVAWKVLNEEENAHCICFVFINWSFV

SEQ ID NO: 3796 - protein, 72 aa, Salmonella enterica
MAKEDNIEMQGTVLETLPNTMFRVELENGHMVTAHISGKMRKNYIRILTGDKVTVELTPYDLSKGRIVFRSR

SEQ ID NO: 3797 - protein, 702 aa, Unknown
  delta proteobacterium MLMS-1
MKTRKKTFRSGAGSPLPLGVSRTPAGYNFAIAARHAEAVSLVLYPPSRAEPVAELAFDPHLNRSGDVWHLLLADFEPTLRYGFRLRGPCRSAAAGYCYRDELVMLDPYAKALTGGSDWGKPYRRPGRSDPLASFQRRCLYLEDDFDWEGDRPLNIPLSETIIYELHVRGFTRHPSSAVEHPGTYRGIIEKIPYFKELGVTAIELLPVAEFNELENTRVNPFTGEQLKNFWGYSPLAFFAPKAAYAVNGRDGNQVREFKEMVKALHAAGLEVILDVVFNHTAEGGADGPVISFKGIDNPIYYLLDPATREYLNFSGCGNTVNCNHPWVRELIVDCLRYWVTEMHVDGFRFDLASIFGRGAGGEILAEPPMVEKIAEDPVLAKTKIIAEAWDAAGLYQVGSFSPHQRWAEWNGRYRDDVRRFLCGHDDTVASLATRLAGSSDLYGQNGRRPFNSINFITSHDGFTLHDLVSYNHKHNEANGEDNRDGDNHNISWNSGVEGESDEPAVLALRARRLRTAAVILLLSQGVPMLCAGDEFGRSQRGNNNAYCQDNEISWLDWRLVEQNAGLFRFFRLLISLRRRHPLFRRDHFFSTAPSARQPEISWQALEPGRQDWSAGCRVLAFRLHGRAGGSGQRRDRDFFVMLNSDAQPQRFTLPKPPARRPWRLLIDTAAASPRDIYQDEKAPKVRGGRQEVAPHGAVVLIA

SEQ ID NO: 3798 - protein, 72 aa, Ralstonia solanacearum
MAKEELIEFEGVVSEALPDNRFRVQLENGVEVWAYASGKMQKHRIRILAGDRVKLEMSPYDLTKGRINYRHK

SEQ ID NO: 3799 - protein, 230 aa, Arabidopsis thaliana
MDPDTVKSTLSNLAFGNVLAAAARDYKKEVLANEKAQGSRPVNEEVDLDELMDDPELEKLHADRIAALRREVEKREAFKRQGHGEYREVSEGDFLGEVTRSEKVICHFYHKEFYRCKIMDKHLKTLAPRHVDTKFIKMDAENAPFFVTKLAIKTLPCVILFSKGIAMDRLVGFQDLGAKDDFSTTKLENLLVKKGMLSEKRKEEDEEDYEYQESIRRSVRSSANVDSDSD

SEQ ID NO: 3800 - protein, 357 aa, Lagenidium giganteum
MSKFDRAVYDRYMDIEVDSNIVLAEYIWIGGSGEDLRSKTRTFNFIPKSPWELPIWNFDGSSTGQAPGEDSEVLLRPQAIFKDPFRGGNNILVICDCLKPDMTPIANNTRQDAARVMKAAEAHEPWFGIEQEYTLFEADKVTPYGWPKGGFPGPQGPYYCGAGAHSVFGRPIVDAHYRACLYAGIKVSGVNAEVMPGQWEFQVGPCVGIESGDHLWCARYILLRVCEDFGVNVSWDPKPIPGDWNGAGCHTNYSTKKMREDGGMAHIIEAIEKMKLKHKVHIAAYGSGNERRLTGRHETASIDQFSYGVANRGASIRIPRSAEADGKGYFEDRRPSSNMDPYTVTARIVKTTILDEP

SEQ ID NO: 3801 - protein, 243 aa, Triticum aestivum
  misc_feature (166)..(166): Xaa can be any naturally occurring amino acid
MENHQLPYTTQPPATGAAGGAPVPGVPGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSAALGFAAGGVXAGPVGGPAAGLPYYYPPMGQPAAPMMPAWHVPAWEPAWQQGGAGVDQGAGSFGEEGQGFTGGHGGSAGFPPGPPSSG

SEQ ID NO: 3802 - protein, 481 aa, Aspergillus oryzae
MDQTPFSKAYIIFDRVTTSSVRASVHWSKPNTGTVSSPTSTHTGQRALEPRSEEEIILGLRKHLLEAVKLRLRADVPAGVYLSGGLDSTAVAGMVSHLMKNGERLGNNPDGLKSQLHCFTVQFDRDSGYDESDVAERTATWLGANCHLVPVDEAVLAAGFEDTIWFSESPLPDLCGVGKLALAEAVHKEGIKVVLTGEGADEHFGGYSYLRLDALAEPDPSWPAAQFPESERLQMHEKLYRQVDSSGSVGRVESAERMLNGSFYGQEMAYFNFLPFASWTDLYASVPPHTALAESFSGSTRDRMMNKWHLLHTSEYISIKTFLSTFILRNAGDNVDMVHQVESRPPFLDHRVTEYANQIPPSLKMSVDPVSKTFRDKHILREAVKPFIPDEIYSRPKRSYAAPVRYPKDGPLCQLFNQLVTEENVKKLGFVDWGKAKGNLHRAFEGSDDMAFRFTLTLAQFVVLMQRFGVATCCPSPNALS

SEQ ID NO: 3803 - protein, 230 aa, Oryza sativa
MDPDAVKSTLSNLAFGNVMAAAARDYQKEIVAKEKAQAASASHDEVDLDELLDDPELEKLHAERIAALKKEVEKREVLKRQGHGEYREITEGDFLGEVTGSEKVICHFYHREFYRCKIMDKHLKALAPIYLGTKFIKLDAENAPFFVTKLGIKTLPCVILFKKGIAADRLIGFQDLGSKDDFSTRALENILKMKGIIDEKKKDEDDEDDETYMSMNRRVRSSTAQDSDSD

SEQ ID NO: 3804 - protein, 356 aa, Leptolegnia chapmanii
MSKLDRAVYDKYMELDTGSFIQAEYVWVGGSGEDLRCKTRTLDKYPASVEELPIWNFDGSSTGQAPGADSEVMLKPAAIYKDPFRRGNHILVMCDCYKPDMTPIPSNTRFDAARVMKACEKEVPWFGIEQEYTLFEADKVTPYGWPKGGFPGSQGPYYCGAGAHSAFGRLIADAHYRACLYAGIRCSGINAEVMPGQWEYQVGPCTGIEAGDQMWISRYILLRVCEDFGVIVSFDPKPIPGDWNGAGCHTNVSTKAMREDGGMKHIIEALEKLKLKHKEHIAAYGTGNERRLTGRHETASIDQFSYGVANRGASVRIPRTAEADGKGYFEDRRPASNMDPYVVTGRIMKTISLNEA

SEQ ID NO: 3805 - protein, 150 aa, Aspergillus oryzae
MCGIGAFLDFHNHSQPVSHQQLESEIDNGLDFIKHRGPDARGKWVNADGRVGLGHIRLSIVDPSPSGNQPFHDSRGDIHAVVNGELYDHERYREQLASEFDFKGNSDCEIVIALYKHYGASFLSHLRGEFALVLWDAKRELFFAARDRRN

SEQ ID NO: 3806 - protein, 235 aa, Oryza sativa
EKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 3807 - protein, 278 aa, Brassica napus
LTTSLVISRFYVSEVIVAMEYLHMMGIVYRDLKPENVLVRSDGHIMLTDFDLSLRCDESTSTPQIVLNRNALPNGSSDQNENQTMDHRQTTSSSCMITNCIVPAVSCFHPRIRRRKKKADHRNNGPELVAEPLDVRSMSFVGTHEYLAPEIVSGEGHGSAVDWWTLGIFMFELFYGTTPFKGIDHELTLANIVARALEFPKEPTIPSAAKDLIAQLLAKDPIRRLRSSLGASAVKRHPFFQGVNWALLMCTRPPFLPPPFRKEHLSDDICPDTHVDYY

SEQ ID NO: 3808 - protein, 590 aa, Pseudomonas syringae
MCGLAGELRFDHQPADLAAVERITHQLAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDDGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 3809 - protein, 556 aa, Bacillus clausii
MKQALSITWDRLWQQHTRTKSALNVFSYAQKGTSALKREAAEHEQAKQNSGGQPEPKEKKPYSRAQLVGLLLGPLLFFLTLMFFHPEGLPTEGRHVLAVTLWIATWWMTEAIPIPATSLLPLILLPITGAMEGSAVASSYGNDIIFLFLGGFFIATAMEKWNLHKRIALFIIAVIGTSTQRILLGFMAATAFLSMWVSNTAAVMMMVPMALAITAQVAETLKGQKEGRELPKFEKAMLFGVGYAGTIGGFATLIGTPPTIIFAGQVRELFGIEVSFASWMLFATPLMLVVLLFTWFYLGRIAFKTKIKELPGGKEVIQSERSKLGRISYEEGIVAGVFAFAAFMWITKDFFWSGDNAMIFQLPGISDGMVAIMATMFLFLIPGKASARILDWADSRDIPWGVLLLFGGGLAIAAGFQSSGLSVWLGEQLTVLDGLHMLLIIGGATLLIMMLTEITSNTATATMIMPIVASLAVAINVHPFALMAPCAIAANCAFMLPVGTPPNAIIFGTGKVKIIEMVRAGFWLNVFSTILIVLAVYAFLPIVFDIDLSVFPDSLK

SEQ ID NO: 3810 - protein, 461 aa, Streptomyces coelicolor
MTVESVNPETRAPAAPGAPELREPPVAGGGVPLLGHGWRLARDPLAFMSQLRDHGDVVRIKLGPKTVYAVTNPELTGALALNPDYHIAGPLWESLEGLLGKEGVATANGPLHRRQRRTIQPAFRLDAIPAYGPIMEEEAHALTERWQPGKTVDATSESFRVAVRVAARCLLRGQYMDERAERLCVALATVFRGMYRRMVVPLGPLYRLPLPANRRFNDALADLHLLVDEIIAERRASGQKPDDLLTALLEAKDDNGDPIGEQEIHDQVVAILTPGSETIASTIMWLLQALADHPEHADRIRDEVEAVTGGRPVAFEDVRKLRHTGNVIVEAMRLRPAVWVLTRRAVAESELGGYRIPAGADIIYSPYAIQRDPKSYDDNLEFDPDRWLPERAANVPKYAMKPFSAGKRKCPSDHFSMAQLTLITAALATKYRFEQVAGSNDAVRVGITLRPHDLLVRPVAR

SEQ ID NO: 3811 - protein, 470 aa, Aspergillus oryzae
MAKPRTTEKKLRVVCIGAGLSGLTIAYKLKHEKPLDFLDLTIYEKNPEVGGTWFENIYPGVACDVPVHSYQFPFAPNPAWSSYYASGKEIQEYIVSTAEKYDLKENIKFNTKLVKAIWCETQGKWKLQLQQGGLIIEDEADIVLDGSGVLNQWKWQEIEGLDTFKGKLLHTARWDPEYNYEGKKIAVLGNGSSGIQVIPSLQPNAAKLVNCIRHAIWTTPNLGGTNFQYTEEEKQRFQDNPDEFLEYRKSIEGAINSVYNAMISGSEESKAFYEWVQGVMRSRLSKNPELEDNSRIAFSKINRITPNGIETDEGEEEFDLIVCATGFNYSFIPPWELIGRDSRRLDEGWKDTAEAYFATCAAKVPNYFIFGGPNYPSFPSNSRQELISSRPVVVKDSVVHAYNKFAQETLKRCVWSKGCHAWYNKRNEGADNTVTAMYPGSVLHFKEKLRPEHFEIQYNTSNPFRFMGNG

SEQ ID NO: 3812 - protein, 378 aa, Buchnera aphidicola
MAKKDYYQILGIPKSAEEREIKKAYKRLAMKYHPDRNQGDKNAENKFKEIKEAYEILINEEKRTAYDQYGHAAFENGYNQNNTYSTFTSSTDFGDIFGDVFGDIFGGSRNQRVKKGADLCYNMEISLEEAVKGTTKEIRIPTFQKCKTCYGMGTSTGTKPNGCSTCHGKGQIHIRKGFFTVQQSCPTCNGIGTVIKNPCRMCRGQGRIKTNKTLSVKIPPGIDTNDKIRLSKEGEAGTNGAQPGDLYVQMKVNKHPIFEREENNLYCEVPINFTMAALGGEIEVPTLDGRVNLKIPSETQSGKLFRIRGKGVKSVQSRSRGDLLCRVVVETPVNLNEKQKYLLSELGNSFNGFRGDKNSPRSKRFFDGVKRFFDDLTK

SEQ ID NO: 3813 - protein, 399 aa, Candida albicans
MDDFDRDLDNELEFSHKSTKGIKVHRTFESMNLKPDLLKGIYAYGFETPSAIQSRAIMQIISGRDTIAQAQSGTGKTATFSIGMLEVIDTKSKECQALILSPTRELAIQIQNVVKHLGDYMNIHTHACIGGKNVGEDVKKLQQGQQIVSGTPGRVIDVIKRRNLQTRNIKVLILDEADELFTKGFKEQIYEIYKHLPPSVQVVVVSATLPREVLEMTSKFTTDPVKILVKRDEISLSGIKQYYVQCEREDWKFDTLCDLYDNLTITQAVIFCNTKLKVNWLADQMKKQNFTVVAMHGDMKQDERDSIMNDFRRGNSRVLISTDVWARGIDVQQVSLVINYDLPTDKENYIHRIGRSGRFGRKGTAINLITKDDVVTLKEFEKYYSTKIKEMPMNINDIM

SEQ ID NO: 3814 - protein, 1173 aa, Oryza sativa
MDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 3815 - protein, 559 aa, Botryotinia fuckeliana
MSLLAEAKRVAAEFEYTDEDVRRGVAEFVAEMNEGLEKNATNMSQIPTYVTGVPNGTEKGLYLAVDLGGTNFRVCSIQLHGDTTFSLTQSKVAIPRELMLAKTASDLFSFLAKQIELFLKTHHEDHFAAHIRRRNTVSTPEGFRDEHIFRLGFTFSFPVHQIGINRGTLIRWTKGFDIADAVGQDVCDLLQKEIDKLHLPVKVAALVNDTVGTLMARAYTSPGKTQTLLGAIFGTGTNGAYVEKLEKLTKPMEGDFDKTTGEMVVNTEWGSFDNGLKVLPNTIYDQILDKDSVNPGIQMFEKRVSGMFLGEILRTVLVQMIKSPTIPLFRDTSSADNDYRSTTTVDENGPLFKQWAVDSSILSIAEADNSVGLRALRQELEKSLGVSAASLEDAQTVKDIAHAIGKRAARLAAVAIGAIVLQTGRLDIKSDTPGPKSAAAIIQDVKDLKIADAASATANKLADTAGLAVNEEDVVDIGVDGSLVEFYPGFEDHMREALRAMDGIGAIGERRIRIGIAKDGSGVGAALIALVAAKMEKQQDYIGDLRSRYGVTGENVLGE

SEQ ID NO: 3816 - protein, 382 aa, Idiomarina baltica
MAQDYYQILGVGKDANERDIKKAYKRMAMKYHPDRTKGDKELEAKFKEIKQAYEVLSDPQKRQMYDQYGHEAFQQARQGGGAGSGGFGGGGADFADIFGDVFGDIFGGGRRQQARPQRGADLRYNLEMSLEDAVKGKEVELQIPTMVECEDCDGSGAKKGTRPETCSHCHGSGQIQMRQGFFAVQQACPHCRGTGSIIKDPCNTCHGQGRVEKTKKLSVKIPAGVDTGDRIRLANEGEAGEKGAPAGDLYVQVHVREHPIFARDGNNLYCEVPVSFTKAALGGEIEVPTLEGKVKLKVPKETQTGKHFRLRGKGVKSVRTGAVGDLICKVVIETPVNLSSRQRELLEELESSMGHGDEAAKFRPKEKGFFDGVKQFFDDLRS

SEQ ID NO: 3817 - protein, 493 aa, Saccharomyces servazzii
MSQEAVADFGLIGLAVMGQNLILNVADHGFTVCAYNRTVSKVDDFLANEAKGKSIVGAKSIEEFIAKLKRPRKIMLLVKAGKPVDYIINDLLPHLEKGDIIIDGGNSHFPDTNRRYEELTKKGILFVGSGVSGGEDGARYGPSLMPGGAEEAWPHIKDIFQSISAKADGEPCCDWVGPAGAGHYVKMVHNGIEYGDMQLICEAYDIMKRIGGFSDKEISDVFATWNKGVLDSFLIEITRDILAFNDKDGKPLVEKILDSAGQKGTGKWTAINALDLGMPVTLIGEAVFARCLSALKSERILASKQLAGPTIPADAIKDKKQFVDELEQALYASKIMSYAQGFMLIREAAKTYGWKLNNPAIALMWRGGCIIRSVFLGEITKAYRENPDLENLLLNKFFSDAVTKAQTGWRKTIGLATTYGIPTPTFSTALAFYDGYRSERLPANLLQAQRDYFGAHTFRVLPEEACETLPEGKDIHINWTGHGGNVSSSTYDA

SEQ ID NO: 3818 - protein, 167 aa, Unknown
  Bradyrhizobium sp. BTAi1
MPISDHLRAVRSKVGHDLLATTAVSISLFDDQGRILLGRDAETGHWTLPGGAIDPNEHPADAATRECFEETGLLVRPQRLLGVFGGPEFLIRYPNGDLTYYTVIAFEAAVIGGALAADGDEIAALRFVDRTEWEALDISPSSRIISRRAFERDAVPYFAPACWRPES

SEQ ID NO: 3819 - protein, 499 aa, Solanum lycopersicum
MGKLVVGATVVCTAAVVCGVTVLLMKHRVKNSGEWGKVEALLKDFEEKCATPVEKLKQVADAMTVEMQAGLASEGGSKLKMLISYVDNLPTGDEKGLFYALDLGGTNFRVMRVQLGGKEKRIVKHEVKEVSIPQNVMTGSSSEVLFDFIATALAEFVATEGDDFHLPPGRQRELGFTFSFPVKQLSIASGTLIKWTKGFSIEDLVGQDVVGELAKAMERAGLDVRVAALVNDTVGTLAGGRYNNPDVIAAVILGTGTNAAYVERAHAIPKWHGLLPKSGEMVINMEWGNFRSSHLPVTEYDQNLDIESLNPGEQIYEKIISGMYLGEILRRVLCRMAEEASLFGDYVPSKLKVPFVLRTPDMAAMHHDESADLKVVGNKLKDILEVPNSTLKMRKIVVELCDIITSRGARLSAAGIVGILKKLGRDTFKDGEKQRSVIAVDGALFEHYTKFRNCLKETMKELLGDAADSTVIELSNDGSGVGAALLAASHSQYTDLEES

SEQ ID NO: 3820 - protein, 579 aa, Saccharomyces servazzii
MFSRTDKNVDTLAGDISQLSFDSPSSKLAYNANNNMTPLRQRDNNRFGVGAGMNMGTPTPSPTKSTVYDQENDSSAMMVDDEDNDDITNSPKKLPMDFYKKSSSNKTQRLVSVCKMYFLDYYCDMFDYVISRRQRTKKVMEYIEQQKVLNNVPVERLNTEWFGYLQQEHDVLRKRRLKPKHKDFEMITQVGQGGYGQVYLARKKDTKEVCALKILNKKLLFKLNETNHVLTERDILTTTRSEWLVKLLYAFQDPESLFLAMEFVPGGDFRTLLINTKYLKSAHARFYISEMFCAVNALHELGYTHRDLKPENFLIDAKGHIKLTDFGLAAGTVSNERIESMKIRLEEVKNLEFPGFKEKSIEDRRKIYHHMRETDVNYANSMVGSPDYMALEVLEGKKYDFTVDYWSLGCMLFESLVSYTPFSGSSSNETYENLRHWKQTLRRPRLDNGRPAFSDRTWDLITRLIADPISRLRSFEHVKRMPYFSDIDFDNLRNMSPPFIPQLDSETDAGYFDDFTNEADMAKYADVFKRQNKLSAMVDNSAVSSKLVGFTFRHRSGKQGSSGILYNGSEHSDPFATFY

SEQ ID NO: 3821 - protein, 499 aa, Solanum lycopersicum
MSVTVSSPAVRSFHVSRSPHKTISRPRVIISAVRSTDSLGVAPILTKLQKDCATPLPVLRHVADAMADDMRAGLAVDGGSDLKMILSYVDTLPTGNEKGLFYALDLGGTNFRVLRVQLGGKEERVVATEFEQVSIPQELMFATSEELFDFIASALGKFAQKEGGNFELQQGRTREIGFTFSFPVKQTSIRTGILIKWTKGFAVSGTAGKDVVACLNEAMERRGMDMQVSALVNDTVGTLAGARYWDDDAMVAVILGTGTNACYVERVDAIPKLAKRMSKSPITIVNTEWGAFSNGLPLTEFDREMDAESINPGEQIFEKTISGMYLGEIVRRVLVKMAKVGGLFGSSYVPEKLVTPFVLRTPDICAMQQDTSIDLEAVESVLYDVAGVKSDLSARKTVVDICDTIAKRGGRLAGAGIVGILQKMEEDSKGLIFGKRTVVAMDGGLYEHYPQYRGYLQEAVTELLGSEISKNVVIEHSKDGSGIGAALLAAANSKYEHDD

SEQ ID NO: 3822 - protein, 366 aa, Arabidopsis thaliana
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 3823 - protein, 84 aa, Unknown
  Saccharum hybrid cultivar
SGKLENNQIPWRGDSALTDGKEAGLDLSKGMYDAGDHMKFTFPMAFTATVLAWSVLEYGDQMSAAKQLDPALDALKWITDSLSL

SEQ ID NO: 3824 - protein, 91 aa, Arabidopsis thaliana
  misc_feature (33)..(33): Xaa can be any naturally occurring amino acid
MSIFTASFSTVSSARSALLLKPTVLISAPVLGXLPPMGKKKGGVRCSMDTKHGNVSVMGAGVSVAATAALTAVMINPAIAFVDDRLSTLRT

SEQ ID NO: 3825 - protein, 313 aa, Glycine max
MNTRKDMDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 3826 - protein, 246 aa, Pinus palustris
QQNELVKKVGASQARITMRRTVRSAPESIWYGPDRPKYLGPFSEQTPSYLTGEFPGDYGWDTAGLSADPETFAKNRELEVIHSRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLYDHLADPVANNAWAYATNFVPGK

SEQ ID NO: 3827 - protein, 716 aa, Zea mays
MATADQSRIFMKDVKRVIIKVGTAVVTRHDGRVSTGNFGVLCEQVKEINALGYEVIIVSSGAVGVGKQRLNYRKLVNSSFADMQKPQTELDGKACAAVGQSGLMALYDMLFTQLDVSSSQLLVTDSDFENPNFRERLRETVESLLDLKVVPIFNENDAISTRKAPYEDSSGIFWDNDSLAGLLAIELKADLLVLLSDVDGLYSGPPSEPQSKMIHTYIKDKYHNEITFGDKSRVGRGGMTAKVKAALVASNSGTPVVITSGSASGSIIRVLQGEKIGTLFHKDASLWEPSSDVSACEMAVTARECSRRLQNLSSDERNKILLDVADALEKNENLIRTENEADVAAAQDAGYEKFLVDRLTLKPGKISALAKSIRTLARMEDPINQILKRTEIAENLILEKTSCPLGVLLVIFESRPDALVQIASLAIRSGNGLLLKGGKEAMRSNKVLHKVITGAIPSNVGEKLIGLVTSRDEIADLLKLHDVIDLVIPRGSNKLVSQIKTSTKIPVLGHADGICHVYIDKSANMNMAKQIVMDAKIDYPAACNAMETLLVHKDLIKAPGLDDLLLSLKTKGVAIFGGPVAHEVLCIPEANSFHHEYSSMACAIEFVDDVQSAIDHIHCYGSAHTDCIVTTDDKVAETFLRQVDSAAVFHNASTRFSDGARFGLGAEVGISTGRIHARGPVGVEGLLTTRWIMRGSGQVVNGDNDIAYTHKNLPLP

SEQ ID NO: 3828 - protein, 415 aa, Alteromonadales bacterium
MSLITDISRQAAKAANTLALLDTETKNQVLTEMAAALREQKAFIIQENESDLSAARDNNLPAAMVDRLTLNDERIESMAEGIEVIVSLDDPVGQLREITERPNGIKIRKMRVPLGVVCMIYEARPNVTADAGALCFKSGNGVILRGGKEALKSSQAIASVMHSVLEKHNLPVSLISVIPDPDRALLMELMQQRDSIDLIIPRGGEGLINFVTENSTIPVIQHYKGVCHLYVDKDADLEVAINLLLNGKTQRTGVCNALEGLVVHEDIADEFLNLCAVVLRQEGVKINADSFAAKYFDDATVLADDEFGEEYLDLEIAIRVVPTFSAAVDHIAQFGSNHTEVICTKNQAAAELFQRSVDASVVMVNASSRFSDGSQLGLGAEIGIATSKLHAYGPMGLESLTTEKYLVNGEGQVRE

SEQ ID NO: 3829 - protein, 341 aa, Amycolatopsis methanolica
MRVGVLTGGGDCPGLNAVIRAVVRKGIEAHGWEIVGFRSGWRGPLTGDSRPLGLDDVEEILIRGGTILGSSRTNPYKEEGGVEKIRAVLADQGVDALIAIGGEDTLGVAKKLTDDGIGVVGVPKTIDNDLAATDYTFGFDTAVHIATEAIDRLRTTAESHYRAMVVEVMGRHAGWIALHAGLAGGANVILVPERPFSVEQVVEWVERRFEKMYAPIIVVAEGAVPEGGAEVLRTGEKDAFGHVQLGGVGTWLADEIAERTGKESRAVVLGHTQRGGTPTAYDRVLATRFGLHAVDAVADGDFGTMVALRGTDIVRVKLAEATAELKTVPPERYEEAEVFFG

SEQ ID NO: 3830 - protein, 169 aa, Triticum aestivum
ACSRPRCRRRSRRLPRAAVAMGRRPARCYRQIKNKPYPKSRYCRGVPDPKIRIYDVGMKKKGVDEFSHCVHLVSWEKEDASSEALEAARIACNKYMTKHAGKDAFHLRVRVHPFHVLRINKMLSCAGADRLQTGMRGAFGKPAGSLCPCCHWAGPPFCAVQAQQCHPCH

SEQ ID NO: 3831 - protein, 344 aa, Agrobacterium tumefaciens
MTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQIASVVLKTIAEVPLAKSAAA

SEQ ID NO: 3832 - protein, 315 aa, Unknown
  Saccharum hybrid cultivar
MEDLYSIHPGISRVGGAASEASTAGVGAGGPSPSDLTELMKAQIASHPRYPSLLSAYIECRKVGAPPQVASLLEEVSRERSPGAAGAGEIGVDPELDEFMDSYCRVLVRYKEELSRPFDEAASFLSSIQAQLSNLCSAGSSPAATATHSDDMMGSSEDEQCSGDTDVPDIGQEHSSRLADHELKEMLLKKYSGCLSRLRSEFLKKRKKGKLPKDARTVLLEWWNTHYRWPYPTEEDKVRLAAMTGLDPKQINNWFINQKKKHWKPSEDMRFALMEGVAGGSSGTTSTSIQAQLDPESHTIWDDNWPIQSVVRPGM

SEQ ID NO: 3833 - protein, 317 aa, Aspergillus oryzae
MPQYNAPTTAEEVANDCRASIANKTILVTGVTLGSLGAGFATAIANYAPSLIILAARDVTKAQQTATEISIINPSVKTRILHLDLGSQVQIREAAKEVLEYEEHIDVLVNNAGVMAPPFSLTQDGVESQFGINHIGHFLFTNLIMSKLVTPGKSSRVVNISSDGHRLGPIRFDDWNFDDGNTYDPWLAYGQSKTANMLFSVSLAQKLGTKGLISVSLHPGVVSTQILRHDVDESVKALDETAICYYYIRYESVAANLTEIISEFASSRLQKALSEAYRTIRRLRPIVERDRRDGSGACYRELKQHLSPGTFKATSGL

SEQ ID NO: 3834 - protein, 491 aa, Botryotinia fuckeliana
MVGLGPRKPPSRKGSMADVPKNYLEQIKKLEQQFTVDTQKLKEITEHFVSELTKGLTVEGGSIPMNPTWCMAFPDGYETGTFLALDMGGTNLRVCEIILTDEKSEFDIIQSKYRMPEELKTGEADELWEYIADCLQQFIESHHHGEDLGTLSLGFTFSYPATQNYIDEGILQRWTKGFDIAGVEGENIVPMFEAALAKRGVPIKLTALINDTTGTLIASAYTDTAMKIGCIFGTGCNAAYMENCGSIPKLAHMNLPPDTPMAINCEWGAFDNEHKVLPRTPYDIIIDKDSPRPGQQAFEKMIAGLYLGELFRLVLVDLHDNKDIHMFEGQDIEKLRKAYTLDSSFLSLVEEDPWENLSETADLFQNKLSIRATVPELELIRRLAELIGTRAARLSACGVAAIAKKKNYETCHVGADGSVFNKYPHFKARGAAALREILDWPAKKNAKEADPIEILAAEDGSGVGAALIAALTLKRVKAGNMAGILHPENFR

SEQ ID NO: 3835 - protein, 419 aa, Escherichia coli
MRMLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 3836 - protein, 287 aa, Glycine max
MAETTQSNAELLEWPKKDKRRFLHVVYRVGDLDRTIKFYTECFGMKLLRKRDIPEEKYANAFLGFGPEQSHFVVELTYNYGVTSYDIGTGFGHFAIATPDVYKLVEDIRAKGGNVTREPGPVKGGKSVIAFVKDPDGYAFELIQRPSTPEPLCQVMLRVGDLERSIKFYEKALGLRVVKKTDRPEYKYTIAMLGYAEEHETTVLELTYNYGVTEYTKGNAYAQVAIGTDDVYKSAEVVNIVTQELGGKITRQPGPIPGLNTKITAFLDPDGWKTVLVDNQDFLKELE

SEQ ID NO: 3837 - protein, 316 aa, Neisseria gonorrhoeae
MSQHRKLIILGSGPAGYTAAVYAARANLNPVIITGIAQGGQLMTTTEVDNWPADADGVQGPELMARFLAHAERFGTEIIFDQINAVDLQKRPFALKGDMGEYTCDALIVATGASAKYLGLPSEEAFAGKGVSACATCDGFFYKNQDVAVVGGGNTAVEEALYLANIAKTVTLIHRRSEFRAEKIMIDKLMKRVEEGKIILKLESNLQEVLGDDRGVNGALLKNNDGSDQQIAVSGIFIAIGHKPNTDIFKGQLEMDEAGYLKTKGGTADNVGATNIEGVWAAGDVKDHTYRQAITSAASGCQAALDAERWLGSQNI

SEQ ID NO: 3838 - protein, 757 aa, Neorickettsia sennetsu
MFEIKESSMEWEGKSLHIKTGEVARQAAGAACVSYGGTVVLAVVTLQKDTAASKKTSDLSGLALVTNFLAKSYALGRIPNGFFKREGKLSEREVLASRVVDRAVRPLIEENLVNEVNIVCKLLAHGNRKVLPEIPALIAASAALQLSGIPFSGPVIGVDVDMRGSEVTCNEIRETEGGLELFVACTEESVVMVEAEASEASEEEVVNALSEALKSAKPVFSFINEFVKSVTTVKPIGVLYDNKELCEKVRAACSGQLESVYNERISSKEKRHNKLGQIYTDTFAQLSDDGYAESEVLFFIKKLEKEIVRKNVLEEGIRPDGRSLTEIRPISIALDYLPGTHGSALFTRGGTQSLVVATLGSYQDEQVMDDIDGERRESVLLHYNFLPYAVGEVGALRAPGRREIGHGRLALKAVKAVLPGKEVFPYTLRLVSEITESDGSSSMATVCGSSLALMDTGVPITKHVAGIAMGLITDGVRSAVLSDISGDEDMLGDMDFKVAGTRNGIVALQMDMKVRGISIATIRDALNQALAGRLHILEKMEHVIAKPRESLKDSAPKILCYKIDKDVVHKVIGSGGKTIRGISSDTSAKIDIDQNNYVYIMADTEEALMEAKTRVDMASGASDSNVPQLKIGELYDGKIVSVVDFGLFVVLPNKQEGLVHISEISKNRVNDIRADYTEGQAVTVRIKDIGSDGKIKLTMRIDEDRVGSGGSSSSPKKRFGAHPRKNGKDNRSNNSERGFNERSGSAEGSSISRKRFF

SEQ ID NO: 3839 - protein, 547 aa, Capsicum annuum
MGRKEEGDDGVERSEGGVVLVNPKPRKGFSAKALDLLEKGIVKLVHDSSKPLHYLQGNFAPTDETPPLNDLLVHGHLPECLNGEFVRVGPNPKFAPVAGYHWFDGDGMIHGLRIKDGKATYVSRYVRTSRLKQEEFFGGAKFMKVGDLKGLFGLFTVYMQMLRAKLEVLDISYGNGTANTALAYHHGKLLALSEADKPYALKVLEDGDLQTLGMLDYDKRLTHSFTAHPKVDPVTGEMFTFGYSHDPPYITYRVISKDGIMQDPVPITIPEPIMMHDFAITENYAIMMDLPLCFRPKEMVKNNKLAFTFDATKKARFGVLARYANNEALIKWFELPNCFIFHNANAWEEGDEVVLITCRLMNPDLDLVNGAVKEKLENFCNELYEMRFNMKSGAASQKKLSESAVDFPRINENYTGRKQRYVYGTTLNSIAKVTGIIKFDLHAEPKTGKSQLEVGGNVQGIFDLGPGRFGSEAVFVPSQPDTECEEDDGFLIFFVHDENTGKSAVNVIDAKTMSAEPVAVVELPKRVPYGFHAFFVTEEQILEQAKL

SEQ ID NO: 3840 - protein, 208 aa, Idiomarina baltica
MGKKRSVSSQRWLKEHFDDPFVQKAQKRGLRSRAVFKIEEIQQRDKLIKKGQTVVDLGAAPGGWSQYVADYFNGDGQVIACDILSMDPIAGVDFLQGDFREQAVLDALLSRIGGKNVDVVLSDMAPNMSGNDNVDQPRAMYLVELALDMCHQVLKPGGSFAVKVFHGQGFEEFLKDVRAAFKTVKTRKPSSSRSRSREVYLVATDYKL

SEQ ID NO: 3841 - protein, 99 aa, Prochlorococcus marinus
MASYKVTLISESEGLNSTIEVPDDQYILDAAEEQGVDLPYSCRAGACSTCAGKITSGTVDQSDQSFLDDDQLEAGFVLTCVAYPSSDVTITTHAEEELY

SEQ ID NO: 3842 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 3843 - protein, 592 aa, Bacillus cereus
MAETLAKRGPDDNKVWIKGNVAFGHKRLIVVDPEGGKQPMTCLKDEANYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKVEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWLQDLLTDKGSILHELFDKEQLSGLIESGGSAFQSPWFGQLMTGPQLLAHLAQIHVWFKEYGVNIKE

SEQ ID NO: 3844 - protein, 415 aa, Oryza sativa
MVLVAIGVVVAAAVVVSSLLLRWNEVRYSRKRGLPPGTMGWPLFGETSRVPQAGTQFHEGPEAQGPLHRAMRGAMLSLVRPAMIRSSLLPKIDAFMRSHLAAWSSSSSSSAVVDIQAKTKEMALLSALRQIAGVSAGPLSDALKAELYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHPKALEQLRKEHFDIRKGKAPEDAIDWNDFKSMTFTRAVIFETLRLATVVNGLLRKTTQDVEMNGYVIPKGWRIYVYTREINYDPFLYPDPMTFNPWRWLEKNMESHPHFMLFGGGSRMCPGKEVGTVEIATFLHYFVTQYRWEEEGNNTILKFPRVEAPNGLHIRVQDY

SEQ ID NO: 3845 - protein, 609 aa, Magnaporthe grisea
MTKIPLARYIFQRLRQYGVDHIHGVPGDNLLHALDHIVPAGSRWVGCCNELNAAYAADGYARVRGMGAVFTTMGVGELSAANAIAGSQAERVPVVHLVGVPSREAMMGQSQYPNVMHHALQPGGGMEPFREIGRLLTQGRDEFRSSAAVYEGATAADFASKFDSMLRRSFVQRKTMYFPLRADLVDHQVDSSWLEKSLDGPDGEQGSKPPAEEWDFLKELRSAEKPVILVDRGLGMDAFKDEINELVALSGIPTFCMPSGAGMIDNRLPNYHGVHSGPFGRINSMTWVGSADLVLAIGPMFSDTNTFGWMTVPRPSAKNPNMKLMILASHTTRPKRAMPGQTTPVMLLQTNRDILRRAIEMLKKEPIKGKAIPFMKDWRVGERRWMVGDQRINQSILYQKLDKYLRPYDTILIGNATPLLGARDFVLPEGARVIASGQWFSIGHMLPAAMGAALAKRGLKGDAGRGRTILLDGDGSFQMTAQELGTIIRQRLDVTIFIFNNGGYAYERLIHGPDEEYNDIAPWKYLELPSAFGAEHARAMHGYNTQTHLVRTWDDLDRLFMDGRFNIGPGLKLVELRLGRKDVPARFRNLFREDEEEERLTRRIRSDPE

SEQ ID NO: 3846 - protein, 243 aa, Oryza sativa
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEEEKAEAVKQMLAAIENLETAFKELSKGKPFFGGDTAGYLDVTLGAVVGWARAGEVLFGRKLFDATRSPLLAAWMERFVALDAVKAVLPDNAELIEYGKMRMAHYAKLAAALAAANKK

SEQ ID NO: 3847 - protein, 238 aa, Rosa roxburghii
MGVCYGTLGNDLPAATEVVNLYKRHSITKMRLFDPNTAALQALKGSGISVILGIQNQDLPALAASQEAVNAWFTANVEPYLDGIELSYIAVGNEVIPGPVGNYDFPVMRFLRIRTMLDGRELSGIKVTTVVPGTALGSSYPPSSGVFAAEAVEVMTSIVQFLASTNSSLMINAYPYFAYKSDPANVHLDYALFTTKTSVIQDGPLGYYNLLDAIVDSFYTAMEKVGSPNVTVVVSESG

SEQ ID NO: 3848 - protein, 429 aa, Mycoplasma hyopneumoniae
MSLKLEVKTEIKLDYQDFQNQINEFHKRINDKNSPDIIFLGWNNFPEVAINPQEIARMRKIVENLHQNSINVLVVIGIGGSYLGAKAALDFILGLGPFENKPEVIFLGNSLSSTDLYQKIEYLKTKNFAINVISKSGSTIEPAITFQILYQFLIDQIGEKLAKTRTFVTTSIKSGELLEIAKSNELEIFEVIESIGGRFSVLSSVGFFPLLFAKINVDEIIQGAIKAHKKYSTSSISQNLAYKYALFRFLMYKNFNYKTEILISYEPFLIYFNEWWKQLFGESEGKNLKGLFPASAIFTTDLHSLGQFIQDGSKNFFQTIIYIKKPKFDLGIKKLVQFNTKINKLSGKTVSEINFQAFLATTLAHSSYGNNPNLVLEIADSSPKTFGHLVMFFEKACAMSAYLLGVNPFDQPGVESYKNELAKNLGWDR

SEQ ID NO: 3849 - protein, 132 aa, Ashbya gossypii
MSSKASKAPASKAPAEKKPAAKKTSSSVDASKKRTKTRKETYSSYIYKVLKQTHPDTGISQKSMSILNSFVNDIFERIASEASKLAAYNKKSTISAREIQTAVRLILPGELAKHAVSEGTRAVTKYSSSTQA

SEQ ID NO: 3850 - protein, 463 aa, Photorhabdus luminescens
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 3851 - protein, 234 aa, Rosa roxburghii
VGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 3852 - protein, 473 aa, Zea mays
  misc_feature (343)..(343): Xaa can be any naturally occurring amino acid
VKDPYWKKNFQEDWKSRFDLPSITDIYDLKPRCSTICCCPSRTLTGDENVDMWNGYVNNDDRALLKVIKYSSPTSAGAECVDLDCSWVEQWVHRAGPRKEIYYEPEEVKAAIVTCGGLCPGLNDVIRQIVFTLETYGVKNIVGIPFGYRGFFEKGLKEMPLSRGLVENINLNGGSFLGVSRGGAKTSEIVDSIQARRIDMLFVLGGNGTHAGANAIHEECRKRKLKVSVVAVPKTIDNDILLMDKTFGFDTAVEEAQRAINSAYIEARSAYHGIGLVKLMGRSSGFIAMHASLSSGQVDVCLIPEVPFTLDGEFGVLRQLEHLLKSKGFCVVCVAEAAGQVCXIHSCLDLLQESGATDASGNVILSDIGVHMQQKIKMHFKDIGVPADVKYIDPTYMVRACRANASDAILCTVLGQNAVHGAFAGFSGITSCICNTHYVYLPITEVITAPKRVNPNSRMWHRCLTSTGQPDFH

SEQ ID NO: 3853 - protein, 276 aa, Coprinopsis cinerea
MSTLARAPVFKPFTLALVQLGQIGANKADNLKHAREMVLKATTQHSKKPDLVVLPECFNSPYGHVHFPVYAEKIGWTPGTKYEIEKSESESVKMLSQLAKETKTWLIGGSIPEADTESDKYYNTCTVYNPDGDLVALHRKIHLFDIDIPGKITFKESESLAPGKTPTYFDTEFARIGLGICYDIRFPELSMIAARKGAHVLIYPAAFNMTTGPLHWELLQRARANDNQVFVSMCSPARDMSAGYHAWGHSMVVNPMGQVIAEAGEKEEIIYADIGD

SEQ ID NO: 3854 - protein, 234 aa, Rosa roxburghii
VGVCYGRNGDNLPTDTEVVDLYKSNGIGRMRIYEPNQATLEALKGSNIELIVTILNNHLQELTDAATATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 3855 - protein, 414 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKLTDGSVKFPFIVQVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 3856 - protein, 473 aa, Roseovarius nubinhibens
MTNPTLLWLRRDLRLSDHPALRAAVARGGPVIPVMIRDDQMHGLGAAPKWRLGLGIEAMGRALAEKGSRLILRSGQAAEVLSALVEETGAGAVYWTRAYDPESIARDRGVKETLVAAGVEAQSHAGHLLFEPWEVETGQGSYYKVYTPYWNAVKSRDVAAPLTAPAEITAPAHWPESEDLDDWALGAAMQRGAAVCLPHQHVGEATAQGRLGAFMAQGIAEYRARRDLPGEAGTSGLSENLSLGEISIRQCWHAAMRARQEGAAGAETWAKELVWREFAYHLIYHTPRLASGNWREEWDGFPWREAGDSPEVMAWKQGRTGVEFVDAAMREMYVTGKMHNRARMVVASYLTKHLLTHWRVGQRWFEEHLSDWDVASNALGWQWVAGSGPDAAPFFRVFNPDTQAEKFDKGGAYRRAWIAEGQDAPPDTALAYFEAIPQSWNLSASRRYPDSPIVGLKEGRQAALAAYEARKPG

SEQ ID NO: 3857 - protein, 420 aa, Glycine max
MDGTFDDEAEPAVTIREYLEEVEERELEADLVLGGDDGKECTYSKGYMKRQAIFSCLTCTPDGNAGVCTACSLSCHDGHQIVELWTKRNFRCDCGNSKFGEFYCKIFPNKDVENVENSYNHNFKGSYCTCGRPYPDPDAEEQVEMIQCCLCEDWFHEEHLGLESSAEIPKDDEGEPMYEEFICKACSEVCFFLKLYPEEIWAAGKQPDATVQISKDKGVLEDILSTCRSEKPTCDTSCCSPKVDDVQATVDSKSISDGKSLSQGENCNGSMASNQCTKSTDLHVNCLLSVNIITVSPVLPGKPMFLSKNWRLALCKCNNCLEFYEQKKIAFLLDKEDSIAEYEQMAKQKREEKLQQQEGAELSFFNKLGHVEKVEILKGIEEMKDGLRAFLESADSSKPITAADVHQFFDDIKNKRRRVQ

SEQ ID NO: 3858 - protein, 160 aa, Glycine max
  misc_feature (99)..(99): Xaa can be any naturally occurring amino acid
  misc_feature (119)..(119): Xaa can be any naturally occurring amino acid
MGSKDSCRTELRIAIRQLSDRCLYSASKWAAEQLVGIEEDPAKFTPSNTRFQRGSSRICRKSRTHETAAVITPVVGVLYDATPVNVMEKDELVDGDFYXLAKSYFGCREYKTAAHVLRXEQTGRKSVFLRCYALCLMMGQVNKKRLARIPRRDTADGGYL

SEQ ID NO: 3859 - protein, 599 aa, Aspergillus oryzae
MSPFNSGTRSESSSPVQKNVKKWWKESTVYQVYPASFKDSDGDGIGDIQGILSKLDYIKSLGANILWLNPIFCSPQVDMGYDISDYYNIYRPYGTVEDLDQLIAAIHERGMKLVLDLVVNHTSDQHRWFQEARSSKANPYRDWYIWRKPIYGEDGKPQPPNNWKSYFGGSVWEYDEPSGEYYLHLFAKEQPDLNWENPYVRAAVHDIIRYWLNKGADGFRMDAINLISKDQNFPNAEITNPDSPWQDGTKHFACGPRLHEYLQGIGKILKQYDAFSVGEMPEVYDLNEMLRSVGSDRNELSMVFHFETVSLDHGPGGKFTSRKWELHELKTIVSRWQTFMHENNGWNTLYLENHDQPRIVSRFGSDEPEYRVPSAKMLATFLGFQSGTLFIYQGQELGMPNVPKHWGINQYRDIETLNHWNEITSNAPQNTPLHEACLAEYRLKSRDNARTPMQWDDSPNAGFSSVRPWLPVHDDYQSLNALDQVNDKESVYHYWASVLRLRKAYPDVLVYGSFELLSPEHPDLFVYARMASSGRAVIVTNFRPHEVTWSVPEKAFNSSGDVALSSYPGRTSHSLLQPTVTIKPFEAFVWLSGTETSRL

SEQ ID NO: 3860 - protein, 706 aa, Thiobacillus denitrificans
MSAIKKTFTYGRHQVTLETGEIARQASGAVVVNMDDTMVLVTVVAKNEVKPGQDFFPLTVDYQEKTYAAGRIPGGFLKRESRPSEGETLISRLIDRPIRPLFPEGFFNEVQIIATVMSSNPEVSADIPALIGASAALSLSGLPFDGPVGAARVGFINGEYVLNPTNAELKDSALDLVVAGTESAVLMVESEAMELPEDIMLGAVVFGHTQMQAAINAINELADEAGADAWDWAPPAEDTAMVDRLKALAEDGLQQAYNIKQKRARMAAVDEVRSKAFAELITADMDTVAANHVKDAFHRLEAGVVRNRILSGQPRIDGRDTRTVRPITIRTGVLPRAHGSALFTRGETQALVVTTLGTGRDEQTIDALEGSYSDRFMLHYNMPPYATGETGRVGSPKRREIGHGRLAKRALLAVLPSKEEFGYTMRVVSEITESNGSSSMASVCGGCLSLMDAGAPLKAHVAGIAMGLIKEGNRFAVLTDILGDEDHLGDMDFKVAGTENGVTALQMDIKITGITKEIMQAALTQAKEGRMHILGIMKASVSETHEMSAYAPRIIAMKINPEKIRDVIGKGGAVIRALTEETGTQIDIQEDGSVKIACTSMEAGELAKKRIEEITAEVEVGKVYEGPVIKLLDFGAIVNVLPGRDGLLHISQIAHERVNTIGDYLKEGQVVRVKILEADEKGRLRLSMKALLEAPAPTSGGEEHAS

SEQ ID NO: 3861 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAREFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 3862 - protein, 485 aa, Sphingomonas paucimobilis
MAHFPQTPGFSGTLRPLRIEGDILDIEIEGEVPPQLNGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLQSQTFCAHPKIDPVTGNLCAFAYGAKGLMTLDMAYIEISPTGKLLKEIPFQNPYYCMMHDFGVTEDYAVFAVMPLLSSWDRLEQRLPFFGFDTTLPCYLGILPRNGDARDLRWFKTGNCFVGHVMNAFNDGTKVHIDMPVSRNNSFPFFDVHGAPFDPVAGQGFLTRWTVDMASNGDSFEKTERLFDRPDEFPRIDERYATRAYRHGWMLILDTEKPYEAPGGAFYALTNTLGHIDLATGKSSSWWAGPRCAIQEPCFIPRSPDAPEGDGYVIALVDDHVANYSDLAIFDAQHVDQGPIARAKLPVRIRQGLHGNWADASRLAVAA

SEQ ID NO: 3863 - protein, 431 aa, Mycobacterium smegmatis
MWLRRDLRLGDLPALQAARGTDDSSVLLCFVVDPRLARSSGERRLAFLFDSLRELDDKLDGRLLVVRGRPDEEIPRLARAVDAEAVHISADFTPFGRRRDEAVAEALGEVPLEATGSPYLVSPGRITKDDGEPYKVFTPFFRRWRDHGWRRPAESSVPSSAVVDPADIANSGRIAVPTAPVKLSFPAGEDAARQRWAEFVDADLADYDEIRDDPAADATSRMSAYLKYGNIHPRTLAVDLGKGKGAQAYLRELAFRDFYADVLWHWPHSLWHNWNRRFDAIELDTDDAAYERFEVWKAGRTGFPLVDAGMRQLNETGWMHNRVRMITASFLVKDLHLPWWWGAEYFLEQLVDGDMASNNHGWQWAAGTGTDAAPYFRVFNPQTQAKKFDPKGEYVRRWVGDVEADDYPGPIVDHSAERAEALRRYGEIGEA

SEQ ID NO: 3864 - protein, 515 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTEGMIVLFVMEMLEFHENDPRRTRIANAYFSLFMALGNILGYATGAYSGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSQYPNGVVLCGMLVITYVARIWIIHLVEYTNRHVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 3865 - protein, 309 aa, Prochlorococcus marinus
MTATTFRNKNSNWTISDIPNLDGKTAFITGANSGLGYYTAKALAEKNAHVLLACRSLEKANSAIDKLKSLNPKGKFTPVELDLSDLNNVSEIGLKISSEFENLDLLINNAGIMHPPKTLSKQGFEIQFAVNHLAHMLLTLKFLPLIEKKENSRIVTVTSGAQFFGKVGWNNLKAENYYNKWESYATSKLANVMFALELNEKIKQKNILSLAAHPGIAKTNLFSAQKPKPSPIETFSLELFSPIFQSAEMGALPQLLAATSPMAKGGDHYGPKFNFRGHPKLSPTSPFALNKKERKNLWEKSLEILNSFL

SEQ ID NO: 3866 - protein, 319 aa, Candida glabrata
MNHKKVVIIGSGPAAHTAAIYLARAEIKPTMYEGMLANGIAAGGQLTTTTEIENFPGFPDGMTGSELMDRMRAQSTKFGTEIITETIAKVDLSSRPFKLWTEFNEDGEPITTDAIVIATGASAKRLHIPGEETYWQQGISACAVCDGAVPIFRNKPLAVIGGGDSACEEAQFLTKYGSKVYLIVRKDHLRASTIMQRRAEQNDKIEILYNTVTLEAQGDGKLLNNLRIKNVKTNEETDLPVNGLFYAIGHTPATKIVEGQVETDETGYIKTIPGSSLTSVPGVFAAGDVQDSKYRQAITSAGSGCMAGLDAEKYLTELE

SEQ ID NO: 3867 - protein, 112 aa, Xanthobacter autotrophicus
MKKIEAIIKPFKLDEVKEALQDVGLQGITVTEAKGFGRQKGHTELYRGAEYVVDFLPKVKIEVVLSDDMVDRAVDAIRRAAQTGRIGDGKIFVSSIEEAIRIRTGESGLDAI

SEQ ID NO: 3868 - protein, 365 aa, Gentiana triflora
MGSLLPSRVESLAISGIKTIPKEYIRPKEELASIGNIFEEAKNNNETTQIVPTIDLKDMDSLDNNKDVQTQCHGELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 3869 - protein, 461 aa, Solibacter usitatus
MIQPDSYVRSLLKRSPGESVTARGWVKTRRDSKNVHFIQLNDGSSPVDLQVVLDAGVVPEDVVAKITTGACISVEGDLVASMGKGQAVEIKARALTVHGTADPEHYPLQKKKHTLETLRELGHLRTRSNTFGAVFRVRNALACAIHKFFQDRGFMYVHTPVISASDAEGAGSMFQVTTLDLQSPKPADFTGDFFGKHTYLTVSGQLEAEIFAHAFANVYTFGPTFRAENSNTPRHLAEFYMIEPEMAFCDLKDNQDLAEAFLKSQVEYVVNACGPDLDFLAKWYDPELRKTLDGLMNASFERITYTEAIDLLQRSGRSFEFPTQWGSDMQSEHERYLTEEVFNKPVIVTDYPKDIKAFYMRGNDDGKTVAAMDVLAPRIGEIIGGSQREERHDVLLQRIREMAAHGLREEAYWWYLDLRRFGGVEHAGFGMGFERMLMYLTGMKNIRDVIPFPRTPGNAEF

SEQ ID NO: 3870 - protein, 188 aa, Triticum aestivum
  misc_feature (80)..(80): Xaa can be any naturally occurring amino acid
  misc_feature (86)..(86): Xaa can be any naturally occurring amino acid
  misc_feature (101)..(101): Xaa can be any naturally occurring amino acid
  misc_feature (109)..(109): Xaa can be any naturally occurring amino acid
  misc_feature (132)..(134): Xaa can be any naturally occurring amino acid
  misc_feature (138)..(138): Xaa can be any naturally occurring amino acid
  misc_feature (140)..(140): Xaa can be any naturally occurring amino acid
  misc_feature (144)..(144): Xaa can be any naturally occurring amino acid
  misc_feature (151)..(151): Xaa can be any naturally occurring amino acid
  misc_feature (157)..(157): Xaa can be any naturally occurring amino acid
  misc_feature (161)..(161): Xaa can be any naturally occurring amino acid
  misc_feature (164)..(164): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(175): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYXIRSKWXVPCLQFNKVGFILRXEHNASPGXYYDGRYWTMWKLLCSGCNDPHKXXXKVEXVXKDYXYPYVRIXRFNNMXQVHXSTXRLKXTGCXDPXKAKHKGILNAFNL

SEQ ID NO: 3871 - protein, 125 aa, Thermus thermophilus
MELEAGTVVEGRVVRVVSFGAFVELAGGEQGLVHISQIAHEYVTNVRDYLNEGDIVQVLIKGRDAKGRLDLSIKDLTPAPEGGAPPPRPRRLPKQSPEFENKLKSFLRGTGGFGGKGKKGGRKKR

SEQ ID NO: 3872 - protein, 415 aa, Unknown
  Shewanella sp. ANA-3
MNLIKQISADAAHAARTLAQLDESLKNTVLLDMARSLREKSYEIQSANLIDVHRATQDNLSPAMVDRLTLNQHRIEAMAQGIETIAALPDPVGRERFIGKRPNGLSISKMRVPLGVVCMIYEARPNVTADAGALCFKSGNAVILRGGKEALHTSQVIASILQAVLTAYGLPKALISVIPDPDRALMLELMQQREFIDVIIPRGGEGLINYVTENSSIPVIQHFKGVCHLYVDKDANQDIALDLLLNGKTQRTGVCNALEGLLVHKDIAPRFLPRVAKALAEHQVKINACPPAAAYFDACTYMAEEDFGQEYLDLEIAIRQVDSFEVATQHIAKFGSHHTEVICTDNELTAARFQRAVDASVVMVNASSRFSDGSELGLGAEIGIATTKLHAYGPMGLEALTTEKYLVSGTGQIRA

SEQ ID NO: 3873 - protein, 136 aa, Helianthus tuberosus
ISHYTWHNVTEKSRVTTKHAFATFSFIAELFISLYVGMDALDIEKWSFVKDSPGTSAEVSAILLGLVLVGRAAFVFPLSFLSNLTKKAQHEKIDFRQQVLIWWAGLMRGAVSMALAYNQFTKEGHTTMPGNAIMIT

SEQ ID NO: 3874 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSYEDVCTGTTGHNEVVRVQYDPKECSFESLLDVFWNRHDPTTLNRQGGDVGTQYRSGIYYYTDEQDRIAREAVEKQQKILNKRIVTEILPATKFYKAENYHQQYLAKGGRMGLRQSAEKGCKDPIRCYG

SEQ ID NO: 3875 - protein, 207 aa, Pseudomonas putida
MVQRSKSSANWLREHFNDPFVKQAQKDGYRSRASYKLLEIQEKDRLIRPGMSVIDLGAAPGGWSQVTSRLIGGQGRLIASDILEMDSIADVTFIQGDFTHDEVLQRILEAVGDSHVDLVISDMAPNMSGTPAVDIPRAMFLCELALDLATRVLKPGGDFLIKIFQGEGFDVYLKDVRSKFDKVQMRKPSSSRDRSREQYLLGRGFKG

SEQ ID NO: 3876 - protein, 481 aa, Arabidopsis thaliana
MEKKKSMFVEQSFPEHEIGDTNKNFDEDGRDKRTGTWMTGSAHIITAVIGSGVLSLAWAIAQLGWVAGPAVLMAFSFITYFTSTMLADCYRSPDPVTGKRNYTYMEVVRSYLGGRKVQLCGLAQYGNLIGITIGYTITASISMVAVKRSNCFHKNGHNVKCATSNTPFMIIFAIIQIILSQIPNFHNLSWLSILAAVMSFCYASIGVGLSIAKAAGGGEHVRTTLTGVTVGIDVSGAEKIWRTFQAIGDIAFAYAYSTVLIEIQDTLKAGPPSENKAMKRASLVGVSTTTFFYMLCGCVGYAAFGNDAPGNFLTGFGFYEPFWLIDFANVCIAVHLIGAYQVFCQPIFQFVESQSAKRWPDNKFITGEYKIHVPCCGDFSINFLRLVWRTSYVVVTAVVAMIFPFFNDFLGLIGAASFWPLTVYFPIEMHIAQKKIPKFSFTWTWLKILSWTCFIVSLVAAAGSVQGLIQSLKDFKPFQAP

SEQ ID NO: 3877 - protein, 138 aa, Helianthus tuberosus
ISHYTWHNVTEKSRVTTKHAFATFSFIAELFIFLYVGMDALDIEKWSFVKDSPGTSAEVSAILLGLVLVGRAAFVFPLSFLSNLTKKAQHEKINFRQQVLIWWAGLMRGAVSMALAYNQFTKEGHTTMPGNAIMITST

SEQ ID NO: 3878 - protein, 234 aa, Rosa roxburghii
AGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 3879 - protein, 410 aa, Streptomyces avermitilis
MAEHPAYPVGLRLTGRRVVVLGGGQVAQRRLPALIAAGAKVHLVSPEATPSVEAMADTGEITWSRRRYEDGDLAEAWYALIATSDAAANVAASAEAERLRVWCVRSDDADAATAWTPATGHSEGVTVAVLTTNAKGRDPRHTAAIRDAVVEGLRDGTLVAPHHRVRTPGVALVGGGPGDPDLITVRGRRLLAEADVVIADRLGPRDLLAELPPHVEVIDAAKIPYGRFMAQEAINNALIEHARQGKSVVRLKGGDPFVFGRGMEEAQALAEVGIPCTVVPGISSSISVPGAAGIPVTHRGVAHEFTVVSGHVAPDDERSLVDWPALAKLRGTLVILMGVDKIGKIADTLVAHGKPAGTPVALVQEGTTAAQRRVDATLATVAETVRAQDVKPPAVIVIGAVVDVGPQTFE

SEQ ID NO: 3880 - protein, 567 aa, Unknown
  Synechococcus sp. RS9917
MQQPWWSGAVIYQLIVRSYADGNGDGTGDLQGLSSRLPYLRWLGVDAVWLTPIYPSPLQDGGYDITDFKAVHPDLGDLAAFHRFLTEAHGQGIRVILDLVLNHTSTLHPWFQRARWAPKGSLERDVYVWSDDPQRYADAPVLFRHFEASNWEWDSVAEQYYLHRFLRHQPDLNYDNPLVQEEMLAVVDFWVERGVDGFRLDAVPFLFEEEGSRCEGLPQTHAFLQVIRERLEQQGREVLLLGEAIQPVEEAAPYLVDEELHGAFNFVLTAHLFAAIASGSTRDLRQCLQASHQAVPGCRWALPLRNHDELWLGDGHLVPEEVIQTIRTGLHQGQGHWLNWGINRRLAPLLNGDPGSNRVLHALLYSLPGMPCVYYGDELGMGDWPGLRDRDPNRTPMAWTPARNGGFSTAPDPLLVLPPITAPGYDYRVVNVEVQKQLPGSLLNWHRRMLTCRRLLPALRSGDFALLHCAHPAVIVYVRCSEAMTVLVAANLSAAGASFRLDLSRWQGQRTREVLWGCEFPPASTDWFVYLPAHGFSWWLIGEVDAISDEPGAEPDPADGGEAVMPA

SEQ ID NO: 3881 - protein, 143 aa, Helianthus tuberosus
ACRSTISHYTWHNVTEKSRVTTKHAFATFSFIAELFIFLYVGMDALDIEKWSFVKDSPGTSAEVSAILLGLVLVGRAAFVFPLSFLSNLTKKAQHEKIDFRQQVLIWWAGLMRGAVSMALAYNQFTKEGHTTMPGNAIMITST

SEQ ID NO: 3882 - protein, 236 aa, Rosa roxburghii
MGVCYGMLGNLPPQTDVVALYKQYNIRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALLDPIIRFLVEHRSPLLVNLYPYFSYKDNTGAIRLDYALFTAASVVVQDGQLGYRNLFDAMLDAVYSALEKAGGGSLEIVVSESG

SEQ ID NO: 3883 - protein, 150 aa, Striga asiatica
PEVLRPLYESSKVLAQRTTIAALRYIRQIAQETSGEVVYGLGRQPAVLRTFSQRLSRGFNDAINGFNDDGWSLLNCDDGGDDVIVAVSSAKNVTGASNNISMIGGVLCAKASMLLQNVPAAVLVRFLREHRSEWADFNVDAYSAASLKNS

SEQ ID NO: 3884 - protein, 530 aa, Nicotiana plumbaginifolia
MADIEGEPGSSMHGVTGREPVLAFSVASPMVPTDTTAKFSVPVDTEHKAKVFKFYSFSKPHGLTFQLSWISFFTCFVSTFAAAPLVPLIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPILYDIIRKAGATPFTAWRIAFFIPGWLHVVMGILVLTLGQDLPDGNRGDLQKKGGVSKDKFTNILWYAATNYRTWIFVLLYGYSMGVELSTDNVIAEYFFDRFDLKLHTAGIIAATFGMANLLARPFGGFSSDFAAKRFGMRGRLWVLWILQTLGGVFCVLLGRSNSLPIAVTFMILFSVGAQAACGATFGIIPFISRRSLGIISGMTGAGGNFGSGLTQLLFFTSSKYSTATGLTYMGMMIIGCTLPVTLCHFPQWGSMFFPPTKDPVKGSEEHYYAAEYTEAERQKGMHQNSLKFAENCRSERGKRVGSAPTPPNLTPNRV

SEQ ID NO: 3885 - protein, 204 aa, Triticum aestivum
VTFQNKFVQKSRLVPVRNSRDIVDPRVRFEIRRYKDAMWVSTAPIEDISLVDATRSGFLQLFKYIQGKNAYNETIEMTAPVLTRVAPSDGPFCVSSFVVSFYVPAKNQADPPPAEGLRVQRWAGARYAAVRRFGGFVADADVGKQAALLEASLQGTRWAAPVSDGRKADPASEYTVAQYNSPFEFSGRVNEIWMLFDTMAASDM

SEQ ID NO: 3886 - protein, 234 aa, Rosa roxburghii
MGVCYGRNGDNLPTDTEVVDLYKSNGIGRMRIYEPNQATLEALKGSNIELIVTILNNHLQELTDAAAATNWVQQNVQPYAADVKFKYIAVGNEVHPDAAEAKYLLPAIQNIQNAVTAANLQVKVSTAIDTTLQANFPPSDGAFSDAANSFITPVITFLGNNGSPLLANIYPYFAYINDPVNIKLEYALFTSPGVVVQDGSNGYQNLFDALLDTLYSALEKAGAPNMAIVVSESG

SEQ ID NO: 3887 - protein, 202 aa, Crocosphaera watsonii
MIVQVMGRDAGHLALRGGIAGGADVILIPELTPYLSLDVLDGCCHQLLRLQKLGRHFGLLVIAEGVKTQNKEKDPHIADYLLRQIKEYSQILCHEKHEDFCLLKDIDMRTTVLGHLQRSHPPVAWDRLLSTAFGIKAVELIQAENYDHLVVWQKGQVSSEPLSTVTATIKERHQQKICTSPVEKYDCMVKTARSLGIYLGDG

SEQ ID NO: 3888 - protein, 375 aa, Pseudomonas putida
MSKRDYYEVLGVERGATEADLKKAYRRLAMKYHPDRNPGDKESEDKFKEANEAYEVLSDASKRAAFDQYGHAGVDPSMGGGGAGFGGANFSDIFGDVFSDFFGGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 3889 - protein, 460 aa, Phanerochaete chrysosporium
MLKIGFLALAFALSPLAQAQTTVSAWGQCGGINYTGSTTCASGSACVYLNDYYYQCIPGATASTPAHSSTITSVSSHTVSSTSSSVVSSSTPSSPPPPSSFGFVTTSGQKFMLNGQEFTVVGENSYWVGLMGYSTANINKAVQDIANAGSTVVRTWGFNEVTPSTQQNYPIYYQSWSGATPTVNTGANGLQNFDQIVASAKANGLRLIVALTNNWSDYGGMDVYVKQILGSANHDLFYTNAQVIAAFKNYVKTFVGRYVNEPTIMAWELSNEPRCAGSTGTTTGTCTTATVTNWISEISAYIKSIDPNHLVAVGDEGFFNEPGNPSYPYQGGEGIDFNVNLNISTIDFGTFHLYPESWGQSSNPSSSVWGSQWISDHATSQKSANKPVIMEEFGVTSDQTDVYKAWFSTVLSSGLSGDLIWQAGSHLSTGDTPQDGYAEYPDGVVYPIIQQHAAALKARG

SEQ ID NO: 3890 - protein, 822 aa, Roseovarius nubinhibens
MIGAAEPLAARLRLPYSVILAVLGVLIGVGATFFLHTELTDALNPVAEAILDLPIRSNVFLYVFLPTLLFQATLGMNLRRMIDDWVPILMLAVVAVVVATVSVGYALAWVSALPLAACLLIGAIVSTTDPSAVVSIFRSISSPRRLARIIEGESLLNDAAAIALFGLFMGFVMLGTPDPELGDALLRFPLLIAGGAITGWLCARVAVWIMALFGRHELAQISVSVALPYLAYIGAEQIVGASGVIAVVAAGLTLNLVAPGRLPPQSWTNLRELWGVLAHWAGALIFILAALLIPRLLEEVRIGDILLVAVVIVAAVVARMVILFGLLPLLARLRLSPPVDRPYRVAILWGGLRGAVTLALALAVTESFRVPDDIQRVVGILATGFTLFTLIVQGTTLRWVIGRLGLDRLSPIDEALSRQVVAVALQTVREDLASTTENYDLSRDIVRSEAKRFGERLDEAVKTAEDSADILDRDRIALGLIVLAGHERDTIIDRVRERTISARMAEKVMSDAERLIEGARSQGRSGYQRAARRSVAYGKGFRAAVWLNRRLGISAPLAQMTTDRFELMLSQRLILRDLGGFIDGRIRRIHGRRVAELLHELLSRRIEAVETALEGLRLQYPGYAEELERRFIRRTALRLEEREYMMMREDGLIGAEVYMSLMADLGARRAAAETRPKLDIALQRTALVRQFPLFAEFSDRALRQLARGLETRYANVGEAIIRKDSAAKRVFFIASGAVELESAGQTWRLGRGEMFGQMAILMQKSVRAEAKAIAPTTLLVLDEDRFRRLLGRSKALRKAVRESAEKRGIEPSALLPPAKDAS

SEQ ID NO: 3891 - protein, 122 aa, Citrullus lanatus
LSRLPGGPEVPFHPGREDKPEPPPEGRLPDATKGSDHLRDVFYTMGLSDQDIVALSGGHTLGRAHKERSGFEGPWTSNPLIFDNSYFTELLSGEKEGLLQLASDKALLSDPVFRPLVEKYAR

SEQ ID NO: 3892 - protein, 455 aa, Phanerochaete chrysosporium
MLRASLLAAICAAGLPAWAAVPMWGQCGGMTYTGDTVCATGTTCVYLNEWFSQCILDAPTSTLPSTSSRPTSVASSSVAASSTASASSPSSTGFVTVSGQKFMLDGEEFTVVGENAYWIGLFDYGVADVDKAYQDIVNAGSTVVRTLGFNDVTPADIAEYPVYYQSWSNGTGTINLGPNGLQNFDQVVARAKAHGLRLLVTLTNNWSDYGGMDVYVQQILGSTYHDLFYTDPQVIAAFKKYINGFVSRYVDEPTILAWELANEPRCAGSTGVTTGNCTNPTITQWIAEISAYIKSIDPNHLVGVGDEGFINDPGNPSYPYQYVEGTLGIDFEANLQIPTIDFGTFHMYPESWGQTNDPSAVGWGNQWITDHAAMGRSAGKPVIMEEFGVTIADQALTYAEWYDTVISTGLAGDLIWQAGSHLSGGDTPNDGYAEYPDGDVYPIIQQHAAALKARG

SEQ ID NO: 3893 - protein, 232 aa, Rosa roxburghii
AGVCYGMLGNLPPQTDVVALYKQYNIRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALLDPIIRFLVEHRSPLLVNLYPYFSYKDNTGAIRLDYALFTAASVVVQDGQLGYRNLFDAMLDAVYSALEKAGGGSLEIVV

SEQ ID NO: 3894 - protein, 221 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISHKAVKREEAQVQADACPLTPSSWKGFWDGADSKDMGIFSVPLLSPCPSLGHSQLVVT

SEQ ID NO: 3895 - protein, 329 aa, Magnaporthe grisea
MHSHSGQFCPGHAKDQLEDVILHAISIGYKTMGLSEHMPRTQLCDLYPEELVPDPHASLAELMPRHAAYMTEARRLQKKYADRITLLIGFEGEFIRSEYGTLVRSLADGNGDPSYFQNGDSKLVTDAGKVDYFIGSLHHGAGGIPIDFDRATYLRSVEAAGPNGEEDLFVHYYDQQFEMLQALRPPIVGHFDLIRLMSEEPGRNPSAWSPNRVWPLIKRNLAFVASYGGWLECNSSALRKGLAEPYPCRPIAEEWVRLGGKFTMSDDSHGIAQVATNYVRALDYLESLGVNEVWTYDRAKEGSELVEKGVSFTEFRGSLRLPTTASKTS

SEQ ID NO: 3896 - protein, 606 aa, Citrus clementina
MAAATTTSSLIDLGSCKDSCSSPSFSSSRARMAFSLKKPTEITCSLQTPSILHFPKQSPKYPPSPAASPPPSSPPLTTKQQPKENDNFAPSKWNFLQKAAALALDAVENALVSQERQHPLPKTADPTVQIAGNFSPVPEKPVCQNLPTTGKVPDCIQGVYVRNGANPLHEPVAGHHFFDGDGMVHAVKFNKGSVSYSCRFTETNRFVQERSLGHPVFPKAIGELHGHTGIARLLLFYSRALFGLVDPSHGTGVANAGLVYFNNRLLAMSEDDLPYHVRVTPSGDLKTVGRFDFSGQLKSTMIAHPKVDPVTGDLFALSYDVVKKPYLKYFRFSPQGIKSPDVEIPLEEPTMMHDFAITENFVVVPDQQVVFKLNEMIRGGSPVIYDKNKVSRFGILDKNATDASKMKWIDAPDCFCFHLWNAWEEPERDEVVVIGSCMTPADSIFNECDESLKSVLSEIRLNLKTGESTRRPLISEDEQVNLEAGMVNRNLLGRKTRFAYLALAEPWPKVSGFAKVDLLTGQVNKFIYGGQRYGGEPLFFPRDPNSENEDDGYILAFVHDEKEWKSELQIVNAMTLELEATVKLPSRVPYGFHGTFISAKDLAKQA

SEQ ID NO: 3897 - protein, 278 aa, Chromobacterium violaceum
MTGKVYLIGAGPGDLDMLTLKAARCLQLADVALVDDLVHPDIRAMLRPDAEIVPVGKRGGCPSASQAAIEQRMVDEAHAGKTVARLKGGDPFVFGRGGEEMLTLQAAGVEVEIVNGLSAGLAVPATLGIPLTHRSFVHGVTFVSGHPHQDGDEPNWQALAQSGMTLVIYMGVKRLPLIRAELLRHGLKADTPAAAIENGTLPQQRQVLSTLDALEQDMGAAGIHSPALIVIGPTVALASCSPSALERSEAPLQGKGGMRASLEARSAEGWERIKMAAD

SEQ ID NO: 3898 - protein, 487 aa, Unknown
  Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 3899 - protein, 590 aa, Mycobacterium avium
MNDAREAVEHHPEEGSHVQDGVVEHPEAEDFDNAAALPTDPTWFKHAVFYEVLVRAFFDANADGAGDLRGLLAQLDYLQWLGIDCIWLPPFYDSPLRDGGYDIRDFYKVLPEFGTVEDFVALLNAAHERGIRVITDLVMNHTSESHPWFQESRHDPDGPYGDFYVWSDTSDRYADARIIFVDTEESNWTFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPADVVEYFGDPSTGGDECHMAFHFPLMPRIFMAVRRESRFPISEILAQTPQIPEMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRTPMQWTPDRNAGFSKANPGRLYLPPSQDPVYGYQAVNVEAQRDTSTSLLNFTRTMLAVRRRHEAFAIGTFEELGGSNPSVLAFVRQVSNDGDTVLCVNNLSRFPQPIELNLQHWSGCIPVELTGHVEFPRIGHLPYLLTLPGHGFYWFQLTACEEDT

SEQ ID NO: 3900 - protein, 392 aa, Pseudomonas syringae
MHNPTPRTESPNALAFIKRFFAAEAAGGLILMAAALAALIVANSPLADSYFVALHTVLAGMSVEHWINDGLMAIFFMLVGLEIKREMLAGQLASWSQRALPGFAALGGMVVPALIYVAFNWGQPDTLGGWAIPAATDIAFALGVLSLLGKRVPLSLKIFLSALAILDDLGAVLIIALFYTSGLSIPMLLAALGSIAVLVALNRLGVKKLLPYLVVGALLWFFMLQSGIHATLAGVALALCIPLGKPDEEASSPLLHLEEKLHPWVAFAVVPIFGFANAGVSLSGITVDKLVDPVPLGVALGLLIGKQVGIFALAALAIRAGLARLPDGSNWGQLYGVAALCGIGFTMSLFIGALAFPGAPALVDEVKVGVLIGSVLSALLGVVVLRRFGARG

SEQ ID NO: 3901 - protein, 74 aa, Unknown
  Nostoc sp. PCC 7120
MSKQDLIEMEGTVTESLPNAMFRVDLDNGFNVLAHISGKIRRNYIKILPGDRVKVELTPYDLTKGRITYRLRKK

SEQ ID NO: 3902 - protein, 567 aa, Debaryomyces hansenii
MSEVSLGRYIFERLRQLLVQTVFGLPGDFNLSLLDKIYEVDGLRWAGNANELNAAYAADGYSRVKGLACLITTFGVGELSALNGIGGAFAEHVGLVHIVGVPSISSQAKQLLLHHTLGNGDFTVFHRMSNNISQTTAFISDIKSAPKEIDRCIREAYIFQRPVYIGLPANLVDINVPAVLLNIPIDLSLRENDPEAQEEVIDNILQLISEASNPVILVDACTSRHNCNGEVEALVNKTQFPVLTTPMGKSSFNESHPRFAGVYVGTMSHVEVKNLVDGADLILAVGALLSDFNTGSFSYSYKTKNVIEFHADCIKIKQGTYPGVQMKEVLNVLIDKIDPAVKHYNPIAIPSPTFLTNSVTNSDVLSALLTQEWLWSKVSAWFREGDIIITETGTSAFGIVQTKFPNNTIGISQVLWGSVGFTVGATLGAVMAAEEIDPNKRVILFVGDGSLQLTVQEISTMVKWETRPYLFVLNNDGYTIDRLIHGMSATYNDIQPWNNLALLPLFNAKYYDAIQVSTTDELEKLFCDEEFAINSKIRMIEVMLPRMDAPINLIKQMEFISKMNADT

SEQ ID NO: 3903 - protein, 561 aa, Neisseria gonorrhoeae
MSMENFAQLLEESFTLQEMNPGEVITAEVVAIDQNFVTVNAGLKSESLIDVAEFKNAQGEIEVKVGDFVTVTIESVENGFGETKLSREKAKRAADWIALEEAMENGNILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQATRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNAAANANAGTTSLGDLLKAKLSGEQE

SEQ ID NO: 3904 - protein, 1072 aa, Vibrio vulnificus
MTESISLTLTNNESSRFLIRQRLLSILQAFGYDACRCDIHMLRLGEFVRITLADIQRFTLSFELDDDSLKVILASSELDPQTCSFPACVHTFQREKAIGVSIPSLIPLSDEILNQLTQFLAKPSRDELMSELKAKNQELAVHQAGLEKEIELRTADLKASEELSRTIIDGAPSSVAIVDESLSISLWNSTAQNVYGYSSEEATGENILTLLNMSLPDALSHVLSAPLALQNQPDVEGGFFEVETTTKEGHMVPIDLGVSIFELNGACHAALFLRDVTSRKAVEKELNDAKAKAEEAVEVKSMFLANMSHEIRTPMNAIIGMSHLALKTDLTPKQHDYVSKIHSSATLLLGIINDILDFSKIEAGKLSIETTEFYLDDVFHNVSMVTGQKAFEKGLELIFDLPRETPRCLLGDPLRLGQIIINLVNNSVKFTEKGEITVSVHHIRNVEDLVELEFRISDTGIGMTDKQMKSLFTAFTQADGSTTRKYGGTGLGLSICRRLVELMGGQIRVESEAGKGSHFIFNVLVKADPANSSAPSIVPQSLEKIRILVVDDNEHALEIMQEMLSTLPGKVALANSGQQAVDCIRKASEQREKFDLIFMDWNMPEMDGIETSRLIRESFASEYQPQIVIVTAYDKEDVLDATNDLDIAGFLSKPVGQSYLFDLLVELFGRDRNPTTQIRKKELPTHDSKNDLKGLKVLLTEDNEINQQIAVELMEGNGLLVTVANNGQEALEHLEAMEKGESHFDIVFMDLQMPVMDGYEASHRIRANSSYDTIPLIAMTAHAMVEERERCLNLGMNDHISKPIDPEILFNTIRKWCPRTLNEKDESPVDVEQSQTQQLDSSIESAATPKSTERAAAEKRTLETLESLDYKNGLLRVAGNQTLYRRLLSQLMDKEISAPERLTIALDKQDTEQAIIIAHSLKGSASNLGAIRLSDIASRLEMAIQHGKERAEIDKLNKELDGYLEHFFQDLALALGRPKPSSDKRLELKDEELMIIHTLDSLLDSLDAYAIEFLDEHYVLLNTLLKSEDFEACCRCVNDCDFESASKSLRKAVSIYPLDLGKLSGEKNGRES

SEQ ID NO: 3905 - protein, 201 aa, Triticum aestivum
KIRIFDLGKKKAKVDDFPLCVHLVSDEYEQLSSEALEAGRICANKYMVKHCGKDQFHIRMRLHPFHVIRINKMLSCAGADRLQTGMRGAFGKPQGTVARVHIGQPIMSVRSSDRYKAAVIEALRRAKFKFPGRQKIYVSKKWGFTKYDRAEYETLKEDGRLAPDGANVKFRPDHGPLDNWRKVHKGTSCCLNMVLILFYWN

SEQ ID NO: 3906 - protein, 320 aa, Rhizobium leguminosarum
MSHKPGRGRIYSSITETIGDTPLVRFDKLAREKGVVANLIGKLEFFNPIASVKDRIGVAMIEGLEAQGKITPGKTVLIEPTSGNTGIALAFAAAAKGYRLILTMPETMSVERRKMLALLGAELVLTEGPKGMKGAIAKAEELASSLDDAVIPQQFENPDNPEIHRKTTAEEIWNDTDGTVDIVVSGIGTGGTITGVGQVLKSRKPEIKIIAVEPADSPILSGGNPGPHKIQGIGAGFAPKILDTGIYDEVVTVTNDEAFEQARLVARLEGVPVGISSGAALTAAIKVGIRPENAGKNIVIIIPSFAERYLSTALFEGLGS

SEQ ID NO: 3907 - protein, 430 aa, Bordetella bronchiseptica
MNDLLPAAAAPAGARALPLRHADPEIWRAVDAERQRQMHSIELIASENFVSQAVLDAQGSVMTNKYAEGYPGRRYYGGCRHVDVAERAAIERARRLFGCEYANVQPHSGSQANQAVYLALLAPGDRILGLDLKAGGHLTHGAHVNLSGKWFEALSYGVDPVSHRIDMDEVERTARRERPRLIIAGGSAYARVPDFARFRAIADATGALFVADMAHYAGLVAGGAFPSPVPFAHVTTTTTHKTLRGPRGGMILTDDADIARRIDAAVFPGLQGGPLMHVIAAKAVALGEALQPGFRAYARAVIDNARALCARLAEGGLSIVSGGTDCHLGVVDLRPWGLAGNAAERALEEAGITVNKNAVPGDAASPAVTSGIRVGSAACTSRGMGPAEFRQIGDLVLAVLGGLRDGGQAGGRDAVPARAAELSRRFPLPY

SEQ ID NO: 3908 - protein, 527 aa, Triticum aestivum
MSSCVSSSHHHCARRLPAPPPRAHLAAADSCASPYRRRVGSLRAMGAEAPSSVAPAAGRKASAVQAEMVEAAAMWCAMHGLVVGDRGNPRSGTVPGVGLVHAPFSLLPTRFPASFWKQACELAPIFNELVDRVSLDGKFLQGSLSRTKQVDDFTARLLEIHAKMMAVNKKEDIRLGLHRSDYMLDSETNSLLQIELNTISTSFPGLGSLVSELHRTLLNQYGEVLGLDSERIPRNWAAIQFAEALGKAWVEYNNGSAVVMMIVQAEERNMYDQYWLINHLKESHGVMTIRKTLAQVEAEGLVLPDGTLVVDGRPVAVVYFRAGYAPTDYPSEVEWSARLLIEQSSAIKCPSISYHLVGTKKIQQELAKPSVLERFLDNEEDIAKLCKCFAGLWSLDNEEIVKSAIEKPDLFVLKPQREGGGNNLYGHDLRETLIRLKNKQGEALAAYILMQRIFPRASLTQLVQGGVCFEELSISELGIFGSYLRNKDKVVINNQCGYLMRTKVSSSNEGGVAAGFAVLDSILLTDE

SEQ ID NO: 3909 - protein, 410 aa, Campylobacter jejuni [sequence omitted]

SEQ ID NO: 3910 - protein, 286 aa, Prochlorococcus marinus
MDSPSTTASGWIDEHHQGVRYGLQGRVLVDEKSPYQRITVIDSSRYGKGLLLDGCWMTAEHQERHYHESLVHPALCSAAQLERVLVIGGGDGGTARECLRYQDVKHLDMVEIDGRVVELSQKHLPSIGGHAWSDARLQLNLEDGIAWTANATDSSYDVILVDGSDPTGPAEGLFNEAFFKQCRRILRPGGVFATQSESPEAFRQIHIDTVRLIRQVFGYADPLYGWVPMYPSGWWSWTFAAVDGPRYRNPLPARAAAISSGCEIWSPRWQQGAFEAIPAFIERELT

SEQ ID NO: 3911 - protein, 112 aa, Agrobacterium tumefaciens
MKKIEAIIKPFKLDEVKEALQEVGLQGITVTEAKGFGRQKGHTELYRGAEYVVDFLPKVKVEVVLADENAEAVIEAIRNAAQTGRIGDGKIFVSNIEEVIRIRTGETGVDAI

SEQ ID NO: 3912 - protein, 240 aa, Arabidopsis thaliana
  misc_feature (155)..(155): Xaa can be any naturally occurring amino acid
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMVXVIKTKSVKYMPFFLSLANFMNGVVWVIYACLKFDPYILIPNGLGSLSGIIQLIIYITYYKTTNWNDDDEDKEKRYSNAGIELGQA

SEQ ID NO: 3913 - protein, 241 aa, Rosa roxburghii
VGVCYGMMGNNLPSHSEVISLYKSNKINRMRLYDSNHGALEALRGSNIEVILGVPNSLLQDFAKNPSNAQNWVKTNVLDFYPSVRIKYIAVGNEVSPVNGDTSLAQFLLPAMQHVYQAVRAANLHDRIKVSTAIDTTLIGVSYPPSQGAFRGDVRGYLDPIIGYLVYAKAPLLANIYTYFSYVGNPRDISLPYALFTSPSVVAWDGNKGYQNLFDAMLDALYSALERAWGGSLEVVVSESG

SEQ ID NO: 3914 - protein, 461 aa, Kluyveromyces lactis
MSAEPYEPEFQQAYNEVYNCLKDSTLFDKKPVYKKVLPVVSVPERIIQFRVTWENDKGEQEVATGFRVQFNSAKGPYKGGLRFHPTVNLSVLKFLGFEQIFKNALTGLSLGGAKGGLCFDPKGRSDSEIRRVCYAFMKELSRHIGQDVDVPAGDIQVGGREIGYLFGAYRHYKNSWEGVLTGKDLNWGGSLIRPEATGYGLIYYTEAMIKYASQGKESFEGKRVVISGSGNVAQYAALKCIELGATVLSLSDSKGSVISETGITAEHIYAIQDGRAAWKTLEQIVGEASVFSGSSVKYIAGARPWVHVGKVDVALPCATQNEVSGAEAEHLVANGVKFVAEGSNMGSTQEAIDVFEGVRLQTASASAPAVWYAPGKASNMGGVAVSGLEMAQNSARVSWTRETVDAELKKIMTTCFDDCVTTAKEYSNESNVEALPSLVKGANLTGFIRVADAMLHQGDVF

SEQ ID NO: 3915 - protein, 318 aa, Prochlorococcus marinus
MEIIETDVAIVGGGPAGCTCALYTSRSNLKTVIIDKNPSVGALAITHQIANYPGVPVDISGEKLLTLMREQAVQYGTDYRRAQVFGIDVGKDWKTVYTPEGTFKAKALVLASGAMGRPASFKGEADFLGKGVSYCATCDGAFYKNREVAVVGANKEAIEEATVLTKFASTVHWITSSDPKQDNEEAKELMDISNIKHWSRTRLLEILGNDMGVNRVIVKNKQEEGPINIDLDGVFVYMSGSKPITDFLGDQIALKEDGGVIVDDFMSTNSDGVWAIGDIRNTPFKQAVVAASDGCIAAMSIDRYLNSRKNIRVDWIHS

SEQ ID NO: 3916 - protein, 361 aa, Photorhabdus luminescens
MMKMDCLIVGAGQAGLSLAATLAAKNINVCILEREARIGDVWRRRPDNMLLFTSRGMTQLHGLPFPGIKEGYPDKNEVADYLERYASHHNLAIHTQTEVVEVKHDTDGYRVKTKDGKVFHAPCLVNATGANQLVDIPALAERFSTDIQQITADQYREPKQIKTGSRVAVVGDGASGRQIAKDLAATAKVTLFCGSSRPLLPNRILGKDIFWWLSKSGLLFANYYSLVGKIMRRRNPIPCGDLKNHRLAVLDIKIANRLVDIKDNKLCDSSGNQYEVDTVIWCLGYKDDTAWLTLPGAADANGFVCKNGHAEGGKTPYPGLFIVGRKWLSSRGSELMLGAYKDTCRVAKWVENYLKEHVPLK

SEQ ID NO: 3917 - protein, 234 aa, Rosa roxburghii
VCYGMLGNLPPQTDVVALYKQYNVRRMRLYDPNQAALTALRGSNIELILGVPNDNLRTIASSQANANSWVQNNVRNYGDVRFKYIAVGNEVQPEESSAQFLVPAMRNIQTAIANAGLGNQIKVSTAIDTRGLGESYPPSKGSFKSENRALHDPIIRFLVEHRSPLLVNLYPYFSYKDNTGAIRLDYALFTAASVVVQDGQLGYRNLFDAMLDAVYSALEKAGGGSLEIVVSESG

SEQ ID NO: 3918 - protein, 345 aa, Glycine max
MASSTITSSFLTSPPSSLFNKSSSPSFHATPTLRPLAPRASMSASAPPYDFGSFRFDPIRESIVSREMTRRYMIDMVTHADTDVVIVGAGSAGLSCAYELSKNPSINIAIVEQSVSPGGGAWLGGQLFSAMVVRKPAHLFLDELNLEYDEQDNYVVIKHAALFTSTIMSKLLARPNVKLFNAVAAEDLIVKNGRVGGVVTNWALVSLNHDTQSCMDPNVMEAKVVVSSCGHDGPFGATGVKRLKSIGLIDSVPGMKALDMNKAEDAIVRLTREVVPGMIVTGMEVAEIDGAPRMGPTFGAMMISGQKAAHLALRSLGLPNALDSVGNVHPELVLAAAESAEIAEA

SEQ ID NO: 3919 - protein, 279 aa, Brassica napus
  misc_feature (47)..(47): Xaa can be any naturally occurring amino acid
  misc_feature (70)..(70): Xaa can be any naturally occurring amino acid
  misc_feature (95)..(95): Xaa can be any naturally occurring amino acid
MATTTAAAASGIFGIRIQDPSSGAGRVQAKFNFSFGKKKPAPPPKKXKQVQNDGDRLVWFPGANPPEWAXNGSMIGGPWIRTPFGLGKPAEYLSXTDFDGLDQNLAKNVAGELLGVRQESKEINPTPFQPYTEVFGIERFRECELIHGRWAMLGTLGALAVEGLTGIAWQDAGKVELVEGSSYLGQPLPFSLTTLIWIEVLVVGYIEFQRNAELDPEKRIYPGGYFDPLGLGSDPEKLDTLKLAEIKHSRLAMIAFLIFSLQAAFTGKGPISFLATFSS

SEQ ID NO: 3920 - protein, 349 aa, Glycine max
MASSTITSSFLTSHPSSLFNKSSSSSFPSFHATPTLRPHRPRASMSAAAPPPYDFGSFRFEPIRESIVSREMTRRYMTDMVTHADTDVVVVGAGSAGLSCAYELSKNPSVNIAIVEQSVSPGGGAWLGGQLFSAMVVRKPAHLFLDELGLEYDEQDNYVVIKHAALLTSTIMSKLLARPNVKLFNAVAAEDLIVKNGRVGGVVTNWALVSMNHDTQSCMDPNVMEAKVVVSSCGHDGPFGATGVKRLKSIGLIDSVPGMKALDMNKAEDAIVKLTREVVPGMIVTGMEVAEIDGAPRMGPTFGAMMISGQKAAHLALRSLGLPNALDSVGNVHPELVLAAAESAEIADA

SEQ ID NO: 3921 - protein, 511 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVKVHHKWIDHLQPSSQSCFLSYRFYISRS

SEQ ID NO: 3922 - protein, 347 aa, Streptococcus orisratti
IKKAYRRMSKKYHPDINKEPGAEQKYKDVQEAYETLGDEQKRAAYDQYGPAGANGSFGGGAGGFGGFDGGAGFGGFEDIFSSFFGGGGSMRNPNAPRQGDDLQYRVNLSFEEAIFGAEKEVTYNREAECTTCHGSGAKPGTSPVTCSRCHGQGVINVDTQTPLGMMRRQVTCDVCHGTGKEIKNPCTTCHGTGHEKEKHKVSVKIPAGVETGQQIRLQGQGEAGFNGGPYGDLFVVINVLPSTKFERNGSTIYYNMDISFVQAALGDTVDIPTVHGPVEMNIPAGTQTGKTFRLKGKGAPKLRGGGQGDQHVTVNIVTPTKLNDAQKRRFELLLLRVVTGRNPRKKA

SEQ ID NO: 3923 - protein, 345 aa, Glycine max
MASSTITSSFLTSPPSSLFNKSSSPSFHATPTLRPLAPRASMSASAPPYDFGSFRFDPIRESIVSREMTRRYMIDMVTHADTDVVIVGAGSAGLSCAYELSKNPSINIAIVEQSVSPGGGAWLGGQLFSAMVVRKPAHLFLDELNVEYDEQDNYVVIKHAALFTSTIMSKLLARPNVKLFNAVAAEDLIVKNGRVGGVVTNWALVSLNHDTQSCMDPNVMEAKVVVSSCGHDGPFGATGVKRLKSIGLIDSVPGMKALDMNKAEDAIVRLTREVVPGMIVTGMEVAEIDGAPRMGPTFGAMMISGQKAAHLALRSLGLPNALDSVGNVHPELVLAAAESAEIAEA

SEQ ID NO: 3924 - protein, 97 aa, Hordeum vulgare
ATKKVKLVTPEGEVELEVPDDVYILDQAEEEGIDLPYSCRAGSCSSCAGKLVSGEIDQSDQSFLDDDQMEEGWVLTCAAYPKSDVVIETHKEEELTA

SEQ ID NO: 3925 - protein, 312 aa, Streptococcus mitis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYSLNLNFVQAALGDTVDIPTVHGDVELVIPEGTQTGKKFRLRGKGAPSLRGGAVGDQYVTVNVVTPTGLNERQKAA

SEQ ID NO: 3926 - protein, 349 aa, Glycine max
MASSTITSSFLTSHPSSLFNKSSSSSFPSFHATPTLRPHRPRASMSAAAPPPYDFGSFRFEPIRESIVSREMTRRYMTDMVTHADTDVVVVGAGSAGLSCAYELSKNPSVNIAIVEQSISPGGGAWLGGQLFSAMVVRKPAHLFLDELGLEYDEQDNYVVIKHAALFTSTIMSKLLARPNVKLFNAVAAEDLIVKNGRVGGVVTNWALVSMNHDTQSCMDPNVMEAKVVVSSCGHDGPFGATGVKRLKSIGLIDSVPGMKALDMNKAEDAIVELTREVVPGMIVTGMEVAEIDGAPRMGPTFGAMMISGQKAAHLALRSLGLPNALDSVGNVHPELVLAAAESAEIADA

SEQ ID NO: 3927 - protein, 533 aa, Unknown
  Gerbera hybrid cv. 'Terra Regina'
MENLRPKLAMAVKSIQWSYAIFWSISTVPGVLAWCDGYYNGDIKTRKTIQAEEINDDDNDDYEVGLQRTEQLRQLYESLSSASETHPYSYEQQTRRPAAALSPEDLTDTEWYFLVCMTFEFTKGQGLPGRTLAKNTASWLCNAHFADSKVFSRSLLAKSASIQTVVCFPYLEGIVEFGITEKVLEEQNIIKQIKASIFDTPSKRFLETPLESCSAMLDHDDLDMILECETIKNRNNSPKNSLNCSREQSLQFLDDEEDGDVSFFNNNSVGSSDCISQNLISGPNDLWSDDDSRYQCVLSTIFKNTRRLILGPHFTQCNGKESGFVSWKNDGMEWNVSSSQSLLKKVLYEVPKMYENGSGLAGFPGRVWKPEGDDVKNINHRFSVLGSLVPSRGKVLDKVSLLDDTIEYLKALEKRVEALQSTKDERERTSDNYANKRKASCNLEELRQDCPSDCITVSAIEKEVTIEIRCRWRDNMMVQVFDAMNSLNLESHSVHSSTVDGILSLSIESKSKGCTVSTAKMIRQALQRVIGRY

SEQ ID NO: 3928 - protein, 320 aa, Streptococcus mitis
DINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAA

SEQ ID NO: 3929 - protein, 112 aa, Synechococcus sp.
MKKIEAIIRPFKLDEVKIALVNAGIVGMTVSEVRGFGRQKGQTERYRGSEYTVEFLQKLKLEIVVEDAQVDTVIDKIVAAARPGEIGDGKIFVSPVDQTIRIRTGEKNADAI

SEQ ID NO: 3930 - protein, 319 aa, Streptococcus mitis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAAA

SEQ ID NO: 3931 - protein, 494 aa, Pseudomonas fluorescens
MLARCLAFSYPASTFLIFFLRRRLSHHLWHPTYPRVLNSVRPAFRLAPFVSQKDTDMTVEQPIQVDTLVVGAGQAGVAMSEHLSKLGVPHLVLERSRVAEAWRTGRWDSLVANGPAWHDRFPGMEFDVAADAFPAKDQVADYFEAYARKFNAPIRTGVEVRKVLRNVGRPGFTVETSEGLIQAQRVVAATGPFQRPVIPPIATANDRLTQIHSAEYRNPQQLPEGAVLVVGAGSSGVQIADELQRAGRRVYLSVGAHDRPPRSYRNRDFCWWLGVLGEWDAEIAKPGREHVTIAVSGARGGQTIDFRALAHQGITLVGLTKAFAGEHVTFQADLLDNLARGDENYLALLDAADAYIARNGLDLPLEPEARRRLPDPDCVKQPILELDLQQAGITSIIWATGYAVDFSWLQVDTFSEQGKPLHQRGVSREPGVYFLGLPWLSRRGSSFIWGVWHDAKHVADHIATQRKYQAYSDARPPAATAEAPALNLSPVGAH

SEQ ID NO: 3932 - protein, 320 aa, Streptococcus mitis
RYHKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREAGCRTCNGSGAKPGTSPVTCGRCHGAGVINVDTQTPLGMIRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAA

SEQ ID NO: 3933 - protein, 155 aa, Treponema denticola
  misc_feature (35)..(35): Xaa can be any naturally occurring amino acid
MGIYNYTVKDSLGNDFSFNDYKDYVILIVNTACEXGLTPHFQGLEALYKEYRDKKFLVAAFPCNQFGGQDPGTNEEIRNFAQSKYGVSFPIMAKIEVNGENTEPIFSFLKKASNGEDIKWNFAKFLVDKTGERVTAYAPTVAPEDLKKDIEKLLN

SEQ ID NO: 3934 - protein, 192 aa, Nicotiana tabacum
SPYDNNGGTCVAVAGADYCVIAADTRMSSGYNILTRDYSKIIKLADKCVLASSGFQADVKALQKVLAARHLIYQHQHNKQMSCPAMGQLLSNTLYYKRFFPYYSFNVLGGLDNEGKGCVFTYDAVGSYGRVGYSSQGSGSTLIMPFLDYQLKSPSPLLLPAKDAVTPLSESEAIDLVKTCFVSATERDIYTG

SEQ ID NO: 3935 - protein, 299 aa, Oryza sativa
MAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEEAERVWCPELARLIGETAEPFVNVIYDAEPLPGLSWAGGRVALVGDAAHPTTPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 3936 - protein, 177 aa, Buchnera aphidicola
MKHTIKVIISEKELDIRVRELGEEITKKYKNSKNKIILIALLRGSFVFIADLCRRIKIEHEIDFMTTSSYGRGMISTGDVKIIKDLDEDIYNKNVLIVEDIIDSGKTLSKVLGILKLRNPKSLSICTLLDKPECREVNINIDFVGFSIPDEFMVGYGIDYAQSYRYLPYIGKVIFKK

SEQ ID NO: 3937 - protein, 381 aa, Hevea brasiliensis
MQIFVKTLTGKTITLEVESSDTIDNVKAKIQDKEGIPPDQQRLIFAGKQLEDGRTLADYNIQKESTLHLVLRLRGGMQIFVKTLTGKTITLGVESSDTIDNVKAKIQDKEGIPPDQQRFIFAGKQLEDGRTLADYNIQKESTLHLVLRLRGGMQIFVKTLTGKTITLEVESSDTIDNVKAKIQDKEGIPPDQQRLIFAGSSLRMVAPLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 3938 - protein, 105 aa, Rhodopirellula baltica
MPDAIMKQVVTVVSPHLAENVLAALRRAPLEGLSVMEVKGYGRQKSYLDQYQDTEYSEAFVPKVEITLWVDDLRLEEVLDKIVAVTRTGRIGDGKILVMPVASFI

SEQ ID NO: 3939 - protein, 356 aa, Camellia sinensis
MSLLSDLINLNLSDTTEKVIAEYIWIGGSGMDLRSKARTLSGPVSDPKKLPKWNYDGSSTGQAPGEDSEVIIYPQAIFKDPFRRGNNILVMCDTYTPGGEPIPTNKRFNAAKIFSHPDVVAEEPWYGIEQEYTLLQKQVKWPLGWPLGGFPGPQGPYYCGIGVDKAYGRDIVDSHYKACLYAGVNISGINGEVMPGQWEFQVGPSVGISAGDELWVARYILERITEIAGVVVSFDPKPIEGDWNGAGAHTNYSTKSTRSDGGFEVIKKAIEKLGLRHKEHIAAYGEGNERRLTGRHETADINTFLWGVANRGASIRVGRDTEKAGKGYFEDRRPASNMDPYVVTSMIAETTLLWKP

SEQ ID NO: 3940 - protein, 373 aa, Campylobacter jejuni
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 3941 - protein, 209 aa, Arabidopsis thaliana
  misc_feature (188)..(188): Xaa can be any naturally occurring amino acid
  misc_feature (198)..(198): Xaa can be any naturally occurring amino acid
MGRRPARCYRYCKNKPYPKSRFCRGVPDPKIRIFDLGKKKAPVDDFPLCVHLVSDELEQLSSEALEAGRICCNKYLVKNCGKDQFHIRMRLHPFHVIRINKMLSCAGADRLQTGMRGAFGKPLGTVARVRIGQPIMSVRSNDRYKAQVIEALRRAKFKFPGRQKIYVSKRWGFTKYDREDYEKLKADXTLTNDGVNVXYMPQHGPLAAW

SEQ ID NO: 3942 - protein, 175 aa, Saccharomyces cerevisiae
GSSHCRFYENKYPEIDDIVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEELYKTIAWPLSRKFGHAYEAFKLSIIDETVWEGIEPPSKDVLDELKNYISKR

SEQ ID NO: 3943 - protein, 434 aa, Schizosaccharomyces pombe
MVYIKCRYVCFCCAFISNTTSKSIFNELRCPVTLTFLQFGFVAFFSAVCLLFRKQFLGGTGIQKPSKYVLYTTLPLSIFQIGGHVFGSLATTKIPVSTVHTVKALSPLFTVLAYRFMFRHVYSAMTYFSLVPLTFGVTLACSFELSADIVGLLYALISTCIFVSQNIFGSKIFMEAKSHSTHTKKHYNKLNLLLYSSGVAFIVMIPVWLYQEGFAYLPEVGSPVFLNLIYNGLSHFFQNILAFTLLSIISPVAYSIASLIKRIFVIVVSIIWFQQATNFTQGSGIFLTAIGLWLYDRSKKGNLYESCKVKEFEKDALELEEQTMEDEKSYPSSGTQSPFYGKNFLPQITPRLDSVVPLISDSPMTPNSVYSNEGVTSSVSGNATPASVRQSTQNDFSNSNIHDRRSSYTFQLNNFKAPQPSRLWATETVPTLKI

SEQ ID NO: 3944 - protein, 319 aa, Idiomarina loihiensis
MAEAKHCKLLILGSGPAGYTAAVYAARANLNPVMVTGMQQGGQLTTTTDVENWPGDAEGLTGPDLMVRMQKHAERFDTEIVFDHISSVDFSKRPFQLKGDVGEYTADSVIISTGASAKYLGLDSEEAFMGKGVSACATCDGFFYKKQKVCVVGGGNTAVEEALYLSNIASEVHVIHRRDTFRAEKILVDRLHEKEQNGNVTFHLNKTLDEVLGDDAGVTGVRIKDTQDGSTEELEVAGCFIAIGHQPNTGIFDGELEMQDGYIQVQSGLQGNATATSVPGVFAAGDVMDHIYRQAITSAGTGCMAALDAERYLDALTKS

SEQ ID NO: 3945 - protein, 306 aa, Unknown
  Mycobacterium sp. MCS
MSANTKWTAADVPDQEGRVAVITGANTGIGYEAAAVLAAKGAHVVLAVRNTDKGGAAAERIRSALPHADVTVRELDLTSLDSIREAADGLRADYPRIDLLINNAGVMMTEKGATKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVAQTPEMGALPTLRAATDPDVRGGQYYGPDGIGEQRGHPKLVQSNARSYDEAAQRRLWSVSEELTGVTFPV

SEQ ID NO: 3946 - protein, 93 aa, Medicago truncatula
MGFHLPAAIVRASFRSSQTSLKVTNVPKSYLAVYFGEEMKRFVIPMSYLNQTSFQDLLSQAEEEFGYDHPMGGLTIPCTEGVFLRVTSRFNGI

SEQ ID NO: 3947 - protein, 337 aa, Streptococcus pyogenes
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKDGKGGLAVGIHNEELVESPILGTAEEGALFSLTEEGKIIVNNPHKARLDFAALNRSLSQ

SEQ ID NO: 3948 - protein, 92 aa, Medicago truncatula
MGFRLPGIRRSSFTAGQSSSKQMEVPKGYLAVYVGEEMKRFLIPVAFLNEPLFQELLSQAEEEFGYCHQMGGLTIPCKEDVFLRTTSRLNGL

SEQ ID NO: 3949 - protein, 92 aa, Medicago truncatula
MGFRLSAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 3950 - protein, 92 aa, Medicago truncatula
MGFRLPGIRRSSFSASQSSSKQVEVPKGHLAVYVGEKMRRFMIPISFLNEPLFQELLSQAEEEFGYCHPMGGLTIPCKEDMFLHTASVLNRI

SEQ ID NO: 3951 - protein, 474 aa, Alteromonadales bacterium
MQYLPIFTKLDNKPVLVVGGGEVALRKCRAFLKARAAVTLVAPWFCDELKEHAQHNEVTLIDAYFDESHLDGKMLVIAATDRDEVNNTVFELANARNVFVNVVDDQPKCTFIFPSIVDRNPITIAISSAGTAPVLARRLREKLETLIPQHIGPLATLVGGFRDKVKQRFKHFSDRRQFWEGVFDSSVVSKVQTGDTQGAEQQLEQMLDAKAEPEGEVYVVGAGPGDPELLTLKALQLMQQADVVVYDFLVSDEIMELVRRDADLICVGKRLGDHSVVQEDTNQMLVDLAKQGKKVCRIKGGDPFIYGRGGEEVQVLAANKVNYQIVPGITAAAGCSAYAGIPLTHRDHAQAIQFVTGHCKKDGQELDWQSLAKPNQTLAIYMGVIKSPHIQAELLQHGRKADTPVAVIENGTRKNQRVVTGQLGELADLIERNSIVSPALLIIGEVAALHSQLAWFGQNNQTSSYAQPLTDIAH

SEQ ID NO: 3952 - protein, 92 aa, Medicago truncatula
MGFRLPAAIRRASFSSSQTSKVLNVPKGYLAVYVGEQMKRFVVPMPYLNQASFQNLLSQAEEEFGYDHPMGGLTIPCTEYVFLHITSHFNGL

SEQ ID NO: 3953 - protein, 440 aa, Dechloromonas aromatica
MPMSTSCPHQPYCEMREQTDMRFISHLTRNTFAIILAGGRGTRLKQLTDFRSKPAVPFAGKFRILDFTLSNCVNSGIRKIGVATQYKAHSLIRHIQRGWSFLDGRFDEFIQLLPAQQQIDETQWYQGTADAVYQNLHFLRRYQPDHILVVAGDHIYKMDYGRMLAHHVKHHADMTVACIDVPLDEAREFGVMGVDEQDRVIDFVEKPQNPPAIPGQPDRALASMGIYIFNTKFLFEQLERDAMTKGSNRDFGKDIIPYIVPRYRVFAHRFADSCVGSDNHRPYWRDVGTIDAYWEANMEMTKVTPELNVYDRDWPIWTYQEQIPPAKFVFDDEDRRGTAVDSLIAGGCIISGASVKRSLLFSSVNVHSWASVEDSVVLPDVDIGRHAVLKRCVIDKHCRIPEGMVIGVDPEEDRKRFHVSPKGITLVTAEMLGQGAAEGR

SEQ ID NO: 3954 - protein, 344 aa, Idiomarina loihiensis
MSSVNTINRIAIITSGGDAPGMNAALRAVVLAAENYGIEVMGFRHGYEGLLTNDFVKLDREDVEHILQYSGTIIKSARSERFKSEEGGREAATNLDAHQIDAFIVIGGDGSFRGAEHLANFWKGPIIGIPGTIDNDLFGTDNTIGYDTAVETAMDALDKIRDTAEAMDRVFIVEVMGRNAGYIGISSAMACGAERMILPELQKDKPLTVDALVKHIESVQRVRGDSSYVMVLCENQWPGGAVRLAEQLEDRLNLPCRPCLLGHVQRGGRPTAMDRILGTRLGVHAVELVRQGKTAVMAGVTANELSETPLIDTWTKRKKLSEELINIQQSLFNPIKKDRNKSTQ

SEQ ID NO: 3955 - protein, 99 aa, Medicago truncatula
MGFRLPAIRRSSFSASQSSNKQVEVPKGHLAVYVGEKMRRFMIPISFLNEPLFQELLSQAEEEFGYCHPMGGLTIPCKEDNVVKITITRTFRALQMDLS

SEQ ID NO: 3956 - protein, 318 aa, Streptococcus mitis
DINKEPGAEEKYKEVQEAYETLSDDQKRAAYDQYGAAGANGGFGGAGGFGGFNGAGGFGGFEDIFSSFFGGGGASRNPNAPRQRDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVESSDKFEREGTTIFYNLNLNFVQAALGDTVDIPTVHGDVELVIPEGTQTGKKFRLRGKGAPSLRGGAVGDQYVTVNVVTPTGLNDRQKAALKEF

SEQ ID NO: 3957 - protein, 380 aa, Mesembryanthemum crystallinum
MDSSDSGEELRPSPPESESESWTSSSVMFSGEDSRSSIGDTSATSSGSSGEIPEAMVVGVRPPAPEISGETPARERCVGRPDRVSWGSTSVIGRRAEMEDAIAVAPEFISPTCGHVGGCTAPDSRSSGHALPLHFFGVYDGHGGSQVAGFCAQRMHEIIAEEWNQEGIDAYEWQKRWKEAFISGFKRADDQITTEVIASEMVGSTAVVAVVSGCQIILSNCGDSRAVLCRRTQTIPLTVDHKPDREDELLRIEGQGGRVINWNGARVFGVLAMSRAIGDRYMSPFIIPVPEVTFTTRSDEDECLILASDGLWDVISNDEAGEVARRLLRRRRRAMVAGDICPAQVVADKLTQLAIGRNSSDNISVIVVDLKSRRRHQATQ

SEQ ID NO: 3958 - protein, 394 aa, Unknown
  Sulfitobacter sp. EE-36
MKVIENVKRRHFLIGSAGTMAAVAVGAPALAQSGGEPLPDYVAWKDAEDMIVHSKQTLETKRAAQGSELITPTTELYIRNNLPAPSDKIVADRDAWEVEIDGVANPGKMTVGALKTLGVETVVCVLQCSGNGRAFFDHETSGSQWSVGAAGNVVWTGVPVRAVIDAMGGADADAVYLTGTGGEDIPQGLPPESIQVERSVPKAAMDRAILAWEMNGEPVPLAHGGPLRLIIPGYYGVNNIKYLKRLALTVEESPNKIQQTGYRVRPVGEKGDPSQPSMYEMSVKSWITGPLVDAATGKVQIHGVAMGGVSGLEKVEVSTDGGQNWADAQFLGPDLGPYAWRPFVLITDLTEGTHMLASRATNAAGDAQPENFPPNERGYGNNGWRAHAVDVTVS

SEQ ID NO: 3959 - protein, 92 aa, Medicago truncatula
MGFRLPGIRRSSFSASQSSIKQVEVPKGYLAVYVGEKMRRFMIPVSFLNEPLFQELLSQSEEEFGYCHPMGGLTIPCKEDMFLHTTSVLNRL

SEQ ID NO: 3960 - protein, 318 aa, Streptococcus mitis
DINKEPGAEEKYKEVQEAYETLSDDQKRAAYDQYGAAGANGGFGGAGGFGGFNGAGGFGGFEDIFSSFFGGGGASRNPNAPRQGDDLQYRVNLTFEEAIFGAEKEVKYNREASCHTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEF

SEQ ID NO: 3961 - protein, 92 aa, Medicago truncatula
MGFHLPAIRRTSFTSSQASSKAVNVPKGYLAVYVGEQMKRFVIPMSYLNQASFQNLLSQAEEEFGYDHPMGGLTIPCTEDIFMEITSRFNGL

SEQ ID NO: 3962 - protein, 281 aa, Chlamydia muridarum
MVLSCELTLKELLESGAHFGHQTSRWNPKMKPFIFEEKNGLYIIDLAKTLAQLKKAVSCIQKTVEQGKSILFVGTKKQAKQIIKEAAIECGEFFASERWLGGMLTNMATIRNSVKTLNNIEIDLASSNSVLTKKETALLAKRHRKLLNNLEGVRHMNSLPGLLVVIDPGYERIAVAEAGKLGIPVMALVDTNCDPTPINHVIPCNDDSIKSIRLIVNALKDAIIDTKKRSGFEILSPVRPIERPAEEIVEGLPLPNEAQNDANSKEGFLVWTDTDNSEALR

SEQ ID NO: 3963 - protein, 159 aa, Clostridium acetobutylicum
MSVYDFKAKDISGEEISLSKYEGKVLLIVNTASKCGFTPQYKELEDIYKKLGNEKFEILGFPCNQFANQEPGGSGDIKNFCEINYGVTFPLFEKIDVKGENAHPLFKYLASQAGGILGKEIKWNFTKFLIDKKGDVVDRFAPVTKPSKIKDKIVKLMEE

SEQ ID NO: 3964 - protein, 92 aa, Medicago truncatula
MGFRLPAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 3965 - protein, 322 aa, Streptococcus oralis
PDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLHIVQATLGDTVEIPTVHGDVELVIPEGTQTGKKFRLRGKGAPSLRGGAVGDQYVTVNVVTPTGLNDRQKAALKEFAAA

SEQ ID NO: 3966 - protein, 181 aa, Clostridium acetobutylicum
MSIYDFKVKDINGEDISMEEYRGKALLIVNTASKCGFTPQYEDLEALYKKFKGENFEVLGFPCNQFENQEPGTNNDIKKFCQINYGVTFKIFDKVDVNGENEAPLYRYLKEQAPFKELDESTPTAKIIAAFLREKLPETLIGDSIKWNFTKFLIDKNGRVVNRFESGVEPMEIESYIKALI

SEQ ID NO: 3967 - protein, 388 aa, Medicago truncatula
MGKREKQKQKHDRSQRGRDYYLQDNNEDDTSTMLSPSHNEDEDEIEDAADSDADNNDNNDQHPSHDMPSKFLLYQQSVQSPKGDISYLQKFFLMYVGGRVPLHLQEDFCGTALLSAEWLRSDPRKTAVGLDLDLEALNWCLENNIPKIGADGFSRISLFHGNVLQPLQSKLVKIDPEELVRNISLSQNTENLQTDVIESDVPTSSAAQDDELTMNNFTLSGRDIVCAFNYSCCCLHKRAELVLYFKHARDALSKKGGIFVMDLYGGTSSENTLKLQRRFPNFTYVWEQAEFDIIQRKTRISLHFHLKKEKRKIRHAFSYSWRLWTLPEIRDCLEEAGFRAVHFWVREMPDSTEITRTEGFGVGKDIKYEEATSFQQQDSWNAYIVGVA

SEQ ID NO: 3968 - protein, 321 aa, Streptococcus oralis
QIQQEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 3969 - protein, 1057 aa, Pseudomonas aeruginosa
MKRMLINATQPEELRVALVDGQRLFDLDIESGAREQKKANIYKGRITRVEPSLEAAFVDFGAERHGFLPLKEISREYFKKSPEGRINIKEVLSEGQEVIVQVEKEERGNKGAALTTFISLAGRYLVLMPNNPRAGGISRRIEGEERNELREALNGLNAPADMGLIVRTAGLGRSTEELQWDLDYLLQLWSAIKEASGERGAPFLIYQESNVIIRAIRDYLRQDIGEVLIDSIDAQEEALNFIRQVMPQYASKVKLYQDSVPLFNRFQIESQIETAFQREVKLPSGGSIVIDPTEALVSIDINSARATKGGDIEETALQTNLEAAEEIARQLRLRDIGGLIVIDFIDMTPAKNQRAVEERVREALEADRARVQVGRISRFGLLEMSRQRLRPSLGETSGIVCPRCNGQGIIRDVESLSLAILRLIEEEALKDRTAEVRARVPFQVAAFLLNEKRNAITKIELRTRARIFILPDDHLETPHFEVQRLRDDSPELVAGQTSYEMATVEHEEAQPVSSTRTLVRQEAAVKTVAPQQPAPQHTEAPVEPAKPMPEPSLFQGLVKSLVGLFAGKDQPAAKPAETSKPAAERQTRQDERRNGRQQNRRRDGRDGNRRDEERKPREERAERQPREERAERPNREERSERRREERAERPAREERQPREGREERAERTPREERQPREGREGREERSERRREERAERPAREERQPREGREERAERPAREERQPREDRQARDAAALEAEALPNDESLEQDEQDDTDGERPRRRSRGQRRRSNRRERQREVSGELEGSEATDNAAAPLNTVAAAAAAGIAVASEAVEANVEQAPATTSEAASETTASDETDAPTSEAVETQGADSEANAGETADIEAPVTVSVVRDEADQSTLLVAQVTEEAPFASESVESREDAESAVQPATEAAEEVAAPAPVEVAAPSEPAATEEPTPAIAAVPANATGRALNDPREKRRLQREAERLAREAAAAAEAAAQAAPAVEETPAVASEEASAQEEPAAPQAEEIAQADVPSQADEAQEAVQAEPEASGEDAADTEHAKKTEESETSRPHA

SEQ ID NO: 3970 - protein, 368 aa, Zea mays
  misc_feature (356)..(356): Xaa can be any naturally occurring amino acid
MAVLSAAGAPPASAIGFEGYEKRLEITFSEAPVFVDPHGSGLRALSRSQIDSVLDLARKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEEXDAIEEKDGVLDE

SEQ ID NO: 3971 - protein, 313 aa, Streptococcus oralis
INKEPGAEEKYKEVQEAYETLSDDQKRAAYDQYGAAGANGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKESQL

SEQ ID NO: 3972 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKIKALHKYDCLRANKSTFAWGLEARVPFLDKDFIRVAMNIDPEYKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLSVPGGPSVACSTAKAVEWDAAWSNNLDPSGRAALGVHASAYGNQVKAVEPEKIIPKMEVSPLGVAI

SEQ ID NO: 3973 - protein, 356 aa, Camellia sinensis
MAQLSDLINMNLSDSTEKIIAEYIWIGGTGLDLRSKARTLSGPVNDPKKLPKWNYDGSSTGQAPGEDSEVIIYPQAIFKDPFRKGNNILVMCDAYTPAGEPIPTNKRYNAEKIFSHTDVVAEEPWYGIEQEYTLLQKDVKWPIGWPKGGYPGPQGPYYCGAGADKAFGRDIVDSHYKACLYAGINISGINGEVMPGQWEFQVGPAVGISAGDELWVARYILERITEIAGVVVSFDPKPIEGDWNGAGAHTNYSTKSMRKDGGYQVIKKAIEKLGLKHKEHIAAYGEGNERRLTGRHETADINTFLWGVANRGASVRVGRDTEKAGKGYFEDRRPASNMDPYVVTSMIAATTILWKP

SEQ ID NO: 3974 - protein, 158 aa, Glycine max
AASVVTETEITELKVNVEKELVSQAEEEDMEALLGTYVMGIGEAEEFSERLKRELQALEAANVHALLESEPLMDEVLQGLDAATSCVEDMDEWLSIFNVKLRHMREDIASVRTCARQFKNINFLDTIYSLVVMAVFAGSMIHMFSFLCSFVKARQFMH

SEQ ID NO: 3975 - protein, 467 aa, Vibrio vulnificus
MNSTNLKLLSLFVLGSVLWFLPVPDGLTEQAWQMMVIFVTTVLSLILAPLPLGAMALLGLTAATLLGVLPIKTALNGFAHPTIWMIAAAFFISRGFITTGFGRRVGYWFISKLGHNSLGLAYGLVLTDLLFAPATPSTTARCGGIIAPLFRSVASAYDSDPEKGTQNRIGAFLVQCIFQCNAITCAMFLTSMAGNPLAANFAKEQGVEITWAGWAAAAIVPGLLCLFLIPLAMYLFFPPELKKTPEMRAIAKEKLQQMGAMTRDEIMVCATFIGMVTLWVLGPTLGIHATVTALIGLVFLLLSRTITWDAVLSEKEAWHTITWFAVLIMMASELNKLGFIKWFSNGIGESLSGFGWATTIILLLLVYYYSHYLMASAMAHISAMYSAFLAIAISAGVPPMLAAIVLGIFSNLYMSTTHYSSGPAPILFGAGFHSLQNWWKIGFVFSLIVIPIFIFVGGMWWKVLGLW

SEQ ID NO: 3976 - protein, 497 aa, Capsicum annuum
MAHAFNMLILCYTFFLLLDLSHNFAFAFTSQDYSNALEKSILFFEGQRSGKLPANQRVKWRGNSGLSDGSGSHVNLVGGYYDAGDNVKFGLPMAFTTTLLAWSVIEFGSSMHSQLGHAKEAIRWSTDYLLKAATASPDTLYVQVGDPNQDHRCWERPEDMDTPRNVYKVSPQNPGSDVAAETAAALAAASIVFKDSDPSYSSTLLHTAQKVFAFADKYRGSYSDSLSSVVCPFYCSYSGYNDELLWGASWLHRASQDTSYLSYIQSNGQTMGANDDDYSFSWDDKRPGTKIVLSKDFLEKSTQEFQAYKVHSDNYICSLIPGSPSFQAQYTPGGLLFKGSESNLQYVTSSSFLLLTYAKYLRSNGGVVSCGSSRFPANKLVELARKQVDYILGDNPAKISYMVGFGQKYPLRVHHRGSSLPSVRTHPGHIGCNDGFQSLYSGSPNPNVLVGAIVGGPDSRDNFEDDRNNYQQSEPATYINAPLVGALAFLSAESTAV

SEQ ID NO: 3977 - protein, 443 aa, Burkholderia vietnamiensis
MLTHQENELLCRVEGDAPMGQLMRRHWTPVCLIEEVSEPDGAPVKARVFGEDLVVFRDSEGNVGVLDEYCPHRRASLVYGRNEDSGLRCLYHGWKFDVAGNVLEMVSEPAASSMTDKVKHKAYPVQEWGGMVWAYMGPQDAIPEFVPPAWAPTADTRVSIAKALLPCNWAQILEGAIDSAHSSSLHSSDFVPARVGGAEATDKNWLRPSTDKAPRLQVERTDYGFRYAALRRPIFNANTHDYVRCTVFVAPGTVLIPPNNLYNVANINVPMDDTNTAFYFIAWGDPETTPENETWRKFLRQQVGVDLDQYYRPLRNHDNRFWQDRQAMKAGNFTGISGFPNQDIAMWVTMGPIANRSDERLGGSDLAIVEFRRRMLDAITEFQQGDGTIGTGAKAIPREVCSYQAVVPKEIDWRTYAARYVSKKNPEPADQPSALATDYQVKQ

SEQ ID NO: 3978 - protein, 286 aa, Buchnera aphidicola
MINEKIWHEKLHRHVGQYFSIDKILYQKKNKYHDIIIFQNSIMGRIMAIDGVVQTTEKDEFIYHEMLTHVPIFYHGLIKNVLIVGGGDGGILREICRHKSIENITMVEIDLNIIDLCKQFFPKHNNNAYKDPRLKIVIDNGLNFVQKTKEKFDLIISDSTDPIGCGKDLFLSDFYFHCKNCLVKNGIFVGQNGVFFLQKNDINQSYKNLKKNFHDVSFYQATIPSYYGGTMMFSWGTDNIDFRQINIKNLEKRIKDKKLTFNYYNSNIHISSFYLPQYIINTLDKS

SEQ ID NO: 3979 - protein, 489 aa, Desulfitobacterium hafniense
MNTIHTPKTKRVLTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 3980 - protein, 924 aa, Oceanicola granulosus
MSETISFTLDGRAVDAAPGETIWQVAKRVGTTIPHLCHKDAPGYRSDGNCRACMVAVDGERNLVASCIRTPVEGMTVTTDGAREVQTRKLVMELLLADQPEQPAAHDRSAHLWEMADAQGLAESRFPAMDADHVPLLDDSHVAMRVNLDACIQCGLCVRACREVQVNDVIGMAGRGHQAFPVFDLDDPMGDSTCVACGECVQACPTGALMPASVLNEVQEGDSQDYDREVESVCPFCGVGCQVSLKVKDDRIVYVDGIDGPANEGRLCVKGRFGFDYVHHPHRLTKPLIRRDDAPAKGLNVDPANPLSHFREASWEEALDAAAGGLARLRETRGGAAVAGFGSAKCTNEEAYLFQKLIRQGFGHNNVDHCTRLCHASSVAALMENVGSGAVTATFNQIEHADVAIIIGANPVENHPVAATYFKQFAKRGGKLIVMDPRGVGLRKFASHMLQFRPGADVSLLNAIMHVIVDEGLYDEQYIQAYTENWEAEKAHLAGFAPEDMAGICGIDAEVIRDVARTFATAERGMIFWGMGVSQHIHGTDNSRCLISLALMCGHVGRPGTGLHPLRGQNNVQGASDAGLIPMFLPDYQPVGDDGVRSAFAEIWGGAEFSAEKGLTVTEIMDAVHDDRIAGMYILGENPAMSDPDVDHARAALAKLEHLVVQDIFLTETANYADVILPASAFAEKTGTVTNTNRQVQMGRPALPPPGEAREDWAITVDLARRLGLDWSYSHPSEVFDEMARTMKSLANITWERLEGEAVTYPSLSPDDPGQPIVFGDGFPRAGGRAKFTPAAVIPPDETPDAEYPMILTTGRQLEHWHTGSMTRRSKVLDAVEPEANCSLHPSTLRKLGVAAGEMVRLTTRRGSIELMAREDRAVAPDMVFVPFAYVEAAANVLTNPAIDPYGKIPEFKFAAVRIEKGSALAAE

SEQ ID NO: 3981 - protein, 464 aa, Triticum aestivum
MASEGEHAAAGEQTPLKKAGEAEQGEELQAPSGWTKKLNPTRGGKFEVVFVAPTGEEVKTKRALTTYLKAHPGGPALSEFVWATGNTPRRSSRLSAKPKATESPEDEKPSRRSGKSKATESPEDEKPAKRGRPSSSKKGKKGKQEDAEDAEAESGDHADAEEAKGTEVEMKDAEEAKVTDLDLEMKEADSAQEEKKEEEAGSSVGEKKETDTVAQEEKKAADTVAQEEKKAADTVAQEEKKAADTVAQEEKKAADTVAQEEKKAADTVAQEEKIDAPVADAPEKTEEVEGKATESEVAPVEAEMSDPVTENKENEKPAEFEEVPVEFEMSDLVSENKENEKPAESEEVPVEFEMSAPVLEEHKEDEKAAEYEVAPVEGEKSENGMAVESTVPPPASSEEKKVEADSTINPATPPPVEVKADAPAAEAAKATENPADNTVPEEQSAVNVDNNGQIHPGVSPVRCI

SEQ ID NO: 3982 - protein, 72 aa, Idiomarina loihiensis
MAKEDSIEMQGTVLDTLPNTMFRVELENGHVVTAHISGKMRKHYIRILTGDTVTVQLTPYDLTKGRIVFRAR

SEQ ID NO: 3983 - protein, 602 aa, Stylosanthes guianensis
MAATSNTWINTKLPSSCSSLKGASCSPQTPSSFTMRSSNKRRTNCNTIKCSLQTLHFPKQLQPTTTTTTTTKPSTKSIPTKENKTANDWNLIQKAASMAIDFAESALASHERKHPLPKTADPRVQIAGNFAPVPEHPVTQNLPIAGKLPECIDGVYVRNGANPMYEPLAGHHLFDGDGMVHALKFHNGSASYSCRFTETNRLVQEKSLGKPVFPKAIGELHGHSGIARLLLFYARGLFGLVDGKNGMGVANAGLVYFNNHLLAMSEDDLPYHVRVTPSGDLKTVGRYDFNGQLKSTMIAHPKVDPVSGELFALSYDVVSKPYLKYFKFNKDGTKSKDVEIPLKVPTMMHDFAITENFVVVPDQQVVFKLGEMMKGGSPVVYDKEKVSRFGILDKNATDSDGIRWIEAPECFCFHLWNAWEEKETDEVVVIGSCMTPADSIFNECDENLKSVLSEIRLNLKTGKSTRRAIIREEEQVNLEAGMVNKNKLGRKSQFAYLALAEPWPKVSGFAKVDLSTGEVKKYIYGDEKFGGEPMFLPRSPSSDREDDGYILAFVHDEKEWKSELQVVNAMTLELEATIELPSRVPYGFHGTFIQSKDLRKQA

SEQ ID NO: 3984 - protein, 251 aa, Triticum aestivum
RNSARGAAGLSRECRRRLETLVGRMLDQATLDDLLVSGDGGGVYDVSLVMRLVRVFASSVEEDGSPSSSQRMRKAGKLVDKYLAEISPDQGLRVSRFLAVAESLPDSARDCYDGVYRALDIYLESHAELTVEERATLCRCLNYEKLTLEACRDLARNRRIPPRIAVQALSLQRPPNSLQSPLSSPTPKRVVPDDDEKEKETLRLNLRLMQGRVAELEMVCKEMRGKARLSPRVAAAKGNKALGGRGLPWMC

SEQ ID NO: 3985 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 3986 - protein, 359 aa, Brassica napus
  misc_feature (119)..(119): Xaa can be any naturally occurring amino acid
  misc_feature (143)..(143): Xaa can be any naturally occurring amino acid
MSALADLINLDLSDSSEKIIAEYIWIGGSGLDMRSKARTLPGPVKDPSELPKWNYDGSSTGQAPGDDSEVIIYPQAIFKDPFRRGNNILVMCDAYTPAGEPIPTNKRACGRPKIFSDPXVARRKETWYGIEQEYTLLQKDTKXGPVGWPPRGFPGPHGPYYCGVGADKAFGRDIVDAHYKACLYAGINVSGTNGEVMPGQWEFQVGPTVGIAAADQVWVARYILERITELAGVVLSLDPKPIPGDWNGAGAHTNYSTKSMREDGGYEIIKKAIEKLGLRHKEHIAAYGEGNERRLTGKHETADINTFLWGVANRGASIRVGRDTEKDGKGYFEDRRPASNMDPYTVTSMVAETTILWKP

SEQ ID NO: 3987 - protein, 340 aa, Ammopiptanthus mongolicus
MAAENDVVSSDLHVKRQRDEEENGVSVSTVSMDMEGCKDSVHNGISSVIPGWFSEISPMWPGEAHSLKVEKILFQGKSEYQNVLVFQSSTYGKVLVLDGVIQLTERDECAYQEMITHLPLCSIPNPKKVLVIGGGDGGVLREVSRHSSVEKIDICEIDKMVVDVSKQFFPHVAVGFEDPRVNLHIGDGVAFLKAAPEGTYDAVIVDSSDPIGPAQELFEKPFFESVARALRPGGVVCTQAESIWLHMDIIEDIVANCRQIFKGSVNYAWTTVPTYPSGMIGFMLCSTEGPPVDFKHSVNPIDENECQKSVRPLKFYNSEIHTAAFCLPSFAKRKIGFINN

SEQ ID NO: 3988 - protein, 465 aa, Arabidopsis thaliana
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGFQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 3989 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACERLHGLSLIDASATPPLDGWSQRFAAHPAAKRVLPD

SEQ ID NO: 3990 - protein, 951 aa, Brucella melitensis
MQHVAGENPRAQTTALAMSATAFTVCFAVWTIFAIIGIEIRSELGLTETQFGLLVSTPILTGSLIRVILGIWVDRYGGRAIFTLTMLVSAVATYLLTYATTYPQMLLAALGVGVAGGSFSVGVAYVSRWYPPEKQGVALGIFGAGNVGAAVTKFFAPMVMVAFGWHTVAEVWAAAMVVMALVFYFTTNDDPVLVERRRKGEKPTSTLMELEPLKNIQVWRFSLYYFFVFGAFVALSLWLPQYLIHVYGVDIRFAGIIAAFFSIPASLFRAYGGHLSDVYGARRVMYWTFAVSLVATFILSYPPTDYVIQSDNGPLAFHAEMGVIGFTVTVFILGFFMALGKAAVFKHIPVYYPGNVGAVGGLVGMIGGLGGFILPILFGVLLDQTGLWTSCFMLLFVIVVVSFVWMHVSIRQMEHAAEGKATEELPAFAELQGLKKAEVKPATGESVLTDWRPDDPAFWEQKGRRIAKRNLWLSIPALLLSFAIWQVWSVVVAKLPLVGYQFTTDQLFWLAALPGISGATLRIFYSFMVPIFGGRLWTTLTTWSLVIPAIGIGYAVQNPDTPYFIFLLLALFCGFGGGNFASSMSNISFFFPKTEKGNAAALNAGLGNLGVSVVQFVVPLVITAGIFGKLGGNPAMVATAAGEAPLWLQNAGFIFVPFIIVTAFANWFGMNDIASAKASFADQAVIFRRRHNWIMCWLYTGTFGSFIGYSAGFPLLTNILFPEVNALQFAFLGPLVGALSRSGSGWLADKYGGGRVTIWAFILMMVGVAGVLYFVGIKDEPNAFWGFFAAFILLFFATGIGNASTFQMIPAIMAKDMERLMPMASAEERRRQADKESAAITGFTSAIAAFGAFFIPKGYGTSISLTGGPEMALWAFLIFYVTCLIITWGVYTRKGGLLDCSTTSSAASSRPQPPLEEKLRGYNHESTPRPPELPGTQECRHLLGRARRHHQ

SEQ ID NO: 3991 - protein, 300 aa, Unknown
  Mycobacterium sp. MCS
MTKWTTADIPSQSGRTAVVTGANTGLGLETAKALAARGAHVVLAVRDTEKGKRAADEITAAHPEAAVGVQSLDLGSLRSVRTAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPPVFNPLVGVLTQSPTMGALPTLRAATDPTVRGGQYFGPSGLGEIRGYPELVTSSAQSRDVDLARRLWTVSEELTGVAFPL

SEQ ID NO: 3992 - protein, 415 aa, Leptospira interrogans
MQFLPKADPEIFAALKKEDERQENNLEMIASENFVSRAVLEAYTSTLTNKYAEGYPGKRYYNGCHNADVVETLAIERAKKLFGSQYANVQPHSGAQANMAVFLACLEPGDSFLGMNLAHGGHLTHGSPVNVSGKIYKPIPYGVDSKTETINYDEVAKLAREHKPKLIVAGASAYARTIDFSKFAEIAKEVGAKLMADIAHISGLVATGYHPSPIGMFDFVTTTTHKTLRGPRGGLILSTLENEKVLNSRVFPGIQGGPLMHVIAAKAVAFQEALQPDYKKYIETVLANAKTLAEVFVKRGYRVVSGGTDNHLVLLDVSVKGLTGAQAADGLDEVGVTVNKNAIPFDKNPPAVASGIRLGTPALTTRGLKPADMETVGNLICDFLDHPNDDKNRTKVKGGIQEMTQKFPMNQFRLD

SEQ ID NO: 3993 - protein, 325 aa, Brassica napus
  misc_feature (248)..(249): Xaa can be any naturally occurring amino acid
VDPRVRADVEDIPRVSSKEAIDFMGASFRRNGQSHREESVAKYDTSRIELDLSLRRPDACENQPSLHPSSASAFTRYVHRPLQTQCSVSPLVTDQRKNVAASGGDDNNTVLINQYNVSEPPPSAQRRNEASFYNSSDSPGPPFSNQMNSWPGQGSYPTPAPIIHFPGPNAAHTSTMAPASVSPSPSSVSPHEYSSMFHPFNGKPEGLQERDGSMDMEERRHVSSATDSGTGNHCSTNYIDYHQQQQQXXEKRSEEGYSSSVGKLQQSLQREAALNKFRMKRKERCFEKKVRYESRKKLAEQRPRIKGQFVRQVQSTDTSTQEAPQ

SEQ ID NO: 3994 - protein, 92 aa, Medicago truncatula
MGFRLPVIRRSSLSASQSSSKQVEVPKGHLAVYVGEKMRRFMIPVSFLNEPLFQELLSQSEEEFGYCHPMGGLTIPCKEDMFLYTTSVLNRL

SEQ ID NO: 3995 - protein, 285 aa, Pseudomonas fluorescens
MSYEPATAATVAGLSVSGVKTMRVALYQCPPRPLDVAGNLQRLHQVAMEATDADLLVLPEMFLSGYNIGLEAVGALAEAQDGPSAQRIAAIAQAAGTAILYGYPERSVDGQIYNAVQLIDAQGQRLCNYRKTHLFGDLDHSMFSAGEDDFPLVELDGWKLGFLICYDIEFPENARRLALAGAELILVPTANMIPYDFVADVTIRARAFENQCYVAYANYCGHEEQIRYCGQSSIAAPDGSRIALAGLDEALIIGTLDRQLMGESRALNRYLSDRRPELYDDLSKR

SEQ ID NO: 3996 - protein, 92 aa, Medicago truncatula
MGFRLPAIRRTSFTSSQASSKAVNVPKGYLAVYVGEQMKRFVIPMSYLNQASFQNLLSQAEEEFGYDHPMGGLTIPCTEDIFMEITSRFNGL

SEQ ID NO: 3997 - protein, 151 aa, Glycine max
TSNHSTTQVPDFLNARIDGLPVKEVVKDQKWLEEEFTEKVQKRGGALIQKWGRSSAASTSVSIVDAIRSLVYSDGNPYGIAEGIVFSMPCRSKGDGDYELVKDVIFDDYLQQRIAKTEAELLAEKRCVAHLTGEGIAVCDLPGDTMLPGEM

SEQ ID NO: 3998 - protein, 388 aa, Medicago truncatula
MSEESHQHHHHHDEDHRTPNSPPTTGTCCKCGGPTTFAPPPPSPNFSEISPPPTYRPIRAPAVPPDPHSQRAIILAPVPQAQHVPVASPPFHFQIPVKRIQSPDDIRRFHDSDSGKNFTGFIVALSDSTRGRKISDPCHQSETVNTIVSILETLTLWIDEIPPLQQAARYGNISYRTWHERLVNSGESLMFKFLPENLKPATVEIVPYFSDSFGNASRIDFGTGHETNFAAWLYCLARLGVIGEEDYQAVVSRVFVKYLELMRKLQLVYCLEPAGSHGVWGLDDYHFLPFIFGSSQLIDHKYMKPKSIHNKDILDNFSHEYLYLACIGFVMKVKKGHFAEHSPMLDDISGVPNWKKVNSGLLKMYKAEVLEKVPIMQHFLFGSLIKWE

SEQ ID NO: 3999 - protein, 202 aa, Crocosphaera watsonii
MTIKQTKNVILIIVKTIFNNENNKMSETIVLGGGCFWCVESVYQNVGGVEAVESGYAGGNTDNPTYEQICTGRTGHAEVVKVTFDPAKVSLTEILEVFFIASHDPTTLNRQGNDVGTQYRSIILWNSEQQLETAKTVIDKLNTDNVFSGKIVTELKELTDYYKAEQYHQNYFKRNPMQPYCLFSIPPKLSKLKKYFPEKALA

SEQ ID NO: 4000 - protein, 718 aa, Arabidopsis thaliana
KSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVSSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMLENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNNQQNQTQIGETCAAVAPQLNPVATTATGGTWMYWPNVPAVPPQLPPVMETQLPTMDRAGSASAMPRQQVVLDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPSGQKPEAPPSSAATKRQNKSQRNINNNSPSANVVVASPTSQTV

SEQ ID NO: 4001 - protein, 444 aa, Arabidopsis thaliana
MQSLSQLGPSEIFLVARREKPSTRAQLWFTGRLSFRQETNGIRLKNRVEFSPRPVPPNLIAAEKEEAKAVLTLFFKKQGLSNSLSSRLINKSDLFIDHLVSRLHSVHKARYLVGRELTTLEIRDSLIPYLEQLHEEHGDLLAELVVSFPDPPAEPRLVASSPVSVLPPRGDTDSAADTRKLRAVSRVSELDTEGALRPQTLYLLDLGLNLEQIKTITRKFAAFPYYSLDGKIKPVVEFLLDLGIPKSDIPTILCKRPQICGISLTDNLKPTMAFLETLGIDKNQWAKIISRFPAILTYSRQKLTSTVEFLSQTGLTEEQIGRILTRCPNIMSYSVEDKLRPTMEYFRSLNVDVAVLLHRCPQTFGLSIESNLKPVTEFFLEKGFGLDEIGIMISRYGALYTFSLKENVMPKWDYFQTMDYPKSELCEVPSVFWVQFTREDQAEI

SEQ ID NO: 4002 - protein, 321 aa, Streptococcus oralis
DINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVESSDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 4003 - protein, 562 aa, Brassica napus
MESFCDNDDNDHSNTTNLLGFSLSSNMLKIGGSEGEALYSSSSSSVATCSVPPQLVVGDNSSSYGVCYGSNSAAGDIYSQMSVMPLRSDGSLCLMEALNRSSYSNHHHHTQVSSPKIEDFFGTLHSNTNHKETMDLSLDSLFYNTTHEADNNTNFQEFFSFPQTRNHHEEESRNYESVPGLTHGRGPFNVGVYGEFQQSLSLSMSPGSQSSCITGPHHHQNQNHQGHNQTQNHHQISEALVETNVGFETTTMAAARKKKRGQEEVVVVGQKQQTVHRKSIDTFGQRTSQYRGVTRHRWTGRYEAHLWDNSFKKEGHSRKGRQVYLGGYDMEEKVARAYDLAALKYWGPSTHTNSSVEIYQKEIEDMKNMTRQEHVAHLRRRSSGFSRGASIYRGVTRHHQHGRWQARIGRVAGNKDLYPGTFGTQEEAGEAYDVAAIKFRGTNAVTNFDITRYDVDRIMSSNTLLSGELARRNSNSIVVRNNNDEETALNAVLDGGSNKKVSGPERVLGFPGNFSLPQDGPKMFGANVVGNMSSWTTNPNAELKAVSITLPQMPVFAAWADS

SEQ ID NO: 4004 - protein, 439 aa, Mycobacterium avium
MHERSSHRPAGRGPPASRGPSPKLLQGIGFAVSRRTMMRRLSRRYGNVFTLRLPMWGPVVMVSDPQLAKQIFTTTPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRHYDGVIERLIAAEQADPNFAERTDVLALLLRSTYDDGAAMSHKEIGDELLTLLAAGHETTASTLAWAFERISRHPELLARLVEEADNGGNELRQATILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 4005 - protein, 326 aa, Streptococcus oralis
SKYHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAVFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVETSDKFEREGTTIFYNLNLNFVQAALGDTVEIPTVHGDVELVIPEGTQTGKRFRLRGKGAPSLRGGAVGDQYVTVNVVTPTGLNDRQKAALKEFAAA

SEQ ID NO: 4006 - protein, 171 aa, Mycobacterium avium
MTNTQKAILAGGCFWGMQELIRKQPGVVSTRVGYTGGDVPNATYRNHGTHAEAVEIIYDPAVTDYRQILEFFFQIHDPTTKDRQGNDRGPSYRSAIFYTDDEQKRIALDTIADVEASGLWPGKVVTEVSPAGDFWEAEPEHQDYLQRYPNGYTCHYIRPGWKLPRRATSGS

SEQ ID NO: 4007 - protein, 542 aa, Streptococcus suis
MTIDKRKVVYQIYPKSYKDTTGNGVGDLRGIIEKLPYLKELGIDMIWLNPFYPSPQRDNGYDISDYTAVNPDFGTMADFEEMVTVGKELGIEFMLDMVLNHCSTDHEWFQKALSGDQYYQDFFILRDQPTDWVSKFGGNAWAPFGDTGKYYLHLFDVTQADLNWRNPHIREELFKVVNFWKDKGVKGFRFDVINLIGKDEAREDCPINDGKPAYTDRPITHDYLKMMNNATFGSEKGFMTVGEMSATTIENCILYTAPERKELSMAFNFHHLKVDYKDGQKWTIMDFDFEELKHLFHTWGEEMSVGNGWNALFYNNHDQPRALNRFIDVENFRKEGATMLAASIHLSRGNNLTSTWVRRSVSSTLTTIAWTTTWTWSLSMPTRCSWTKVTRLSRPSRLSRPSPVTIPAPRCNGTLLTMQASQQATPWLKAGKSYQTINVEQEKTGPIFTFYKRTHPLRKELPLISEGDYKAAYKDSQKVYAFERLLNDEKLLVLNNFFAEEVELDLADDYAHGQVLISNYPDNKLGKKIILKPYQALAIQVK

SEQ ID NO: 4008 - protein, 178 aa, Glycine max
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 4009 - protein, 322 aa, Streptococcus oralis
FTQISQEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVICGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKNSQL

SEQ ID NO: 4010 - protein, 418 aa, Geobacter sulfurreducens
MSIAEKIRNIAADARQAAIAMAKLSASAKNELLLAMAGSLVRNTVQLIEENRKDLEAGEAKGLSTAMLDRLMLNEARIKAMADGLREVAALSDPVGEVTRMWTRPNGLRVGKMRIPLGVIGIIYEARPNVTADAAALCLKSGNSVILRGGSEAIHSNLAIARILGEELKRAGIPAAALSVVPFPEREGVLEMLKQEEFIDLIIPRGGESLIRFVVENSRIPVIKHYKGVCHVFVDADADFDMAEKIIVNGKVQRPGVCNALETLLVHKDIAETFIPRIAETLIELKVELRGDDCVRQFVPQATKATEDDWHAEYLELILAVRVVDDLDEAVAHINRYGSLHTEAIVTRDYHNAQRFIREVNSSTVLVNASTRFADGNQLGLGAEIGISTTKLHSFGPMGLEDLTTTKFIVYGDGQVRP

SEQ ID NO: 4011 - protein, 317 aa, Streptococcus oralis
EPGAEEKYKEVQEAYETLSDDQKCAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVICGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 4012 - protein, 1323 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGDGCPMPQRSNSAPAFFSRKTSEADVLWFNCVHIRDCRSVLDDILKQKGNNKIETLNRYVSVAISVIEEQDGGALRRLVEQQQWRYLVSQSTRSPKLIHGFFSFSSKTNPNPNKQQQILIDYISKSLQSNDTWETLSTKFSSIDLSDSLIETILLRFKNPETAKQALSFFHWSSHTRNLRHGIKSYALTIHILVKARLLIDARALIESSLLNSPPDSDLVDSLLDTYEISSSTPLVFDLLVQCYAKIRYLELGFDVFKRLCDCGFTLSVITLNTLIHYSSKSKIDDLVWRIYECAIDKRIYPNEITIRIMIQVLCKEGRLKEVVDLLDRICGKRCLPSVIVNTSLVFRVLEEMRIEESMSLLKRLLMKNMVVDTIGYSIVVYAKAKEGDLVSARKVFDEMLQRGFSANSFVYTVFVRVCCEKGDVKEAERLLSEMEESGVSPYDETFNCLIGGFARFGWEEKGLEYCEVMVTRGLMPSCSAFNEMVKSVSKIENVNRANEILTKSIDKGFVPDEHTYSHLIRGFIEGNDIDQALKLFYEMEYRKMSPGFEVFRSLIVGLCTCGKVEAGEKYLKIMKKRLIEPNADIYDALIKAFQKIGDKTNADRVYNEMISVR

SEQ ID NO: 4013 - protein, 314 aa, Streptococcus oralis
ISQEPGAEEKYKEVQEAYETLSDDQKRAAYDQYGAAGANGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 4014 - protein, 588 aa, Rhodobacter sphaeroides
MEREMTEVMSGARMVVQALKDQGVDTVFGYPGGAVLPIYDEIFQQNDIRHILVRHEQGAVHMAEGYARSTGKPGVVLVTSGPGATNAVTGLVDALMDSIPLVVLSGQVPTFMIGTDGFQEADTVGITRPCTKHNWLVKDTARLAETIHQAFHVATHGRPGPVLVDIPKDVQFATATYQPPQKARVDHYQPKVKGDIEAITRMVELIETAERPVFYTGGGVINSGSAASQLLREFVDATGFPITSTLMGLGAYPASGKGWLGMLGMHGLYEANLAMHGCDLMINVGARFDDRITGRVKDFSPFSQKVHIDIDPSSINKVIRADVPIIGDVGHVLEDALRLWKSRGRKVNREALAEWWKQIAEWKAVNCLDYAPSSKLIKPQHALQRLEALTKGMDRYITTEVGQHQMWAAQFLGFEGPNRWMTSGGLGTMGYGLPASIGVQVAHPEALVINIAGDASFLMNMQEIGTAMQFRLPVKQFILNNERLGMVRQWQQLLHGQRYSQSWSESLPDFVKLAEAFGAKGIQCADPADLDDAIREMIAYDGPVVFDCLVEKHENCFPMIPSGRPHNEMLLGDAETEGAIGAKGAVLV

SEQ ID NO: 4015 - protein, 657 aa, Ustilago maydis
MPLLDPREVLLRRGIPIPAAASFHVPGLPDLHAESSSSTALAHPLQMSAGYLPARPIEADGQPKDNAHLFFLLLRARHVPAKRKLIIWFNGGPGCSSFDGAMMEVGAWRMDGKGGLVWVKDGASWNEYADILFLDQPAGTGFSYVNTNAYTKSLPQAADEVVHFLEQFVQVYPEYSRDVELEYGSQGSGVDVYLAGESFAGQYIPYTAKAIVKSPKPPVSLKGIAIGNGFIDPKSQYGTELETMVQKNIWTTSSGEYKHVAGLVKACHEELDKSNQREIGKCELILQTIIASTTTKTQGASGYTCINVYDVRLSDSSPACGMNWPTTLPAMYDYLRRPDVRKALHVDEHHKPEAWVECNANVGSAMRTDTTSPPSVQLLPELLDSGVKVLLFAGEEDLICNAIGVQRAAENLEWGGAKGFDDKQPAQDWYVNGTHAGTWRTARNLTYVGIKGASHMVGVDKPIESHDMIVRFMGIDYMKVAGPNALIPSRVGNEPDRVLITGGGGGIAQIGKDGSRVIPGSGKTEEEVAEEARWRAYYDAGSFALMVLLIAVGIGTWLLLRARKQRRLNRNRIGRGGALRLATTTELGASRSTTGNGDTDETSNNHELERLVGGKHVEDDDDDVEEHIFNVGDEDLSDSNGENGPPVVKARHTGSQR

SEQ ID NO: 4016 - protein, 90 aa, Triticum aestivum
  misc_feature (44)..(44): Xaa can be any naturally occurring amino acid
MLPIGHFFLVCTRFVENGCEKIDHPVDLYARYSDMVKAKTERFXDLDDLEMDDDVRYNQKFRVGLYTLQWASEFPVFLLSPVTSLLYKEQ

SEQ ID NO: 4017 - protein, 657 aa, Escherichia coli
  misc_feature (330)..(330): Xaa can be any naturally occurring amino acid
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALHEFRDAIKALHKAGIEVILDIVLNHSAELDLDGPLFSLRGIDNRSYYWIREDGDYHNWTGCGNTLNLSHPAVVDYASACLRYWVETCHXDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGVGGTLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 4018 - protein, 173 aa, Yarrowia lipolytica
MADERSKLEQAGEGTNFSSDEIDRLRKRFMKLDTDASGILETNEFLSLPGVAANPLASRLMDVFDENHSGDVDFQEFINGLSTFSTKGNKKEKLRFAFKVYDIDRDGYISNGELFIVLKMMVGNNLKDAQLQQIVDKTIMEADKDGDGKISFEEFEAQVGGTNVYQSMTLDLF

SEQ ID NO: 4019 - protein, 314 aa, Aeropyrum pernix
MAGGSEKSVFLKWSWFLEWLTPDRATLKHIEDVIFQGRSRFQEIAVVRVSGEGKVLVLDGKTQSSESDEFMYHEALVHPAMILHGSPRKVLILGGGEGATLREVLKHRSVEKAVMVDIDETVVNVAREHLREWHRGAFDDPRAEVVIDDAWNYVASKAETGFDVVIADLVDPLEAGPATRLYSEEYYRMVKDVMNPGGVFVTQAVSISHLTEYHAIIRNTVARVFKHVESYGVYVPSFDSMWGFVVASDDKDPRILGDRGFFETRLSHQLQGAELRFLDYASMLHMLNIPKMYREAIAREKRYATLDNQVFLPA

SEQ ID NO: 4020 - protein, 713 aa, Idiomarina baltica
MNPITKQFQYGQHTVTLETGVVARQATAAVMASMDDTTVLVSVVAKKEAREGQDFFPLTVNYQEKTYAAGKIPGGFFKREGRPSENETLTSRLIDRPIRPLFPEGFMNEVQVVATVVSVNPQVSPDLVAMIGTSAALAISGVPFNGPIGAARVGVINDEYVLNPTQDELTESKLDLVVAGTQQAVLMVESEANLLSEDTMLGAVMFGHESMQVVIDAINEFAQEAGKEKWDWQAPQKDATLVEKVKSLAEAGIGEAYRITDKAERYGKIAEVKQAMIEQLVAENEEADTDEAGKIFHDVEKDIVRSRILAGEKRIDGRDPDMVRAISVATGVLPRTHGSALFTRGETQALVTATLGTDRDAQMIDELTGTSTSRFLLHYNFPPYCVGETGMVGAPKRREIGHGRLAKRGIQAVMPSHEEFPYTVRVVSEITESNGSSSMASVCGSSLALMDAGVPIKSSVAGIAMGLVKEGDKHVVLSDILGDEDHLGDMDFKVAGNNEGITALQMDIKIDGITRDIMESALGQAKAARLHILSVMDEAIGEHRDELSTYAPRFTTIKIDQDKIKDVIGKGGAVIRELTESTNTNIEIGDDGTIKIAASDQNDADAAIKRIKELTAEIEVGKIYQGKVARIVDFGAFVTVLPGKDGLVHISQIAEERVNDVNDYLKVGDTVPVKVLEIDRQGRVRLSMKEAAEKPAEANSEQSTEQSEDKSED

SEQ ID NO: 4021 - protein, 127 aa, Rhodopirellula baltica
MSQSESDLLDQLGGMDGVRRVVDEMYVRVLADPELTHFFDGVPIEKLARMQTEFIASITSGDIQYTGADLTKVHAGRGITGVHFSKFCGHLTDALEANNVSSHAIDQVLGKLAMYSDKVTGSSNVDG

SEQ ID NO: 4022 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACERLHGLSLIDASATPLLDGWSQRFAAHPAAKRVLPD

SEQ ID NO: 4023 - protein, 554 aa, Pseudomonas syringae
MAYYRTPSDVTALPAWQALNKHRQAMQNFSMREAFNTDPQRFSQFTLSSAGLFLDYSKNLITTETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLGLLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMDEQEVQKLAPHKVIPGNRPSNTLVVERISPRRLGALVAMYEHKVFVQSVIWGTNAFDQWGVELGKEMGKAVYQRLTGGTEEQADDASTQGLINYFRGRHRG

SEQ ID NO: 4024 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGKAFFSGGDAAPGLLDLALGCFLPALRACERLHGLSLIDASATPLLDEWSQRFAAHPAAKRVLPD

SEQ ID NO: 4025 - protein, 188 aa, Zea mays
  misc_feature (21)..(21): Xaa can be any naturally occurring amino acid
  misc_feature (43)..(43): Xaa can be any naturally occurring amino acid
GLYSVAIIDADGADLGLYRKXHIPDGPGYQEKFYFNPGDTGFXGICWDQWFPECARAMALLGAEILFYPTAIGSEPQDCNLDSREHWKRVMQGHAGANLVPLVASNRIGRETVDTEHGKSSITFYGNSFIAGPTGEIVKLANDKDEEVLVAEFDLDEIKSIRHGWGIFRDRRPELYKVLLTLDGEKQS

SEQ ID NO: 4026 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHGLSLIDASATPLLDGWSQRFAAHPAAKRVLPD

SEQ ID NO: 4027 - protein, 327 aa, Zea mays
MDEINLLRQAQRQHQHHLMVRGIGEEIDLEIGPVDDPSFSGASLVAVTSTHDTVVHADDHKSLLIPCSQPGAADGLAPQQHLSQGEEHDGMLRSPSGHTKKKKKVVKKWREEWADTYKWAYVAVHDTTTRIFCSVCKEYGRKHRRNPYGNEGSRNMQMSALEEHNNSLLHKEALRLQMASKEKLQPPEIEGPVYVKALSKTAASILECVLRRDPHEAEYIQSIQETLKNALSLYKLGGAAGGSDFDPKGKSDNEIMRFCQSFMDELYRYLGPDQDFSAEDIGVGPREMGYLFGQYRRLSGHFQGNFTGPKIFWSGSSFRTEATGYGL

SEQ ID NO: 4028 - protein, 312 aa, Unknown
  delta proteobacterium MLMS-1
MSASPEIPASVAGLVGDTPLLRLEHMSRECGAEILVKLESHNPIFSVKDRIALAMLTAARRQGLIQPTTTIIEPTSGNTGIALAMLCAAQSLRLTLTMPETMSVERRALLRHLGAKLVLTPGPEGMKGAIARAEELAAADTDTFIPNQFTNPANPEIHRRTTAEEIWRATGGELDLFVAGVGTGGTITGVGEVIKERLPGFKAFAVEPAASPVLSGGAPGPHKIQGIGAGFIPAVLNTGIIDEVIQVSNEDAIASARLLAAREGVLAGISSGANLYAAMQIAARPEFKGKRIVTVVCDTGERYLSTDLFLTE

SEQ ID NO: 4029 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 4030 - protein, 368 aa, Citrobacter freundii
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFSKKDEEGKYLVDVILDEAANKGTGKWTSQSSLDLGEPLSLITESVFARYISSLKDQRVAASKVLSGPQAKRAGDKAEFVEKVRRALYLGKIVSYAQGFSQLRAASDEYNWDLNYGEIAKIFRAGCIIRA

SEQ ID NO: 4031 - protein, 567 aa, Streptococcus pyogenes
MNVAGMLHIPDSRYCFAISQKELVIRLRVAKEDRGITVNLVHGPKYGYHEFQEELEMSVAYTDHTHAYYETTLTLDDVRLAYIFKIEEEGQTYYFSEDGLTTSYDFSNGFYNFFQMPYINAVDVHQVIPWTKDAVFYQIFVDRFNRGDWEKGDSYVNMGWLEKPTPKSFAGGDLKGITEKLDYLKDLGITVIYLTPIFQSISNHKYDISDYYAIDPQFGTKYDLQELIDLAHKMGIKIILDAVFNHASSDAVEFQDVLRYGKESKFFDWFMTHDEHPSMDLVNYETFAGCNYMPKWNTSNRDVQDYLIEIGRYWIKEFCIDGWRLDVSDEVSHDFWRRFRQAVKAEKADAILIGENWHDAYPYLAGDQYDGIMNYAFTKACLDYFAFETMTSKQLAEKLSNILMRNTWQVNRMNLNLLDSHDTHRFFTQVKGSKDKLLAALALLFIFMGIPCLYYGTEVAMEGGYDPDSRRGFPWDDAERDKDFFSKVKAIIALRQQPALQEGAISIDYDEDCLILKRSLGEQSISLVLNNGESAYSIKEGGQILTSNGVTKNKKQLLQDGYIVFSN

SEQ ID NO: 4032 - protein, 713 aa, Roseovarius nubinhibens
MFNEVKKSIQWGEETLTLETGKVARQADGSVIATLGETSVMANVTFAKEPKPGQDFFPLTVHYQEKYYAAGKVPGGFFKREARPTEKETLTARLIDRPIRPLFVDGFKNEVLVMCTVLSHDLVNDPDIVAMIAASAALTISGAPFMGPIAGCRVGYEDGEYILNPTVDDMHELRSNPDQRLDLVVAGTRDAVMMVESEAYELTEEEMLGAVTFAHEQLKPVVDLIIDLAEVAAKEPFDFQAPDYSDLYAAVKAAGEKEMRAAFAITDKQERTAAVAAARTAIKAALTEEQLEDANLGSALKKLEASILRGDVVKGGKRIDGRDTTTVRPIVSETGLLPRTHGSALFTRGETQGLVVTTLGTGDDEQFIDALHGTFKSNFLLHYNFPPYSVGEAGRVGPPGRREIGHGKLAWRALQAVLPAPTDFPYTIRVVSEITESNGSSSMASVCGGSLSMMDAGVPLKAPVAGVAMGLILEDDGDFAILTDILGDEDHLGDMDFKVAGTEKGITSLQMDIKVAGITPEIMKQALAQAKDGRLHILGEMSKALTEASEFSVHAPRIETMNIPTDKIREVIGSGGKVIREIVETSGAKVDINDDGVIKIASPNGEAIQKAYDMIHSIVAEPEEGQVYDGKVVKIVDFGAFVNFFGKRDGLVHVSQIENRRLNHPSDVLKEGQDVKVKLLGFDDRGKVRLSMKVVDQETGEEIAPEKKEKDDA

SEQ ID NO: 4033 - protein, 416 aa, Dechloromonas aromatica
MFSAKDTLAKVDPELWQAIQAEVQRQEDHIELIASENYVSKAVMEAQGSQLTNKYAEGYPGKRYYGGCEYVDVAEQIAIDRLKKLFGAEAANVQPNSGSQANQAVLMAFAKPGDTIMGMSLAEGGHLTHGMALNMSGKWFNVVSYGLNEKEEIDYDKMEALAREHKPKIIVAGASAYALRIDWERFAKIAKEVGAIFWVDMAHYAGLIAAGFYPNPVPFADVVTSTTHKTLRGPRGGVILMKAEHEKALNSAIFPGLQGGPLEHVIAAKAVAFKEAATPEFKNYQEQVINNARVMARVLGEERGLRIVSGRTESHVFLLDLRAKNITGKDAEAALGRAHITVNKNGIPNDPQKPFVTSGIRIGSPAMTTRGFTEIEAEQIAHLVADVLEAPSDEAVAATVREKVSALCKKFPVYGA

SEQ ID NO: 4034 - protein, 195 aa, Roseovarius nubinhibens
MRRATITRKTAETDISVEINLDGTGRYDNETGVGFFDHMLDQLARHSLIDMTLRCTGDLHIDDHHTVEDVGIALGQALAEALGDKRGIRRYGACLLPMDDALVRTALDLSGRPFLVWNLDLPTQKIGTFDTELVREFFQALSTHGGITLHVDMLHGVNSHHIAEAAFKSVARALRDAVDTDPRKSDAIPSTKGAL

SEQ ID NO: 4035 - protein, 255 aa, Glycine max
  misc_feature (43)..(43): Xaa can be any naturally occurring amino acid
  misc_feature (88)..(88): Xaa can be any naturally occurring amino acid
  misc_feature (152)..(152): Xaa can be any naturally occurring amino acid
ETYPSTHGVYEQGIDEICEIIHDTGGEVYMDGANINAQVCFSXIHVFISYENLQSHIECKRMGLGNYMAIFDASVSPLEPIMGYVSVXIGSKGLTDASKIAILNAGSRAKRLENYYPVLFRGVNGTVAHEFIIDLRGFKNTAGIEPEDVAKXAELDRFCDALISIRQEIAEIEKGKVDINNNVLKGAPHPPSLLMADAWTKPYSREYAAFPAPWLRTAKFWPTTGRVDNVYGDRNLICTLLPASQAVEEQAAATA

SEQ ID NO: 4036 - protein, 491 aa, Zinnia elegans
  misc_feature (44)..(44): Xaa can be any naturally occurring amino acid
  misc_feature (49)..(49): Xaa can be any naturally occurring amino acid
  misc_feature (465)..(465): Xaa can be any naturally occurring amino acid
  misc_feature (475)..(475): Xaa can be any naturally occurring amino acid
DYLLLSLLSTVTFFFLLLHLATTSSRRKTRLPPGTVGLPFIGEXLQLIXAYKTQNPEPFIDSRVAKYGTLFTTHVFGERTVFSADPETNRFILQNEGRLFESSYPGSILNLVGKHSLSFMRGSLHKRMHSLTMSFANSTIIKDHLLVDIDRLVRLNLDSWTGRVLLLEEAKKITFELTLKQLLSIEPCEWTENLRKIYMLVIEGFFCIPIPMFSITYRRAIKARERVAEELSLVVRERRRESEKGMKKNDMLAALFDGGGDVGGVGLTDAEIVDFLVSLLVAGYDTTSTTMTLAVKFLTDTPRALAQLKEEQDEIRARKTDAGTIEWEDYKSMPFTQCVINETLRVSNIISGVFRRAMTDVDIKGYRIPRGSKVFTSLRAVHLGHENFNDARVFDLWRWQKSSNPTNFMPFGGGPRKCPGNELARVALSVFLHHLVTRFSWEPAEEDKLMFFPTTRTQKRYPIIXESSVVMQSSXVKDTKRKTQVGRRILS

SEQ ID NO: 4037 - protein, 320 aa, Streptococcus oralis
INKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 4038 - protein, 178 aa, Pediococcus pentosaceus
MDNDIARVLYSKADIKEACERLGKQLTKDYAGKRPLILSVLTGAMFFTTDVVREFDVYSEIDFIDVSSYKGGMESTGTVDLVSDLSEDVNGRDVLIIEDIVDTGRTLSYIVDLLYSRNAKSVKICTFLDKPAGRVVEAKADYVGFTVPKEFVVGYGLDYQGYYRNLPYVGVLKPEVYE

SEQ ID NO: 4039 - protein, 496 aa, Zinnia elegans
MCSTTLNMCDLEFFILASCLVLALFLILKLVKRRTNNGSTRNLPPGNMGWPFIGETIGYLQPYSATTIGKFMEQHISKYGKIYKSSLFGEPTIVSADPGLNKYILQNEGRLFECSYPRSIGGILGKWSMLVLVGDMHRDMRQISLNFLSNARLKTQLVNEVEKNTLWVLDSWKENSPFCAQEEAKKFTFNLMATHIMSLDPGEPETERLKKEYVTFMKGVVSPPLNFPGTAYWKALKSRATILKFIETKMEERIRMDEGNGLGKLDNDLLGWSMKNSNLTKEQILDLVLSLLFAGHETSSVSISLAVYFLEACPTAVRQLREEHEEIVMKKKLLGEKYLTWDDYKKMEFTQCVINETLRFGNVVRFLHRKAIKDVRYKGYDIPCGWKVLPVIAAVHLDPTHFDQPYLFDPWRWQNASVTSSTCSTPPSASNFMPFGGGPRLCTGSELAKLEMAIFIHHLVLKYEWELVDSDEAFAYPYLDFPKGLPIKIRHRKQSC

SEQ ID NO: 4040 - protein, 315 aa, Streptococcus oralis
PDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKAA

SEQ ID NO: 4041 - protein, 448 aa, Halomonas halodenitrificans
MQHLEGVTRPQQYRALGLSTLAFTTCFAVWTIFSIIGIQIKQDLGLNETQFGILVATPILTGSISRIFLGIWTEQFGGHRVFSVLMLLTAACVFLLSYVESYAMFLVAALGIGLAGGAFIVGIAYTSYWFEKDKQGTALGIFGAGNAGAAVTNFGAPFLLLALGWERTAVVYAVVLAAVAVGFWVFATEDPLTRARRRGQGAQATSARAQLEPLRHLRVWRFALYYFFVFGAFVALASYLPRYYVGAYGVSIAVAGSLAALYTLPASVFRALGGWMADRYGARAVMYLTFIASLVCLFLLAYPETRYVVQGKEGEIAFTLAMPLWGVVVLTVLLGFFMSLGKAAVFKHIPVYYPENVGSVGGLVGMIGGLGGFFLPILFGIVLDLTGIWTSSYMVIFMLVAVSLIWMHTAIRRMERKNVPELGEERYRYLPEIQEPAEEHARRHGPRP

SEQ ID NO: 4042 - protein, 466 aa, Oryza sativa
AKRANRLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 4043 - protein, 476 aa, Clostridium acetobutylicum
MNTSEIRKSHYNIYLKLLICILFGVFIWFIPHSKSIQPLAWHMLAIFIATILACILKPLPIGAVSIIGLTLAIITNTINVNTGLLGFSEGSIWLIVIAFFISRGFIKTGLGSRIAYHFIKLFGKKTLGLCYSIIFCDLVIAPATPSNTARAGGIIYPIIKSLSEAFGSKPEDNTERKIGSFLIFSEFHGDIITAAMFLTSMAANPLAKTLAKTLNVNITWFGWFLAALVPGIISLVLIPLIIYKIYPPEIKNTPNAPELAKKELEKMGPMKKDEKLMSIVFVIILFLWITGSLTKIDATLTAFIGLSLLLIFKVITWDDVKGEKGAWDTLIWFSVLVMMANQLNKLGLIKWFSTLVKNSVHGFSWPIILLILLVCYFYIHYIFASATAHVSSMYSAFLAIAIAGGVPPLLAALSLGFFGNLLASTTHYSSGPAPILFGSGYVNQNKWWSLNFILGIVYFIIWLGIGSIWWKVIGIY

SEQ ID NO: 4044 - protein, 317 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETDQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVNVVTPTGLNDRQKQRLKNSQLQ

SEQ ID NO: 4045 - protein, 424 aa, Thermus thermophilus
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVVRNAFEAVWQVAQEKKIPLRTAAYVVAATRVLEARAPPGLYP

SEQ ID NO: 4046 - protein, 189 aa, Coprinellus disseminatus
TREQHIRREKATSNICTAQALLANMAAMYAVYHGPEGLKRISNKVHGFTQVFKSSVESLGFKAINTTFFDTLTLDVTGAVANSWAVHASANAAAINLRRIDDKHVGVTFDESVTPAELVDLINVFATAANKSPFALSDLAEPTESAISPHLKRTSKFLPHPVFNKHHSETEMLRYINHLSSKDLSLTHS

SEQ ID NO: 4047 - protein, 241 aa, Burkholderia xenovorans
MTVFFIGAGPGDPELITVKGQRLVRSCPVILYAGSLVPAAVLEGHAAVQVVNTAELDLDQIIALLEAAHLKGQDVARVHSGDPSLYGAIGEQIRRLRELKIPYEIVPGVTATAACAAALGCELTLPDISQTLILTRFASKTSMPEGEQLADLARHRATMAIHLGVRHLARIVDELRPHYGGACPIAVIYRASWPDEEKLTGTLDDIVGKVQSSSIERTALILVGQVLAAEGFADSTLYAKD

SEQ ID NO: 4048 - protein, 315 aa, Streptococcus oralis
GAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKYEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 4049 - protein, 233 aa, Ostreococcus tauri
MFDAREDALAGARQHANWSPYDNNGGTVLAVAGESYVICAGDTRMSSGYNILTRKFEKIDKMSGKTLMASAGFAADAVTLKKTLKARCKQYEFQNKREIGCVAFAQMLSNTLYYRRFFPYYAFNIVAGLDAEGKGAVFTYDAVGSYERTNYSCQGSGQALIMPVLDNQLKTVSPLVLPAASSATPLSEQEAIDLIKDCFATAAERDIYTGDSVELWIMNAEGVRKEEMALRAD

SEQ ID NO: 4050 - protein, 189 aa, Coprinellus disseminatus
TREQHIRREKATSNICTAQALLANMAAMYAVYHGPEGLKRISNKVHGFTQVFKSSVESLGFKATNTTFFDTLTLDVTGAVANSWAVHASANAAAINLRRIDHKHVGVTFDESVTPAELVDLINVFATAANKSPFALSDLAEPTESAISPHLKRTSKFLPHPVFNKHHSETEMLRYINHLSSKDLSLTHS

SEQ ID NO: 4051 - protein, 319 aa, Streptococcus oralis
HKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKYEREGTTIFYKLNLNIVQATLGDTVEIPTVHGAVELVIPEGTQTGKKFRLRGKGAPSLRGGAVGDQYVTVNVVTPTGLNDRQKAALKEFAAA

SEQ ID NO: 4052 - protein, 323 aa, Yarrowia lipolytica
MIRAKFTEYKQALRNNWVGQPQYTEKDYPDIDGKNFVVTGATGGVGLEVTKLLLDKKSHVIMVGRSRSDWQPVLDQLQKDHSHGTLDFVEADLADLTTVQRAGEYIRTKYPTLDGAIFNAGVMAPPYSLTPQGQESQWGVNVVSHFLLAKYISPAVIAAAKTAPKDSVRLVWLSSSVTFVSPYEGGIKFDDINHQDDKNPSPWTLYSQSKIGDAYLAYLWSKHHPDSGVVSVSVDPGNLSSNLSRHYPILSTLKSYIQYPPKYGAYTELSALLNPAVKNNEHLIPWGVRGHLRLDVDDGRRGSVGEELWQRLNKDVAPYFKEE

SEQ ID NO: 4053 - protein, 189 aa, Coprinellus disseminatus
TREQHIRREKATSNICTAQALLANMAAMYAVYHGPEGLKRISNKVHGFTQVFKSSVESLGFKATNTTFFDTLTLDVTGAVANSWAVHASANAAGINLRRIDDSRVGVTFDESITPADLVNLINVFATAASKSPLALSDLAEPTESAISPHLKRTSKFLPHPVFNKHHSETEMLRYINHLSSKDLSLTHS

SEQ ID NO: 4054 - protein, 523 aa, Candida albicans
MYQHQDQTQHQYYQQYNSYNPSIEDLIASSDDKRYQNGGIGNSLQRPPVAGLPYISSQVNPNTSSANLSKLTNNINNYGYNNNNNSYIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 4055 - protein, 825 aa, Ostreococcus tauri
MYLFKNLLWKSLRMVSLMKRLPTLGSSRAWFLKTTSSSHRRLVRKSPEAPRSSSGFPVANSPRFRRAFSLDSLEFGQERRRVVVCETNRVEIVNHRVSRRHRVGTASSPRRHPRMFSGERTVGITLGITLGIALAPVVVRVFRPRSESSPRVRRLLSLPQSLQRLHRRRADRSNPPRAITRPSRRSFALLELASQIISQQRVRGGINPAASSLDRFALAPNSLAPPWCSRPRAVVHVARCAVVIARATRRGVRAARDVDARHVHARARMGAAARAPSTRVRARAMPRSRPRARVGRVDGTDGTMSNPALSGNFAPVADELAHELACAIAGRLPRAIDGVYARNGPNPHREPALGVDRYHWFDGDGMVHAVRLGDGKATYVRRYVRTRGFERERASGEALYTGLRDINPIWRYLIPRLVEKCTLDVARPDSAYFVIQSKNTSSNALKYHGGRLLSLFESGSPYELAVDPLLTTKGLCDFNGSFTTADFWAGNFTAHPKICPLTKELIYMGYNLVALGPEQEGQTTITVGAIDEKSGKRTRKRTFKVDRPSMQHDVAITPTKIVLIDGPLIFNLSRVIQGGLPFSFEKESTLRVGYVPREGDDGPYWIDTDETCFAYHVVNAYEEGSKLVLDVCKSDETNALGMCQESQATRSTPSANPVCAGRDVAALWRWELDTASKSLISSTRMCEQPSDFPCINRDFTGLKYRYAYSVAYKAGTEPKDRMDIPTFDAVLKHDLDTGVTTRYDLGDGKTCGDIVFVPSEEPKSEDDGYLLVLTHIEGDDPRAELLVLDVSKEVMTEQCVVNIPVRVPYGFHCEYIPGPIPTWPL

SEQ ID NO: 4056 - protein, 450 aa, Salmonella enterica
MTYFLYGNNFSSSILDTISYIIDWIIINMEPITLTLCLLVFAIVMFVWEKVPLAVTSMIVCVALVITGVLNIKQAFAGFIDTNVILFVAMFIVGGALFETGMANKVGGVITRFAKTEKQLIFTIMVVVGLMSGVLSNTGTAAVLIPVVIGVAAKSGFSRSRLLMPLVFAAALGGNLSLIGAPGNLIAQSALQNIGGGFGFFEYAKIGLPMLICGILYFLTIGYRFLPNNATGGEVGSVGEQRDYSHVPQWKQRLSLVVLIATILGMIFEKKIGVSLAVTGCIGALVLVVSGVLTEKQAYKAIDSQTIFIFGGTLALAKALEMTGAGKLVADYVIGMLGQNSSPFMLLIAVFALSVVMTNFMSNTATTALLVPVSLSIAAGMGADPRAVLMATVIGGSCAYATPIGMPANMMVLSAGGYKFVDYAKAGIPLIIVSTIVSLILLPILFPFHP

SEQ ID NO: 4057 - protein, 189 aa, Coprinellus disseminatus
TREQHIRREKATSNICTAQALLANMAAMYAVYHGPEGLKRISNKVHGFTQVFKSSVESLGFKATNATFFDTLTLDVAGAVANSWAVHASANAAGINLRRIDDNRVGVTFDESITPADLVNLINVFATAASKSPLALADLAEPTESAISPHLKRTSKFLPHPVFNKHHSETEMLRYINHLSSKDLSLTHS

SEQ ID NO: 4058 - protein, 261 aa, Prochlorococcus marinus
MSCLDFGTVYLVGAGPGDPDLLTLKAYRLLRQCGALVHDALVPKEVLELVPESCERHFVGKRRERHWVPQSKTNELLVELAQRHSCVVRLKGGDPFLFGRGGEEAAHLQSHGVSVEVVPGITAGMAAPAYVGIPLTHRCGGSSVTFVTGHEKIDKQRPSVNWKDLASASDSLVIYMGLHNLAYIVEELIAGGLDPATSAAIIQQGTVVGQRYLKAPLEQLAQRVQSEGFAAPSIVIVGAVVDEQVAACAPQPAEVLMPIKS

SEQ ID NO: 4059 - protein, 400 aa, Triticum aestivum
MAAAGSSRRGPMDDDKLNFETSAGVDVVGSFDAMGIREDLLRGIYGYGFEKPSAIQQRAVVPIIAGRDVIAQAQSGTGKTSMVSLSVCQVIDTNIHDDSFNMKEDAEEWVQALILSPTRELATQTERVMQAVGNYMSVSVHACVGGKSIGEDIRKLEAGVHVVSGTPGRVCDMIKRRTLRTRAIKLLVLDEADEMLTRGLAARVVGVSRLLPPELQITSKFMTDPVRILVKRDELTLEGMKQFFVAVEKEEWKFDTLCDLYDTLTITQAVIFCNTKRKVDWLTERMRTNNFTVSAMHGDMPQKERDAIMSEFRSGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 4060 - protein, 485 aa, Blastopirellula marina
MITLRGVELLADADVVLYDYLANPSLLRHVRSDAQLHCLGRHGQGKLWSQQEINQAMVDAAQQGLRVVRLKSGDPTIFARAADEIDALKQNEIPFEIVPGVTTALAAGACAGVPVTDSRFASAVALVTGREKPGKSDAAIDYAALAKFPGTLVMYMGVTSAPAWSAGLIAGGKSPDTPCAIIRRCSWPDQETFQCTLGEIADYLHSGSKIRPPVIVVVGEVAREASADNWFQQRPLFGQRILITRPEHQAEDLAHTLAELGADVYLQPAIQISPPSDWTPVDDAIRRLHDFEWLVFSSTNGVRYFLDRLFASGEDLRAVGHLHIAAIGPGTADMLAKYHLKADVIPAEYRAESLVEALQATTDRQRFLLPRASRGRDVLPTGLAAGGGEVTEIVVYQSDDCMTLSPEIIEAWDDQPIDYVIVTSSAIARATVRLLGARAQQTKFVSISPITSDALREAGVEPNIEAAVYTMDGIVAALQQHVSEN

SEQ ID NO: 4061 - protein, 151 aa, Vibrio vulnificus
MQKTTRTMPAHKHIALVAHDNYKPELLRWVKENKEKLQSHFLYATGTTGHMLSRETGLAIKSMISGPMGGDQQLGALISEGKIDMLIFFWDPLNAVPHDPDVKALLRIASVWNIPVATNRATAKFLFESPLLNEEVDVEIPDYQAYLAGRT

SEQ ID NO: 4062 - protein, 451 aa, Staphylococcus aureus
MCIVSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 4063 - protein, 538 aa, Medicago truncatula
MGCLLSKDKDSEPEHNNGGYRYGEHNHRNNHEQVNTSRTAPTSSYQPQIPTKPSSISAPSPKPLIKQDSNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLAVFIEEGKVYRDIVGSAYYVAPEVLRRRCGKEIDIWSAGVILYILLSGVPPFWAETEKGIFDAILEGHIDFESEPWPKISDSAKDLVRKMLIQEPKKRITAAQVLEHPWIKDGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 4064 - protein, 126 aa, Thermus thermophilus
MKALALIAHDAKKDEMVAFCLRHKDVLARYPLLATGTTGARIQEATGLAVERVLSGPLGGDLQIGARVAEGKVLAVVFLQDPLTAKPHEPDVQALMRVCNVHGVPLATNLVAAEALIAWIRKGTPQ

SEQ ID NO: 4065 - protein, 484 aa, Haemophilus influenzae
MSVKGDIGVIGLAVMGQNLILNMNDHGFKVVAYNRTTSKVDEFLQGAAKGTNIIGAYSLEDLAAKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKKTELDSYLIDITTDILGYKDVDGQPLVEKILDTAGQKGTGKWTGINALDFGIPLTLITESVFARCVSSFKDQRVVANQLFGKTIAPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 4066 - protein, 110 aa, Neisseria gonorrhoeae
MSSELIVHTGDAAFEQDVLKSDLPVLLDFWAPWCGPCKMIAPILDDIAAEFEGRLKVVKINIDDNEATPSRFGVRGIPTLMVFKNGEVVATKVGALAKGQLTAFVEASIA

SEQ ID NO: 4067 - protein, 303 aa, Mycobacterium tuberculosis
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTEVVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 4068 - protein, 72 aa, Clostridium perfringens
MSKSDIIEMQGTVLEALPNAMFEVELESGHKILAHISGKLRMNFIRILPGDKVTVELSPYDLTRGRITWRAK

SEQ ID NO: 4069 - protein, 425 aa, Mycobacterium tuberculosis
MNTLNDSLTAFDPDIAALIDGELRRQESGLEMIASENYAPLAVMQAQGSVLTNKYAEGYPGRRYYGGCEFVDGVEQLAIDRVKALFGAEYANVQPHSGATANAATMHALLNPGDTILGLSLAHGGHLTHGMRINFSGKLYHATAYEVSKEDYLVDMDAVAEAARTHRPKMIIAGWSAYPRQLDFARFRAIADEVDAVLMVDMAHFAGLVAAGVHPSPVPHAHVVTSTTHKTLGGPRGGIILCNDPAIAKKINSAVFPGQQGGPLEHVIAAKATAFKMAAQPEFAQRQQRCLDGARILAGRLTQPDVAERGIAVLTGGTDVHLVLVDLRDAELDGQQAEDRLAAVDITVNRNAVPFDPRPPMITSGLRIGTPALAARGFSHNDFRAVADLIAAALTATNDDQLGPLRAQVQRLAARYPLYPELHRT

SEQ ID NO: 4070 - protein, 676 aa, Ralstonia eutropha
MCGFAGFLGGIPGSLEDRAILLTRMGQRILHRGPDHGDLWCEPGAPFGFTHRRLAIVDLSPAGRQPMISASGRYVIVFNGEIYNHPEIRAELESAGAAPRWRGHSDTETLLAGIDAWGADATVRRTIGMFAFAVWDRQTHSLTLARDRLGEKPLYYGWQGSGQARAFLFGSELKALRPHPAFDGSIDRNALTLYMRYNNVGGGHSIYQGIAKLPPAHLLTVSMLAREPVLRAYWSGSAAALQGKQDPFTGGPQEAVDSLDALLRDAVARQMMADVPLGAFLSGGIDSSTVVALMQSQSTQPIRTFSIGFHDAGYNEAAHAKAVARHLGTSHTELYVSPEHAMAVIPRLPEIYDEPFSDSSQIPTLLVSGLARQHVTVSLSGDAGDELFGGYNRYQITAELWGRLARIPGPVRAAAAWGLTRLSPHQINRVAALLPMASRWSHVGEKVHKGAGVMAAHTVDELYRGMVSQWQCPDAIVMGGAEPATLPEPVARALAMLGDVERMMAADLLTYLPDDILTKVDRAAMARSLETRIPFLDHRVVEFAWRLPLAYKIRQEDAGHTTKWVLRRVLDRYVPRELIERPKMGFGVPIDAWLRGPLRDWADDLLSEERLRREGFLNPQPIRQRWTEHLSGRRNWQHPLWCVLMFQAWLGHETTERTAPPLTDIPTSDRRLACAF

SEQ ID NO: 4071 - protein, 172 aa, Zea mays
AANPVYGKIPVLLLPDGRAICESAVIIQYIEDVARGSGGAEASSLLLPDDPYERAMHRFWTAFIDDKFWPALDAVSLAPTPGARAQAVEDTRAALSLLEVAFKDRSNGRAFFSGGDAAPGLLDLALGCFLPALRACERLHGLSLIDASATPLLDGWSQRFAAHPAAKRVLPD

SEQ ID NO: 4072 - protein, 409 aa, Pseudomonas sp.
MGERRDTTVIVGAGHAGTAAAFFLREFGYHGRVLLLSAETQHPYQRPPLSKEYLLAQHSTPSLLKGKDSYARADIELCLQDDVLSITPASRQVKSSQGSYTYDHLILATGSHPRFMATLGQADNLCYLSDWDDAGRIRQQLGEASRIVVLGGGFIGLEIASSACKMGKHVTVIERAPRLLSRVVSEAFATFIGDIHLGNGIELRLGEEVREVRRCTSGVRVDAVFLSDGQLLECDMLVIGVGSEPRMELATAAGLACASGVLVDEHCHTSDPFISAIGDCVAVCPSPGHQLPRRESVQNATEQARLVAARLSGRPVPPVQTPWFWSDQLQARINLAGERPAQGQVIVRRYGGDKVSMLYLQDQQLVAIEACNMPGDCLLARRAIGQNHSLDLARLVDADVPLKDALHFA

SEQ ID NO: 4073 - protein, 258 aa, Clusia minor
CEEIGRGRFGVVYKCTKLSTNETYALKSIVKNSLNDDLLDARCLVTEPKILRHVSPHPHVTQLHDSHEDDCYLHLIIDLCPNGDLYTLLLSTGPIPEAQSKAQFVQLMKAVSHCHKSGVVHRDIKPDNILFDSRESLKLADFGSAECGKGSDLNGVVGTPYYVAPEILEGREYGEKVDVWSAGVVLYVMLAGFPPFYGETVVEIFEAVLRGNLRFPTRAFCTVSSSVKDLLRRILCRDVSRRFTADQVLRHPWVTSGG

SEQ ID NO: 4074 - protein, 260 aa, Clusia minor
CEEIGRGRFGVVYKCTKLSTNETYALKSIVKNSLNDDLLDARCLVTEPKILRQVSPHPHVTQLHDSHEDDCYLHLIIDLCPNGDLYTLLLSTGPIPEAQSKAQFVQLMKAVSHCHKSGVVHRDIKPDNILFDSRESLKLADFGSAEVICGKGSDLNGVVGTPYYVAPEILEGREYGKKVDVWSAGVVLYVMLAGFPPFYGETVVEIFEAVLRGNLRFPSRAFCTVSSSVKDLLRRILCRDVSRRFTADQVLRHPWVTSGG

SEQ ID NO: 4075 - protein, 607 aa, Hordeum vulgare
MQTLSAQPLASSSSIQRHHGRRRGPGSVRFAPRAAAAAAATSTSTARSPAYVSSPSTRKVPGYEQSSPPAIASPQKQGSSGGEGEQSLNFFQRAAAAALDAFEEGFINNVLERPHALPRTADPAVQIAGNFAPVGEQPPVRALTVSGRIPPFINGVYARNGANPCFEPTAGHHLFDGDGMVHAIRIRNGAAESYACRFTETARLSQERAAGRPVFPKTIGELHGHSGIARLALFYARGACGLVDPSHGTGVANAGLVYFNGRLLAMSEDDLPYQVRVTAGGDLETVGRYDFDGQLDCAMIAHPKLDPVSGELFALSYDVIKKPYLKYFYFHADGTKSADVEIELDQPTMIHDFAITENFVVVPDHQMVFKLAEMFRGGSPVMLDKEKTSRFGVLPKYAKDSSEMMWVDVPDCFCFHLWNSWEEPETDEVVVIGSCMTPADSIFNDTDDHLESVLTEIRLNTRTGESTRRAILPLESQVNLEVGMVNRNMLGRKTRYAYLAVAEPWPKVSGFAKVDLVTGELTKFEYGEGRFGGEPCFVPMDGEHARPGAEDDGYVLSFVRDEDAGTSELLVVNAADMRLEATVQLPSRVPYGFHGTFIGDADLDAQH

SEQ ID NO: 4076 - protein, 315 aa, Cryptococcus neoformans
MASVKEGDYQALKEEIKKIMKQPGYDDGSAGPVLVRLAWHASGNFSLVEHNGGSNGAGMRFPPESVDPANAGLHYAISFLLPLQSANSWISHADLWTLAGVTAIEAMGGPQIPWEPGRLDYESEQAAVEHRGDVSNRLPDGALGAAHIRDVFGRMGFSDQEIVALSGAHNLGRCHADRSGFDGPWVVNPTRFSNQYFKLLLPGTRLMMLPTDMALIEDPSFRPWVEKYAADQNLFFKDFANAFGKLIELGVDRDDTGFARLAKKAAEEGKPLDKTAPPAGDETCPVSGAVGGGVQRAAGGGGCPFMAMQNREAKL

SEQ ID NO: 4077 - protein, 592 aa, Hordeum vulgare
MQTLTASSSVSSIQRHRPHPAGRRSSSVTFSARAVSSAPRAPAPSRFVRGADAAPAKPLIAVPKPPAVERQEKKLNFFQRAAATALDAFEEGFVANVLERPHGLSRTVDPAVQIAGNFAPVGETPPVQALPVTGRIPPFINGVYARNGANPHFDPVAGHHLFDGDGMVHALRIRNGVAETYASRFTETERLQQERALGRPMFPKAIGELHGHSGIARLALFYARAACGLIDPSRGTGVANAGLVYFNGHLLAMSEDDIPYHVRVTDDGDLQTVGRYDFDGQLECPMIAHPKLDPATGELHALSYDVIKKPYLKYFYFAADGTKSADVEIPLDQPTMIHDFAITENYVVVPDHQVVFKLQEMLRGGSPVVLDKEKTSRFGVLPKCAADASEMVWVDVPDCFCFHLWNAWEEEETDEVVVIGSCMTPADSIFNESDECLESVLTEIRLNTRTGESTRRPILALSEQVNLEVGMVNSNLLGRKTRYAYLAVAEPWPKVSGFAKVDLATGELTKFEYGEGRFGGEPCFVPMDPATSRGEDDGYILTFVHDEAAGTSELLVVNAADMRLEATIQLPSRVPYGFHGTFITGKELESQA

SEQ ID NO: 4078 - protein, 329 aa, Dechloromonas aromatica
MKITLLGAGAWGTALSIAFSGKHDLTLWSREVDVADDLRKTRENHRFFPGYKLPESVAVSTDFEVAVAGAELLVVATPIAGLRPTVERLQALGCKLPVLWVCKGFEAGSGKLPHQVVAEVLGKEALCGALSGPSFAEEVAAGQPTAVSLATNDPAFAREAARQLHTTRLRIYANDDLVGVEVGGAVKNVLAIATGVCDGLGLGLNSRAALMTRGLAEIARLGLALGAERQTFMGLAGMGDLILTCTGDLSRNRRVGLALAQNKSLPQILEELGHVAEGVYTAREVDRLAARLGVEMPISAAVAAVLDGRLTAAQAVEQLMARDPKEELA

SEQ ID NO: 4079 - protein, 319 aa, Streptococcus oralis
DINKEPGAEEKYKEVQEAYETLSDDQKRAAYDQYGAAGANGGFGGAGGFGGFDGAGGFGGFEDIFSSFFGGGGTSRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIYYKLNLNIVQATLGDTVDIPTVHGAVELVIPEGTQTGKKFRLRGKGAPSLRGGAVGDQYVTVNVVTPTGLNDRQKAALKEFA

SEQ ID NO: 4080 - protein, 71 aa, Rickettsia akari
MSKDDLIQFTGTILELLPNATFRVKLENDHGIIAHTSGRMRKNRIRILLGDKVTVEMTPYDLTKGRVIHRH

SEQ ID NO: 4081 - protein, 530 aa, Chromobacterium violaceum
MRIALAQFNPVVGDIVGNAQKIVDLANAALAQGADILLTPELALTGYSPEDLLLRDSFYREVARGLDIIEQLDGITVIVGHPARIGNERFNAATVLRDGNRLGQYHKMLLPNYEVFDECRYFTPGAAPLVFEQNGVKVGVLICEDAWQLEPAAEAADAGAELLLSLNASPFHRDKIETRHQVMRYRVEETGLPLAYANLVGGQDELVFDGGSFALDKAGNVAAQAAAYDDELLLVDFAYGDFQPGRQAALPGAQESVYRALVVGVRDYIGKNGFPGALLGLSGGIDSALTLAVAVDALGADKVHAVMMPSRYTADISVTDSRDMIGRLGVKYDEIEIWPMYESFMAALAPSFAGLEMDTTEENLQARIRGTLLMALSNKSGKLVLTTGNKSEMTTGYCTLYGDMAGGFAVLKDVAKTLVFELCRWRNTVSDIIPERIITRPPSAELRPDQKDQDSLPPYEVLDAIMARYVEDNQSAADIIAAGFAEADVNRVVRLLKINEYKRRQAPVGPRVTQRGFGKDWRYPITNKFS

SEQ ID NO: 4082 - protein, 796 aa, Crocosphaera watsonii
MEIVKQLKQIVIILLVFAVVNLCLLSFQSYQMTKYGRVVNFSGIVRGASQKLVKNELSNYPKDQEIEKINAIIQGLIKGDKTLDLPLVKNKIFQVKISIVQEKWTDLKAEIIAFREGKSTKQQLLQISEDFWIVTNDATFASENTASSHIQSLRKLYLVLFLINLTVLTFVWKINKKISLNIKDRIRAEISLKSSEEKFQQLANNINEVFWMTDINFREIIYVSPAYEKIWGKTCESLYLDINQWKNSIYPQDVSFFDRVLENFLINQEGTFYLEYRILSSDNQIYWIHHRGFLIKNIENQAYRIAGIAEDITQKKNIEICLREELKQTILLQTITKKIRASLEIETILNNTAHILAIKMKIDSCLIYTYIGDDQFQLNLIGTNINKNIRHYDFLNQLDKDDSYLKRIIDEDKAVVINKIEEEPLLISNQHLLQAENIKSLLTIRTSYKQNINGVIELHQYDKIHNWQPKDIKLIEAVASQLGIAIAQANLLAENKKQLEKLNQQNIQLQEKSKQAEAANKAKTNFLANMSHEIRTPLNAILGFSDLLSQKIIDPENVNHLQSIIFSSNNLLALINDIFELIRLESGIVKVESETVNLTEIIRQIYYKFSEKANQKNIKLIVNLNKNIPDILEFDKLKLYQIINNLLSNAIKFTKLGSVKVDVWANYFQSDLKTRQENCSIVIRIKDTGIGISQEKQKIIFDRFTQVSQETNREYEGIGLGLTLTQKMIQLLEGNLKLESELEKGTTITVTLPHLNIIQLSNQKALNLITETQLTTQEQKNIGQQKKLVLSNYQNS

SEQ ID NO: 4083 - protein, 320 aa, Streptococcus oralis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGAVELVIPEGTQTGKKFRLRGKGAPSLRGGAVGDQYVTVKVVTPTGLNDRQKATLKEFAAAG

SEQ ID NO: 4084 - protein, 294 aa, Unknown
  Acinetobacter sp. ADP1
MFDSIAQDIPYHTLIDGSPVRLDLKRLDLIHPHISGNKFYKLKYNLIEAKKRGCDRILTFGGAFSNHIAASAYAAHHFDFKSIGIIRGQELAYRSLNATLKTAQHYGMQLEFMSREQYRQKDQSEFLHTLQSQYPSAFIIPEGGTNALAIQGSKEILSDTDRLNYDVICCAVGTGGTLAGLIEASHHGQYVIGFSALKGDFLHNDVQRHTNKTNWHILDDYCFGGYAKTSSELFDFIAGFEQKYQIPLEQVYTAKMLYGLLDLIQKNDFDQGTRILALHTGGLQGRRHDIGVTE

SEQ ID NO: 4085 - protein, 319 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAAGD

SEQ ID NO: 4086 - protein, 318 aa, Streptococcus oralis
KEPGAEEKYKEVQEAYETLSDDQKRAAYDQYGAAGANGGFGGAGGFGGFDGAGGFGGFEDIFSSFFGGGGTSRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIYYKLNLNIVQATLGDTVDIPTVHGAVELVIPEGTQTGKKFRLRGKGAPSLRGGAVGDQYVTVNVVTPTGLNDRQKAALKEFAAA

SEQ ID NO: 4087 - protein, 526 aa, Pediococcus pentosaceus
MKFTELGLDEDILKAVLDNGYDEPTPIQAETIPGVLEGKDIIGQAQTGTGKTAAFGLPILQNVDLDNPNIQAIIISPTRELAAQTQAEIFKLGKYKKAKVQVVYGGSDIRRQINALKSHPQIVVGTPGRLLDHIGRKTIRLDHVKTLVLDEADDMLDMGFLPDIEHIIEQTPSERQTLLFSATMPAPIKKIGVKFMTDPKQITVKSKELTADLVDQYYVRSKEFEKFDILTRVLDVQAPKLAVIFGRTKRRVDEVSKGLVTRGYNAAGIHGDLTQQRRMSILRQFREGQLDILVATDVAARGLDISGVTHVYNYDIPQDPESYVHRIGRTGRAGATGTSVTFVTNWEMDYLRDVEHLTKKRLLPMKPPTEEEAFAGRAAMAEQSIEELVQKTDVAKFEEQVDHLLEQHDAKTLVAALLNEVTKSDASEIKVKITPERPLPRKKGGNKGGKGGGGYRGGNHRGGNGRRSNGNSSNGGGRGGKWNNDRKGGGKSRFGRDDRNHNGGKRNDRNSGNKGGSNRQFVIKEK

SEQ ID NO: 4088 - protein, 94 aa, Oryza sativa
  misc_feature (25)..(25): Xaa can be any naturally occurring amino acid
  misc_feature (56)..(56): Xaa can be any naturally occurring amino acid
  misc_feature (81)..(81): Xaa can be any naturally occurring amino acid
  misc_feature (83)..(83): Xaa can be any naturally occurring amino acid
MATSSTAAATSVVARAGLARPVGLXEMRARRIKRVRCNYSKEAGTPAAAVKGAGAXLLAMAATAAPAMALVDERMSTEGTXLXLGLSNNHVGWI

SEQ ID NO: 4089 - protein, 210 aa, Francisella tularensis
MMKVTLYTTKYCPYSLRARIALAEKKMSTDIVEAGDLEPAMIKKITPNGVFPVLMEKDYSINNRKALLIYIDERFPAPSLLPNVVNERIKIRLSLDKIDNEWYPVLDQIRKHRSDQKMLESMFKDLKESLLAMEKAFTGSEFFISSGFTLADCYIAALIICLEAEGFIIDDEYGAIYEYKKRLFARDSVKKANIKGGAGESLLKTLRTHR

SEQ ID NO: 4090 - protein, 259 aa, Bacillus thuringiensis
MKVACIQMDIVFGDVEKNIENAKNKISEAMKERPDVIVLPELWTTGYDLTRLSEIADKDGLETKEKLIEWSKQYGVHIVGGSIAKQTKQGVTNTMYVVTNKGELVNEYSKVHLFQLMDEHKYLIAGNSTGEFKLDDVECAGTICYDIRFPEWMRVHTAKGAKVLFVVAEWPLVRLAHWRLLLQARAVENQCYVVACNRAGKDPNNEFAGHSLIVDPWGEVVVEANKEESILFGELTFEKIKEVRKGIPVFADRRPELYK

SEQ ID NO: 4091 - protein, 288 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCITCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGNGAPSLRGGAV

SEQ ID NO: 4092 - protein, 843 aa, Unknown
  Populus tremula x Populus alba
MAMAVAPQHRESSSSGSLNKHLADNGKYVRYTSEQVEALERVYAECPKPSSLRRQQLIRECPILANIEPKQIKVWFQNRRCREKQRKESSRLQTVNRKLTAMNKLLMEENDRLQKQVSQLVCENGFMQQQLQTAPAAADASCDSAVTTPQHSLRDANDPAGLLSLAEETLAEFLSKATGTAVDWVQMPGMKPGPDSVGIFAISQRCSGVAARACGLVSLEPTKLAEILKDRQSRFRDCRNLEPFTMFPAGNGGTIELLYRQIYAPTTLAPARDFWTLRYTISLENGSLVVCDRSLSGSGAGPNAAAAAQFVRAEMLPSGYLIRPCEGGGSIIHIVDHLNLQAWSVPEVLRPLYESSKAVAQKVTITALRHVRQIAHETSGEVVYGLGRQPAVLRTFSQRLSRGFNDAINGFNDDGWSLMNSDGAEDVIIAVNTTKNLISANNPAHSLSFLGGILCAKASMLLQNVPPAVLVRFLREHRSEWADFSVDAYSAASLKAGSYAYPGMRSMRFTGSQIIMPLGHTIEQEELLEVIRLEGHSFAQEDAFVSRDIHLLQICSGIDENAVGACSELVFAPIDEMFPDDAPLLPSGFRVIPLESKTKDAQEALTTNRTLDLTSSLEVGPVTNHASVDGSSCHLRSVLTIAFQFPFESNLQDNVATMARQYVRSVISSVQRVATAISPSGLNPALGPKLSAGSPEALTLAHWICQSYCYHLGAELLRSDSVGGDSVLKHLWHHPDAILCCSLEALPVFIFANQAGLDMLETTLVALQDITLDKIFDESGHKALFTDFAKVMQHVSACLPAGICMPTVWHNESDEQTVSCKELTAEHNTAHCIAFSSVNWTFL

SEQ ID NO: 4093 - protein, 112 aa, Yersinia pestis
MKKIDAIIKPFKLDDVREALAEVGITGMTVTEVKGFGRQKGHTELYRGAEYMVDFLPKVKIEIVVADDIVDTCVEAIMQTAHTGKIGDGKIFVFDVSRVVRIRTGEQDEEAI

SEQ ID NO: 4094 - protein, 531 aa, Geobacter sulfurreducens
MRRKPWLRPGSRSSRCFSRNRDSIFHTGYPSMANELVINTSSHETRIALIENGTIAELYIERSREKGIVGNIYKGRVVRVLPGMQAAFVDIGLEKAAFLYVADVFDAMEEFETFMEVNGEESDSERQVLHPLHPIEELLQEGQEILVQVSKEPIGTKGARITSHVSLPGRHLVYMPTVDHVGVSRRIEDEPERERLKEIVGKAKPAGGGFIVRTAAEGKTEEDLVADMNYLTKLWEEVVRRNEKAHAPCLIHADLDVTQKVIRDILTENVSRIVVDSRHEHDKIVQFISTFMPKMKYSMELYDDEEPIFDHFGLEVEISRALGRKVWLKSGGYIIIEQTEALTAIDVNTGRFVGKHNLEDTILKTNLEAVKEIAYQLRLRNIGGIIIIDFIDMEKEVNREKVFTALEEAMKADKSKTNILKISDLGLVEMTRKRVRESIGRMMCEPCPYCEGRGYVKSKTTVCHEIFRELRREMLDIRGSKVMLTVHPQVADLLYDEERRGLEELEKKFKKRITVRAKPGFHQEQFEIAIS

SEQ ID NO: 4095 - protein, 852 aa, Bacillus thuringiensis
MQITKRLINKTVLLLTLIVMLSSVFSFQNVKAVSNSKTTEVIIHYKEQSGNTKDWNLWIWGENSNGKSYEFTGEDEFGKYAKINIDGDYNRLGFIIRTNEWEKDGGDRWIENIKDGRAEVWILSSDEKVYNSKPSSDLSIQKATIDSFHEITVTTNVPFYIKEKKIEMEGIKIKSISPYDINSGDITNKVKIITEQKIDLKQTYKVKIENLADTNTEIGKVIRTEEFDKLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKRWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWNLNTPLAAELKANQKNAEKMKGIAHFNDNIRDGLKGSVFEEKENGFVNGKENMEDRIKKGITAGIDYDRNTSTYQDPEQVLTYVEAHDNHTLWDKLELTNPGDSEEARKQMHKLSSSILLTSQGIPFLHAGQEFMRTKYGDHNSYKSPDSINQMDWLRRAAFNNEVDYMKGLIELRKKYPAFRMTSAEQIKTHVSFIDAPKNTVAYTIEGNKNEYFTVAHNANKEAGEITLPSKGPWKVLVDGKQAGSKPLYVVHDNKIKVPALSSLVLKTEKPIK

SEQ ID NO: 4096 - protein, 254 aa, Legionella pneumophila
MNNVSMRELLEAGAHFGHRTRFWNPKMSEYIFGSRNKIHIINLEKTLPMLSDVTNYVSRLAANKAKILFVGTKRAAQDSIREHAKRCGMPYVDHRWLGGMLTNYKTVRQSIFRLKELKEMKEKGLFNDMIKKEALMLTRELEKLERSLGGIENMGGLPDALFVVDVGFEHIAVEEARRLRIPVIGVVDTNNSPDNIDYVIPGNDDSMRAVDIYVRCVADAILDGKNSNTVGRVSSDSEFVEVTSNSNEEEKSGE

SEQ ID NO: 4097 - protein, 367 aa, Salmonella enterica
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIR

SEQ ID NO: 4098 - protein, 419 aa, Bordetella pertussis
MSSIETYMQSVGEQARTASRAMMRATGAAKNQALLAMAEAILAQRAELQAANAKDVAAARANGLEAALLDRLTLSDRSIELMAEGLRQIAALPDPGGSITATSVRPNGMRVAQMRVPLGVIGIIYESRPNVTIDAAALCLKSGNATILRGGSEALHSNVALGRIVQAGLQAAGLPTAAVQVIDTTDRAAVGKLVTMTEHVDVIVPRGGKGLISRLAQEARVPLIKHLDGNCHVYVDAAADLAKAHDIAFNAKTYRYGVCGAMETLLVHADVAQRLLPALGQALREHGVELRGCARALQWLPEGKPADDADWATEYLGPILAVRVVDTIDEAMDHISRWGSGHTDAIVTENLSAAQRFQREVDSSSVYVNLPTCFADGFEYGLGAEIGISTNRLHARGPVGLEGLTTLKWVLNGEGQVRA

SEQ ID NO: 4099 - protein, 172 aa, Zea mays
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHSLSLIDASATPLLDGWSQRFAAHPAAKRVLPD

SEQ ID NO: 4100 - protein, 591 aa, Chlamydomonas eugametos
MAAKFVEGTLDVTLKSASDLREDMSVKLDAYCVVSCASTAHRSNTVTDAGKTMNWEQTFHFDKVASTSVLKLESSMRRTPSDRSSCACKIPLTRACTSGSDEVCVPVLDKKGKPIGETHVSMTFKATSMADGPTKGNWILPTYANKDCWKDYEQGKVVGKGSFGTTYLVTKKDTQEQYAVKVISKRKLTTMEEVEDIQREVRIMHHLAGHPNVVQLKNVYEDKSYVYLVMDACMGGELFDAIVERGTYSEKDARALMRTIVSVVAHCHDMGVIHRDLKPENFLLLDKSANPVLKSIDFGLSSFYQEGQVFHDIVGSPFYVAPEVVRRSYGKEADIWSCGVILYILLCGYPPFHGDNETKIFEAIMNKSLDFQSDPWPKVSEPAKECIRRMLDRNPKTRASAQQTLEHEWMRENGVATEKRLEMEVLTSMKKFSAGNRLKKEAAKIIAANLPTDEICGLREMFIAIDVDHSGSITAEEFANALRMKGNSLPEDEVQRLVSNADVDGDGTCDYEEFLAATINQSKLEREDRLKIAFEHFDLDHDGSITHDELMQSLANLGINDAGIKEIIADVDRDGNGQIDYNEFCLMMRNL

SEQ ID NO: 4101 - protein, 256 aa, Brassica napus
  misc_feature (124)..(125): Xaa can be any naturally occurring amino acid
  misc_feature (180)..(180): Xaa can be any naturally occurring amino acid
VDPRVRADYCRERMHLALTEEILKEKPEFCDGDTWQEKWKRALFNSFMRVDFELDFVPETVGSTSVVAVVFPTHIFVSNCGDSRAVLCRGKTPLALSVDHKPDREDEAARIEAAGGKVIQWNGXXRVFGVLAMSRSIGDKYLKPSVIPDPDVTSIRRVKEDDCLILASDGLWDVMTNEEXVCDMARKRILLWHKKNAMAGDALLPAEKRGEGKDPAAMSAAEYLSKMALQRGSKDNISVIVVDLKGIRKFKSKALN

SEQ ID NO: 4102 - protein, 419 aa, Ralstonia eutropha
MHDEQPRGATANVPTSTIVIVGAGQAGGWAAQTLRNEGFTGRLVLIGDESHPPYERPPLSKAVLAGEAEPSSTQLLRPDAFEALGLEWWPDIPVNHIDRHAKRLEMTDGKTLAYDKLILCTGGRARTLTVPGADRARVHTLRTIGDALSLAQEFRPGRSVAVIGGGWIGLEVAATARQRGAEVTVIEAQGRLCERSVPPEISEHLLGLHATHGVHIRLGVHISGIARGADGRPALTLADGDTLTCDAIVAGVGLVPNDDLARDAGLDCDGGIIVDERCCTSDPDIFAAGDVAVTPNPWAGRRMRLESWQNAQEQGIAAARAALCLPVVYQPLPWFWSDQYDMNLQIYGVPLPSHRIVTRGMPGDNSFALFYLEDDVIKAALGANAARDLRFARRLIEQSKPVDVKRLADADVPMGKLSA

SEQ ID NO: 4103 - protein, 223 aa, Oryza sativa
MARRPARCYRYCKNKPYPKSRFNRGVPDPKIRIFDLGRKKASVDDFPMCVHLVSNEYEQLSSEALEAARICANKYLVKIAGKEGFHLRVRVHPFHVVRINKMLSCAGADRLQTGMRGAFGKPQGLVARVNIGQILLSVRTRDSNRAAAIEALRRSMYKFPGRQKIIVSKNWGFTPVRREEYVQLRQEGKLRQDGAYVQFLRGHGLIEENMKRFPEAYENVSQA

SEQ ID NO: 4104 - protein, 1003 aa, Coccidioides immitis
MAGHDDEEARIETVKDAVTDMKLERQSSTESVAPNGILDTITPKDEPNGHLSSKPSTPSLKPPKSRSRSSNSLAKDEVPEEKVGGDITIKQEPGQPPKLARSASQKLPPRAAPLFTDLPDKTTEATSTFQLMEVCTYANKYLGYTEHAMDCDCAEEWACGEDSDCINRATKMECFGDCGCGDSCQNQRFQRREYAKVSVIKTEKKGYGLRADCDLRPNEFIFEYIGEVINEPQFRRRMIQYDEEGIKHFYFMSLNKGEFVDATKKGNLGRFCNHSCNPNCYVDKWVVGEKLRMGIFAERYIKAGEELVFNYNVDRYGADPQPCYCGEPNCTGFIGGKTQTERATKLSHATIEALGIDDPDGWDTAVARRPRKKKAGEDDEEYVDSLQPKSLDENGVTKVMAALMQCKEKWIAVKLLGRIQRCEDERVRHRVVRMHGYQILNSQLNTWKDDFNVVLQILDILDKFPRLTRNKIIDSKIEGTVSPLQECDDERVAEKAKALLEIWSALEVGYRIPRMKRDPAAVNNTPTANHYERRETAKDDRKPNSSKSRSRSRSRSRSVDVTRNAPRGPAALTRGGGKGHMHSYRPGQRPFRRPFNPLPKGWFAAESNGRTYYYSATGETTWSRPTAPAVQPPPPPKRESKEKTLQDIIDGIMNAKENTPKAKDKSATPATPADAKIPEKKEHKEKWRSYSEEKQKKLYENTLFPHVKYIVDKFKHKLPKDDLKRYAKEVAKKLVNSDFKNNRVEDPTKISDKQVKQVKKYCKEYFDKAVAKHRAYEEKKAERKSKGSVKATTSATIDKAETTSTKAPPQFDGAAETGDEDSDVQLSDAEYEDGQEESSHHSGLKRKRTDDEDFENDHENGGVSPTKRQRSASLPIIPPPPPPMSPSNLVLDDGSREALKRQRTEGAEDDEYGDSTISSGKRQRSETPPPPPPPPPPADIPPENIESENENDKDQEELQDYDVQEANWGKEDNIAIQSPSHSPFPAQSISNHSNTARETDSHS

SEQ ID NO: 4105 - protein, 598 aa, Corynebacterium glutamicum
MNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 4106 - protein, 290 aa, Kluyveromyces lactis
MSAVLKSKLKVALVQLAGSSPDKSANLSRAAQFVAKAMDAQPDTKLVVLPEFFNAPYAVDKFREYAEVITPDATSVKALSEIARKWKVTLVGGSIPELEPSTDKIYNTSLIFNEDGEIIGTHRKAHLFDIDIPNGITFKESVTLSGGNKNTLIDDPKIGKFGVGICYDMRFPELAMVSARKGAFAMIYPSAFNTTTGPMHWHLLARSRSIDNEIYTILCSPARSGGSGYQAYGHSLVVNPRGEIIAEAGEGEEIVYAELDPQLIKEVRQAIPVTFQRRFDIYPDVSKTDK

SEQ ID NO: 4107 - protein, 432 aa, Kineococcus radiotolerans
MTLAPVQPAGTTVEEAVLAVCRRAKVASRPLRLASRATKDAALHAIADAIEAATERIVTANGEDLARGAADGTSPHLLDRLRLDPQRVAAVAAAVREVAALPDPVGEVVRGSTLPNGLRLRQLRVPMGVLGVVYEARPNVTVDVAVLALKSGNAVVLRGGSAAQSSNTVLVEVVRGALESVGLPADAVTSIDEHGRDGVGALLTARGLVDLLVPRGGADLIQRVVREATVPVIETGVGNCHVYVDASADLAQAVEIVLNAKTSRPSVCNAAETVLVHSALAADFLPTLLRALHEAGVVLHADATSLAAARAAGLPAQPVTDEDWAAEFHGLEIAVGVVDSVQDAVEHIARWTSAHTEAVLATDVRVTDYFCAAVDSAVVAVNASTRFTDGGEFGLGAEVGISTQKLHARGPMGLAELTTTTWQVLGDGHVRV

SEQ ID NO: 4108 - protein, 382 aa, Kineococcus radiotolerans
MSTPSTVTRREDLARAGRVVVKVGSSSLTTAVGGLDAARLGALVDVLAARRAGGGEVVLVSSGAIAAGLAPLGLRKRPRDLASQQAAASVGQGLLLAEYARAFARAGLTVGQVLLTAEDVVRRTHYGNAQRTLERLLSLGVVPVVNENDTVATHEIRFGDNDRLAALVAHLVRADALVLLSDVDALYDAPPSTPGASRLATVRGPEDLGGVTVGSAGAAGVGTGGMATKVEAAGIAVAAGVPALVTSAALAGDALAGADVGTWFPVTATGRARRSTRQLWLAHAAAPAGRLVLDEGAVRAVRQARSSLLPAGVVGLSGRFRAGDPVDLVDGNGHALARGLVNYSSEELPDLLGRSTRELARQWGPAYEREVVHRDHLVLLGR

SEQ ID NO: 4109 - protein, 322 aa, Agrobacterium tumefaciens
MPEARKPGRGRVYSSITETIGDTPIVRLDKLAKEKGVKANLLAKLEFFNPIGSVKDRIGVAMIEALEAQGKITPGKTTLVEPTSGNTGIALAFAAAAKGYKLILTMPETMSVERRKMLALLGAELVLTEGPKGMKGAIAKAQELAETLPDAVIPQQFENPANPDIHRRTTAEEIWNDTDGTVDILVSGIGTGGTITGTGQVLKSRKPEVKVIAVEPADSPVLSGGNPGPHKIQGIGAGFAPAILDTGVYDEIVTVTNDEAFEIARLAARLEGVPVGISSGAALAAAIKVGAREENAGKNIVVIIPSFAERYLSTALFEGLGL

SEQ ID NO: 4110 - protein, 319 aa, Triticum aestivum
  misc_feature (63)..(63): Xaa can be any naturally occurring amino acid
MAEHLASIFGTEKDRVNCPFYFKIGACRHGDRCSRLHNRPTTSPTIVLANMYQRPDMITPGVXDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGYRGGDGGDGGGYCGGGGGGYRGGDGGGYRGGGGGGYPGGGGRHDRYDDGPRRRYGGSPPRRGRSPPARENSEERRAKIEQWNREREEK

SEQ ID NO: 4111 - protein, 149 aa, Clostridium acetobutylicum
MALIMNSKKKIALVAHDNRKKALISWCEANSEVLSNHSLCGTGTTAKLIKEATGLEVFPYKSGPMGGDQQIGAAIVNEDIDFMIFFWDPLTAQPHDPDVKALLRISVLYDIPIAMNESTAEFLIKSPIMKEQHERHIIDYYQKIRKDNF

SEQ ID NO: 4112 - protein, 319 aa, Streptococcus oralis
NKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 4113 - protein, 451 aa, Unknown
  Candidatus Desulfococcus oleovorans Hxd3
MSVIKSVIDKVKHMDPDQKEFHQAVIEVMETLEPTAERHPEFVKNGIYERIVEPERAVQFRVPWVDDKGQVQVNRGFRVQFNNAIGPFKGGIRFHPSVNLGIIKFLGFEQIFKNSLTTLAMGGGKGGSDFDPKGKSDGEIMRFCQAFMRELFRHIGPETDVPAGDIGVGGREIGYMYGYYKKIRNEHTGVLTGKGLEYGGSLIRPEATGYGTVYFASEMLATRGLDFKGKRVAVSGAGNVAQYAIEKVNEMGGTVISVCDSGATIIDEAGIDNDKCCYLMELKNVRRGRVNEYADQYKTVCVESKNVWDVIREQGIKVDVALPCATQNEIDGANAEALVKNGCICVAEGANMPSSPEAVRIFQANNVLYGPGKAANAGGVATSGLEMSQNSSKLSWTREEVDSRLLLIMKGIHKSCLDAAEAYGKKGDYVTGANIAGFVKVAKAMLAYGIV

SEQ ID NO: 4114 - protein, 317 aa, Streptococcus oralis
EPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 4115 - protein, 1280 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 4116 - protein, 203 aa, Zea mays
YCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGTCARVDIGQVLLSVRCKESNANHAEEALRRAKFKFPGRQKIIRSRKWGFTKFTRAEYLKYKSEGRIAPDGVNAKLLGVHGPLSKRAPGKAFLAENIQASA

SEQ ID NO: 4117 - protein, 328 aa, Streptococcus oralis
LSKKYHPDINKDPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 4118 - protein, 286 aa, Streptococcus oralis
AAGANGGFGGAGGFGGFDGAGGFGGFEDIFSSFFGGGGASRNPNAPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAA

SEQ ID NO: 4119 - protein, 327 aa, Streptococcus pneumoniae
LSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAT

SEQ ID NO: 4120 - protein, 223 aa, Oryza sativa
  misc_feature (50)..(50): Xaa can be any naturally occurring amino acid
  misc_feature (115)..(115): Xaa can be any naturally occurring amino acid
  misc_feature (124)..(124): Xaa can be any naturally occurring amino acid
MALVEDNNAVAVSFSEEQEALVLKSWAILKKDSANIALRFFLKIFEVAPXSASQMFSFLRNSDVPLEKNPKLKTHAMSVFVMTCEAAAQLRKAGKVTVRDTTLKRLGATHLKYGXVGDAHFEVXKFALLDTIKEEVPADMWSPAMKSAWSEAYDHLVAAIKQEMKPAGVIDRHASCSTSMILASRVRLAFVAFKCSFHIHRVPQKKECVCGVRLVHAPAVFFS

SEQ ID NO: 4121 - protein, 659 aa, Arabidopsis thaliana
MSSLFPFIFLFLFSFLTSFRASAQDPRFLAYYCPNATTYSSNSTYLTNLKTLLSSLSSRNASYSTGFQNATVGQALDRVTGLFLCRGDVSPEVCRNCVTFAVNNTFSRCPNQREAVFYYEECILRYSHKNILSTAITNEGEFILRNPNHISPIQNQINQFTNLVLSNMNQIAIEAADNPRKFSTIKTELTALQTFYGLVQCTPDLSRQNCMNCLTSSINRMPFSRIGARQFWPSCNSRYELYDFYNETAIGTPPPPLPPLASPSLSDKSGNSNVVVVAVVVPIIVAVLIFIAGYCFFAKRAKKTYGTTPALDEDDKTTIESLQLDYRAIQAATNDFSENNKIGRGGFGDVYKGTFSNGTEVAVKRLSKTSEQGDTEFKNEVVVVANLRHKNLVRILGFSIEREERILVYEYVENKSLDNFLFDPAKKGQLYWTQRYHIIGGIARGILYLHQDSRLTIIHRDLKASNILLDADMNPKIADFGMARIFGMDQTQQNTSRIVGTYGYMSPEYAMRGQFSMKSDVYSFGVLVLEIISGRKNNSFIETDDAQDLVTHAWRLWRNGTALDLVDPFIADSCRKSEVVRCTHIGLLCVQEDPVKRPAMSTISVMLTSNTMALPAPQQPGFFVRSRPGTNRLDSDQSTTNKSVTVSIDDKSMSDLDPR

SEQ ID NO: 4122 - protein, 172 aa, Zea mays
AANPVYGKIPVLLLPDGRAICESAVIIQCIEDVARGSGGAEASSLLLPDDPYERAMHRFWTAFIDDKFWPALDAVSLAPTPGARAQAVEDTRAALSLLEVAFKDRSNGRAFFSGGDAAPGLLDLALGCFLPALRACERLHGLSLIDASATPLLDGWSQRFAAHPAAKRVLPD

SEQ ID NO: 4123 - protein, 127 aa, Francisella tularensis
MRFAHVMLRVKDLDKSIDFYTNVLGMTVQKKIDNTEYKYTLAFLGYGDISSHTVLELTYNWGEHEYDHSNAFGHLCMQVEDVYKACDDVKAKGGVVTREAGPVKGGTQIIAFIKDPDGYQIELIEKA

SEQ ID NO: 4124 - protein, 483 aa, Mycobacterium avium
MRAEVTAFDLPVTGRIPDHLDGRYLRNGPNPVAEVDPATYHWFSGDGMVHGVALRDGRARWYRNRWVRTAHVCAALGEPAPGGLDPRAGMLSVGPNTNVLGHAGQTLALVEGGGANYRLTEDLDTVGTCDFDGTLFGGYTAHPHRDPRTGELHAVSYSFGRGRRVQYSVIDTAGRARRTVDIEVSGSPMMHDFSLTDEYVVIYDLPVTFDPVQVMPADVPRWLSAPARLVVQSLLGRVQLPGPMATAMNRNRQPLHRMPYRWNDAYPARLGVMPRDGGNDEVRWFDIEPCYVYHPLNAYSEIRDGAKVLVLDVVRYSRMFDRDLRGPGDTRPTLDRWTVNLTTGAVGSELRDDRSQEFPRINEALLGRRHRFGYTVGTDGGYPSDGASEMSTGLYKHDYATGSRRVAPLDPDLLIGEMCFVPNPAGGQDGAEDDGILMGFGYHRGRDEGQLVLLDAQSLEQVATVHLPQRVPMGFHGNWVPAG

SEQ ID NO: 4125 - protein, 172 aa, Zea mays
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHGLSLIDASATPLLDGWSQHFAAHPAAKRVLPD

SEQ ID NO: 4126 - protein, 369 aa, Corynebacterium glutamicum
MRERISNAKRVVVKIGSSSLTNDEDGHTVDPNRINTIVNALQARMEAGSDLIVVSSGAVAAGMAPLGLSTRPTELAVKQAAAAVGQVHLMHQWGRSFARYGRPIGQVLLTAADAGKRDRARNAQRTIDKLRILGAVPIVNENDTVATTGVNFGDNDRLAAIVAHLVSADALVLLSDVDGLFDKNPTDPTAKFISEVRDGNDLKGVIAGDGGKVGTGGMASKVSAARLASRSGVPVLLTSAANIGPALEDAQVGTVFHPKDNRLSAWKFWALYAADTAGKIRLDDGAVEAVTSGGKSLLAVGITEIIGDFQQGEIVEILGPAGQIIGRGEVSYDSDTLQSMVGMQTQDLPDGMQRPVVHADYLSNYASRA

SEQ ID NO: 4127 - protein, 172 aa, Zea mays
AANPVYGKIPVLLLPDGRAICESAVIVQYIEDVTRESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACGRLHGLSLIDASATPLLDGWSQRFAAHPAAKRVLPD

SEQ ID NO: 4128 - protein, 271 aa, Zea mays
MTTARLVSTSPTRLPSTSASPIHRTSLCAVGRAPAFSARPLGFSLRLKPSPAMAAAGVGGNGPPTAHGDSIGSSRIGEVKRVTKETNVHVKINLDGTGVAECSTGIPFLDHMLDQLASHGLFDVYVKATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 4129 - protein, 468 aa, Salmonella enterica
MSKQQIGVVGMAVMGRNLALNIENRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 4130 - protein, 371 aa, Nicotiana tabacum
MSTSSHKHNTPQMAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFTDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 4131 - protein, 478 aa, Clostridium perfringens
MKFNELNLSEDIIKALNNLGYKNPSEVQEASIPKLLKGEDIIVKSQTGSGKTASFGIPVCEKINIEEKKVQCLVLTPTRELAIQVKDELSNIGRIKKVRCAAIFGKQPFNEQIRELKQRVHIVVGTPGRVFDHMERGTLDLSEVNYVVIDEADKMLSMGFIDQIKDILGELRLNKTTALFSATFSKEIEEICEEYMRNPMLLEVKSKVFNRDRIEESAIEIEEKNKGKALWKCLYAYHPESAIVFCNTRNKVKSVYKMLKDEGITCNELHGDMEQKKRIEVMENFRDKHFKVLVCTDIAARGIHVDSIELVINYEVPMETESYVHRIGRTGRAGREGKAITFVNHYEKKYLENVEEYIGYEIRKASLPSDEEVKAGRKIFKESQKVQLKESKKPKKEVHGDIVKIHVNGGKKKKIRAFDIVGCFSNLPGLTGEDIGIIDVQDGFSYVDILNGKGDKVLKSFKEVTIKGKKVKIQKARK

SEQ ID NO: 4132 - protein, 339 aa, Nicotiana tabacum
MAHLIVTLLLLSVLTLATLDFTGAQAGVCYGRQGNGLPSPADVVSLCNRNNIRRMRIYDPDQPTLEALRGSNIELMLGVPNPDLENVAASQANADTWVQNNVRNYGNVKFRYIAVGNEVSPLNENSKYVPVLLNAMRNIQTAISGAGLGNQIKVSTAIETGLTTDTSPPSNGRFKDDVRQFIEPIINFLVTNRAPLLVNLYPYFAIANNADIKLEYALFTSSEVVVNDNGRGYRNLFDAILDATYSALEKASGSSLEIVVSESGWPSAGAGQLTSIDNARTYNNNLISHVKGGSPKRPSGPIETYVFALFDEDQKDPEIEKHFGLFSANMQPKYQISFN

SEQ ID NO: 4133 - protein, 172 aa, Bacillus halodurans
MKGRPIKEFSLVMDLSQAKKGADKMGYMEDLRKRVGTRPLILPASVVIILNEQDEILLQKRLDGRWGLPGGLMELGESFEETAKREILEETGLTIKNVTFLDVFSGKDLYVKVENGDEFYAVTALFMTREVAGGIQMDPRESLDLQYIALDQFPPNVTRTSKIFLDRFMELK

SEQ ID NO: 4134 - protein, 269 aa, Clostridium perfringens
MRKALKDSKRIVVKVGTSTLTYENGSVNLMRIEKLSRVISDICNMGKEVVLVSSGAIGVGVGKLRLEKKPETIREKQAVAAVGQCALMHIYNKFFGEYSHVVAQVLLTRDVLENERMKNNVCNTFDTLLEKGIIPIVNENDAISIDEIQNILNFGDNDNLSAIVSTLVNADTLIILSDIDGFYDSDPRTNEDSKMLKEVYEITPEIEECAGGAGSNRGTGGMVTKLSAAKVATSNGIDMILANGENPEILINILNGEDIGTMFVAKKGE

SEQ ID NO: 4135 - protein, 260 aa, Pediococcus pentosaceus
MSVISMKQLLEAGVHFGHQTRRWNPKMKPFIFTERNGIYIIDLQKTVKLIDNAYNFVKDVAANDGVVLFVGTKKQAQTAIEEEAKRAGQYFVNHRWLGGTLTNWNTIQKRIKRLKDLKAMEEDGTFDRLPKKEVALLNKQKDKLEKFLGGIEDMPHTPDVLFVVDPRKEQIAIKEAQKLNIPVVAMVDTNSDPDQVDVIIPSNDDAIRAVRLITAKMADAVIEGRQGEDEEEASQEVAEGVSKDSLEDLKKSVEEGSNEE

SEQ ID NO: 4136 - protein, 441 aa, Arabidopsis thaliana
  misc_feature (276)..(276): Xaa can be any naturally occurring amino acid
MASNNVYSVLRSLLLLLHPVFLGQHHVGSATIVKSLPGFEGPLPFELETGYIGVGEEEEVQLFYYFIKSERNPKEDPLLLWLSGGPGCSSISGLLFENGPLAMKLDVYNGTLPSLVSTTYSWTKASSMIFLDQPVGAGFSYSRTQLLNKPSDSGEAKRIHEFLQKWLGKHQEFSSNPFYVGGDSYSGLVVPATVQEISKGNCECCNRPINLQGYVLGNPLTDCVYDCNSRVPFAHGMALISDELYESLKRTCRGDYGNVHPRDTECLKFVEEFNKXTNSVCERRIIDPCCETETPSCYTYRFMLAAYWANDETVRKALQIKKESIGEWARCHRGIPYNHDIKSSVPYHMNNSIDGYRSLIYSGDHDIEVPFLGTQAWIRSLNYSVIDDWRPWMIKDQIAGYTRSYANKMTFATVRGGGHTAEFTPEEASMMFQRWIKGQPL

SEQ ID NO: 4137 - protein, 458 aa, Erwinia carotovora
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 4138 - protein, 728 aa, Francisella tularensis
MLLASSNAIAEDTKTKNDNLSPQSVDLSPLRNLNKLDSPMDKDYNYHQAFKKLDTEQLKKDMQDLLTQSQDWWPADFGNYGPFFIRLSWHDAGTYRIYDGRGGANRGQQRFSPLNSWPDNVNLDKARQLLWPIKQKYGDAVSWSDLIVLAGTVSLESMGMKPIGFAFGREDDWQGDDTNWGLSPEEIMSSNVRDGKLAPAYAATQMGLIYVNPEGPDGKPDIKGAASEIRQAFRAMGMTDKETVALIAGGHTFGKTHGAVPEDKVKQAIGPAPDKAPIEQQGLGWHNSYGTGNGDDTMGSGLEGSWTSTPTFWNHDFLHNLYNLDWKKTLSPAGAHQWTPTNAKPENMVPDAHKLGVKHKPIMFTTDLALKEDDGFNKYTQEFYNNPEEFKEEFAKAWFKLTHRDMGPKSRYIGPWIPEQNFIWQDPVPAADYKQVSTQDIAQLEQDIINSGLTNQQLIKTAWDSASTYRKTDYRGGSNGARIALAPEKDWQMNEPAKLEVVLTKLKEIQTNFNNSKTDGTKVSLADLIVLGGNVGVEQAAKQAGYNIQMPFVPGRTDATQAQTDIESFNYLKTKSDGFINYTDGSISADKLPQTLVEKASMLDLNIPEMTVLVGGMRALDVNYDNSQEGVLTTTPGQLNNSFFVNLLDMSTQWKKSDKKDGEYIGIDRKTGKQKWTASPVDLIFGSNSELKAVAQVYAENGNEQKFVNDFAKAWHKVMMLGRFDVQQ

SEQ ID NO: 4139 - protein, 424 aa, Roseovarius nubinhibens
MSVEKIDTLVVGGGQAGIAMSEHLGRAGIPHVVLERDRIAERWRTGRWDSLVANGPAWHDRFPNMTYDNCEPEVFPGKDRVAEYFVQYAKMINAPVRCGVEVTRAQRLKGRPGFRVETSDGVFEARRVVCATGAFQRPIIPNVIPESAPVDQIHSFDYRNPDQLKPGAVLVVGAGASGSQIAEELIASGRKVYLSLGPHDRPPRRYRNRDFVWWLGVLGKWDLEAMAPGTEHVTVAFSGANGGNTVDFRRFAEAGCTLVGRTDSYAEGTLRFADDLVENIAAGDAFYHRMLDECDAYAEANGLDLPLDPEARKIGPDPDCLTHPVESLDLAEAGITTVLWATGFARDYDWLEIDTFDAQGAPLHQRGVSREQGVYFLGLPWQSRRGSSFIWGVWHDAKHVADHIATQRAYLDFHETAQAQTEPA

SEQ ID NO: 4140 - protein, 323 aa, Streptococcus pneumoniae
KYHPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFA

SEQ ID NO: 4141 - protein, 325 aa, Streptococcus pneumoniae
HPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAAGD

SEQ ID NO: 4142 - protein, 293 aa, Streptococcus pneumoniae
HPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKFPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGA

SEQ ID NO: 4143 - protein, 117 aa, Glycine max
  misc_feature (37)..(37): Xaa can be any naturally occurring amino acid
  misc_feature (80)..(80): Xaa can be any naturally occurring amino acid
MASSMIFSPADTTVNRAGAGMAGPFTGLKYMAGFPTXRKTNNDLTWIARHGGKRPCMHVWPTIGKKKFETLSYLPDLDDXPLAKEGQYPLKKGWDPLLGITLEHRFAYPEHKKAPGY

SEQ ID NO: 4144 - protein, 126 aa, Thiobacillus denitrificans
MQTHYDRLGGADTIRRLVDRFYDLMDEDPDYYGIRKLHPTDLTESRNKLAWFLSGWTGGPPEYTDRFGHPFLRRRHLPFVIGESERDQWMGCMIRAMQDVGLDAALQQELTAALFQTADFMRNQPQ

SEQ ID NO: 4145 - protein, 507 aa, Robiginitalea biformata
MKKKRLSFWEIWNMSFGFLGIQFGFALQNANTSRIFETLGAEIDQIPILWIAAPVTGLVVQPIIGYFSDRTWTRLGRRRPYFLAGAILASIALCIMPNSPALWVAAGMLWIMDASINVAMEPFRAFVGDNLPGDQRTLGFAMQSFFIGLGAVVGSVMPYVFTNWLGISNTAPEGVIPDSVKWSFYVGGVVFLTAVLWTVWRSREYSPEELEQFEENRDFPAPDLSPEENERRIARLRQYGIMFLAAGLLATAIPYYYNLQKELYVLTVGFALVGILFLAASAIRRRKGRNGFVTIMSDLLNMPDTMKQLAWVQFFSWFALFSMWIYTTQAVTGHVYGTRDTTSELYNDGADWVTVLFGVYNGVAAVVAFLLPVLARKTSRKITHLIALTLGGLGLMSVYFITDPDWLLLSMVGVGIAWASILSVPYAMLAGALPPKKMGYYMGVFNFFIVIPQMVAATILGFLVSGLFGGEPVYALVVGGLAMILSGLLTLRVRDRRAIDLAGMTKS

SEQ ID NO: 4146 - protein, 322 aa, Streptococcus acidominimus
PDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAA

SEQ ID NO: 4147 - protein, 725 aa, Treponema denticola
MTDFQKFLIGILAGIFIAVLVVVGILFFTKSKTSDSAAADTQILAKIEAEKEELARLQEKIAKKEAELEQAKKEAEKERELLEAESIKKAGEINKNLAAASEKEKKAAEEEKKRKAEEALKRAEEARKRQEELIKQQQALKEAEAKKKASIDEAKKIAAAKAEADRKARAEQERKAKEEAERKAKAEQERKAKLAAEQRAKDEAAKRTADAEREKKRLEEEAKKKAALDAQKAQEAERLAKQNADAKTRAQMEEVDRLVSEGVNFLKNGNLNSALSSFSKASSKMPDSETSFTAKKYLDMASALNDYASAREGTGDAEKALSDADSYIKKSVNADGQNARAHYVYSQIADAQKQPQVAFVELEKAQSLDPDNYLYNYELGKKYYARGHYQKAKTSFERSVKSNPKFDNAFFNLGMSCRKLGLENEAFSAFSSAVKIKPDYVKAFLEMARIRKAQRKFDQAIENYKKAISYEPTNLPALREMAQVYADLGQNNLAERHFTEAITLGEDDAITYYNLATVQVDLEKYGEALSNAEKAYRLKPSDARVLYTYGLTLEKNGRKSEAYDYYTQAAATNKNYAKPRINLGRMYLDEGKFGEAEDNLLAAYRLEPNNFEVNTNLGKLYGLKGDYTKSVNHYSNAVKTQPRNITAKQNLAAAYISADLKENAVSVYEQIIKVDTKNWDAYYELGKLYISLNKKADAKLILEGVLNKNPNYPKAAEIRSILSSL

SEQ ID NO: 4148 - protein, 464 aa, Robiginitalea biformata
MEDASNTAIDTPVPDWLQWSNLYEVNLRQYTPEGTFAAFRNHLPRLRDMGVDILWFMPVQPVSRERRKGPMGSPYALSDYLATNPDFGSFEEFCQLVEEIHRLGMRVILDWVPNHTGWDHSWIREHPDWYIRGDSGKIIDPVNPVTGESWGWTDVAALDYGNPEMRQAMIDAMTYWVRESGIDGFRADVAHGVPVDFWEECTRTLYAIRPLFMLAEAEDSELVNSGYFTADYGWDMHHLFNEIAKSLGGAAGGRQLDQGNIAASPGEDSTATADALEIDRQLSRQAERYRRGLKMYFTSNHDENAWAGTEFRRMGAAHLVFAVIAATLRGIPLVYSGQEAAMDRQLAFFEKDEISWGDYPYTDFYKALNELRHRNRALWNTEGGGRVVKIPTGVDRWVYAFTRGFETDRVVVVLNLSTHPREAVLGGLGYSGEYKRIFGGQSGFLGPGDTLVLEPLEYRVYSNR

SEQ ID NO: 4149 - protein, 323 aa, Streptococcus pneumoniae
HPDINKDPGAEDKYKEVQEAYETLSDDQKRAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAAA

SEQ ID NO: 4150 - protein, 185 aa, Thiobacillus denitrificans
MTPHEAQQLLHDAECVATAERVQAALDRLAGEIGEALSSEMPLVLAVMGGAVVFAGQLLTRLAFPLEFDYLHVTRYRGKTRGGEIEWRVLPGKSVAGRAVLVLDDILDEGETLAAVRAKLLEMGAARVWSAVLTDKANGLVKPVRADFVGLEVPDRYVFGCGMDAYGLWRNLPAIYALSPDAASG

SEQ ID NO: 4151 - protein, 959 aa, Sinorhizobium meliloti
MSLIHEIDYGTPASKSEKLVTLTIDGREITVPEGTSIMRAAMEAGIEVPKLCASDMMDAFGSCRLCLVEIDGRAGMPASCTTPVAAGISVSTQTQRLKDVRRGVMELYISDHPLDCLTCAANGDCELQDLAGAVGLRDVRYGYDGENHVTARNNGEINAKWAPKDESNPYFTYDSAKCIVCSRCVRACEEVQGTFALTISGRGFDSRVSAGMNEDFVSSECVSCGACVQACPTATLTEKSVIEIGQPEHSVVTTCAYCGVGCSFKAEMRGEELVRMVPWKDGQANRGHSCVKGRFAYGYSNHRDRILNPMVREKVTDPWREVTWEEAFAHVASEFRRIQYQYGRDSVGGITSSRCTNEETFLVQKLVRAGFGNNNVDTCARVCHSPTGYGLNQTFGTSAGTQDFDSVEHTDVAVIIGANPTDGHPVFASRLKKRLRQGAKLIVIDPRRIDLVRSAHVEASYHLPLKPGTNVAILTAIAHVIVTEGLANEAFIRERCDWSEFEDWAAFVAEPHHSPEATEAYTGVPPELVRGAARLYATGGNGAIYYGLGVTEHSQGSTTVMAIANLAMLTGNIGRPGVGVNPLRGQNNVQGSCDMGSFPHELPGYRHISDDATREIFEKLWGVTLNHEPGLRIPNMLDAAVEGTFKGLYVQGEDILQSDPDTKHVAAGLAAMECVVVHDLFLNETANYAHVFLPGSTFLEKDGTFTNAERRINRVRRVMRPKNGYADWEVTQKMAQAMGLAWNYRHPSDIMDEIAATTPSFAMVSYDYLDKMGSVQWPCNEKAPLGSPIMHVDGFVRGKGKFIRTEYVATDERTGPRFPLLLTTGRILSQYNVGAQTRRTENVVWHAEDRLEIHPHDAEQRGIRDGDWVRLASRSGDTTLRALITDRVAPGVVYTTFHHPSTQANVITTDFTDWATNCPEYKVTAVQVSPSNGPSDWQRDYDEQARQSRRIAGKLEAAE

SEQ ID NO: 4152 - protein, 1284 aa, Ralstonia eutropha
MISKPNPPAGFWLRSSLLAYGALLILAVWLVAFAAMSMVRQNEQVSVGARLGATVNTTARQLETWASEQRRRAVSMSTLDDTVRLARPLLANGADPSPERVQEFVNWITPLYRSNGYIGYGLISMDNRIIVSDLVERNGQPLQPEAAAAALRARENGASLSAPYPGPVLADGPVGPVDRSPFQIVCSRLWDNDRVVGALCLRIDPYAVMLQILKAARFGNTGELYVIDRDGRLNSPSRFDESLVGQGLLSPGDASMFNLRVRVPHDLGDGRWRVDDDAPLTRMAQQVLHSETLQVSFGYQDYRGKRVAGAGLWIPALGSALILEQDMEEALSSYLSTRTVVASMAAAIMLLIGVAAWALRKSQHRLAQSEERLRALLDHSPAIMHLKDRNHAFLQLNPSMEKLLGLTRDQVLGKTDRELAVMPDGTRERWEIEARVMATGRAEEQIYAMEAPEGSRQLRVIRFPVHDPTSNAVVGVGAVGIDITDQERANRELKEMSQTLEHKVWERTRELAVANAELAKAKHEAESAAQAKASFLANMSHEIRTPMNAVIGMAHLALSTQLDPQQRDYVEKIQRSGQHLLGILNDILDLSKIEAGKLEIEQIDFSLERLLRTVGDLVSERAAAKQLELVVDVQPDVPDSLRGDPLRIRQVLINFTTNAVKFTERGEIVIRVARCAGEHAESRVRLHFEVRDTGIGIDADAIPRLFRSFEQADSSTTRRYGGSGLGLAISHRLVTLTGGTIGVQSELGKGSTFWFELSLLPGTRRAPALLVQPELAGRRLLVVDDHGYARQVIGSMLRGFGFRADEVESGEKALSAIQHADAIADPYHAVFIDWRMPGLDGIQTVRKLAAMSLQSQRPRPLMITANGREEVVREGERNGFETTLHKPVSPSVLFDATMRVLASEPGRMADKGAPRSVTGPSWTLPHARVLLVEDNEINREVATHLLQQAGITPDTAENGAIALELLAVQDYDLVLMDMQMPVMDGFEATRHIRANPRLASMPVVAMTANALPEDRNRCLAAGMDDHIAKPISPATFFTTLHRWLTGAPARTGGNLHDAAWHENVANPVAEIIEVVEPEAEEEEAAPDWMRALAGTGLLDVDGAVARVGGRIDTFRQLLGRLLSGYAQTPQQIGALLQAGERVEAARLAHALAGLAGNLGARQVAGAAASLECTLMGMAADDASALLNGLEQAHASLCMALRQHLPAETPEPAAPVATQVTSMTDVLDRLRRQLADGASEASLTFAANRQRLADMLAGDRFRRLCEAVENYDYESAVEVLADSAG

SEQ ID NO: 4153 - protein, 295 aa, Treponema denticola
MSKIIIALLQLTPGNSLVENMYIGIAACRKAKNMGADIALFPEMWSIGYEIPKSVNELKSKAISKNDAFIHSFSDLAKELQMAIGITFLEKYEPLPRNSICLFDRFGKELYTYAKVHTCIFGDEKNLMPGNDFYVSELDTERGCVKIGSMICYDREFPESARILMLKGAEILLVPNACPMEINRISQLRARAFENMVGIATVNYPKGKPDCNGHSTAFDGIAYEIDEPYSRDTLIIEAGEEEGIYIATFNIEELRKYRSREVHGNAYRQPTKYEILLSEEKQEPFIRKDYGKSAN

SEQ ID NO: 4154 - protein, 166 aa, Bordetella pertussis
MNTMYDFSAPTITGAERALADFRGQVALVVNVASRCGFTPQYSGLEELYRSYRNEGFVVLGFPCNQFGRQEPGDEAAIAQFCETQYAISFPLFAKIDVNGAHAHPLYRWLKARKPGLLGTRAIKWNFTKFLVGRDGLPLRRYAPAHTPESLRHDIARACAAPGPTP

SEQ ID NO: 4155 - protein, 217 aa, Corynebacterium glutamicum
MAWFFAPEPVMVTADEALKGGRHPVLENPAPHTVLGTPVTGPWKEGQQRIWIGLGCFWGVEQMYWQMDGVEGTSVGYAGGFTPNPTYREVCSGRTGHTEIVEVVYDPSKISLEQLVARGLEAHDPTQGFRQGNDVGTQYRSAYYTENEEDAARVKAVVDAYGETLKQHGFGEITTEIGVISPSDYFLAEDYHQQYLDKNPDGYCPHHSTGIPCGVEA

SEQ ID NO: 4156 - protein, 473 aa, Arabidopsis thaliana
MSSSVPNSDRKIVTGPAGYILEDVPHFSDDFPDHPTYPNPLQDNAAYSVVKQYFVDEDDTVPQKIVVHPDSPRGTHFRRAGPRQRVYFESDDVLACIVTCGGLCPGLNTVIREIVCGLSYMYGVKRILGIDGGYRGFYARNTIHLDLKTVNDIHRSGGTILGTSRGGHNTTKIVDSIQDRGINQVYIIGGDGSQKGAAAIFEEIRKRKLKVAVAGIPKTIDNDIPIIDRSFGFDTAVEEAQRAINAAHVEATSFENGIGLVKLMGRYSGFIAMHATLASRDVDCCLIPESPFFLEGSGGLFEFIDKRLKESGHMVIVIAEGAGQDLLSESMKESTTLKDASGNKLLQDIGLWISQRIKDHFAKKMTLTLKYIDPTYMIRAVPSNASDNVCCTLLAQSAVHGVVAGYNGFTVGLVNGRHTYIPFNRITEKQNKVVITDRMWARLLSSTNQPSFMKQADKIHSNQLVGEPGTMKW

SEQ ID NO: 4157 - protein, 461 aa, Magnetospirillum magnetotacticum
MMSLSLFRMPLPRALAWAALIIGAAIVVIDPLPGTEGRVLGLAVAFIGLWATAVIPEPMTAVFFFTTAMLLKAAPAGTVFGGFSSAALWLIFGGLIMGIAFRSTGLGERLGARLSHAFGSSYWGVISGVTLVGLALGFLMPSSMGRAIMLMPIAVGLAERYGFAPGTNGRIGVVLAAAFGCHVPTFSILPANLPNLVLVGAAETLWHYTPHYGEYFLLHFPILGFLKTAIMIPLIVWLWPDTPQPEAATRPLGPMKRQEGQLALLLACALVLWATDFLHHVSPAWISMAAGALLLLPGIGLVDRKAFNEQINYGSMFYVAAIMGLGAIVDQSGLGARLAHAVLDVLPLSPGHAATNFASLSVLSTLVSLLTTLPGAPAVLTPMAGQMAEASGMSVEAVLMSQVLGFSNPIMPYQSAPMVVAMQLGGERLGPAQTLCLWLAGITILVLLPLDFLWWRLLGWI

SEQ ID NO: 4158 - protein, 331 aa, Clostridium perfringens
MSKVAFLGAGSFGTSLGILLGNKGVTVSLWDRDENVINDINVNRKNDKYIKDLTIPTNVTAYKDLDEALNGAEYVVLAVPSHVIRTACKNLKGKINDDVIIINIAKGIEEGTNLRLSQVINQELPNNKVVVLSGPSHAEEVSKGIPTTLVASSECMECAEKVQDLFMDKNFRIYTNDDIIGVEIGGAVKNIIALAAGVCDGIGYGDNSKAALMTRGMAEIARIGIKMGGKAETFFGLTGMGDLIVTCTSMHSRNRRAGILIGQGKTAEEAIEEVGMVVEGIKACKAFYELKEKEGVTMPITDIAYKVLFEGAKAENAVSLLMERDKKKEEI

SEQ ID NO: 4159 - protein, 258 aa, Pseudendoclonium akinetum
MITKLKPYLQMTLTLEQMVAAGMHFGHQARKWNPKMKPFIYAQKDSIHIIDLISTYTHLNEASKFLTDSVSIGQKILFVGTKKQVSQLIAKAALECDSFYVNGKWLGGQLTNWQTIKLSIQKLKSLETKERHGLLGKIPKKEAALLKKEKEKLGKYLDGIKNMASIPDIVIIIGQSEEINAVRECKKLGIRTITILDTDCDPSLADLFIPANDDSISSIKLLLGEFVTAIKKGQQNFAEKLLLSSDLKKQIKKQRSRR

SEQ ID NO: 4160 - protein, 802 aa, Rhodobacter sphaeroides
QPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKLVLKEKAPEAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSSDLSDTPIIFRPGTDRAILNYIAHHIISTGRVNRDFVDRHTNFALGATDIGYGLRPEHQLQLAAKGAADAGAMTPTDFETFAALVSEYTLEKAAEISGVEPALLEELAELYADPDRKWMSLWTMGFNQHVRGVWANHMVYNLHLLTGKISEPGNSPFSLTGQPFACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRAADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLHWPVVEGEETRWRYREGFDPYVKPGEGLRFYGKPDGRAVILGVPYEPPAESPDEEFGFWLVTGRVLEHWHSGSMTLRWPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 4161 - protein, 232 aa, Physcomitrella patens
MALQPRLSLSCLRGRSVDACAFAVPASASISASSDACVRIPCWNGASSSSKRLPFFGARVASASDPKSPNWRKRVSGVVQVHLEEYDFDDQSKDYQPSVDFYKVEAVLRPWRLSPVSSALLKMGIRGVTVTDVRGFGAQGGSRERQAGTEYAGDSYLKKVKLEIVVSKDQVEAVIDTIIDQARTGEIGDGKIFVSPVSDIIRIRTGERGLKAERMAGGRAAMQTSAEGSDGN

SEQ ID NO: 4162 - protein, 161 aa, Unknown
  Musa x paradisiaca
SSMMVSSAATVSRASPAQSSMVAPFTGLKSTSAFPVTRKANADLSHLPGNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 4163 - protein, 885 aa, Francisella tularensis
MKRILINSKSGEETRIATLDNGKLIDLDIESVDREQKKANIYKGYISRIEPSLNAIFVNYGEEKNGFLPFKEVSEYYLKDVPNGENIAPLLSEGQELIVQIDKEERGDKGAALTTFITLAGSYMVLLPNNPEGGGISRRVEGEDRERLKKYLKELNIPKNMSVIARTACVECSFEELKHDFDTLVELWGSISQAYHRIKKPALLHKESDIIVRTVRDHLKEDVKEIIVDSKECFEDVKRQLSLLRQSFDINKVKLYNEELPLFAQFGIDQQIENAYKREIRLPSGGSIVIDTTEALVAIDVNSSRANKAEDVETTAFKTNLEAAEEVARQLRIRDLGGLVIVDFIDMSFYPNRKQVEEKLMEALQQDRARIQMSRISKLGLVEISRQRLSSSINESVMQKCPRCEGHGFIKTTQATALTILRKIRAEAIKEDTNEIRVQVPVDIAAYILNEKRDSIVEIERISQVKVMIIPNFNMESPKFQMQRIWGTSYKSNRTSSELIEDVYNIEIPKAGKKKIAAVDLNQAIENQAASNTQEQKPQTDAQVDIVTQNDKKQDDVTQQAKKKGFFARLFSGIFATDSKAAQQANNSAQKQQNKEQNFQRQQQHNKAQKDNNQRNERNNSNNKNERNKNRNNKGAKPQIAQENKPQKDNSQRSDLNANGNSNNDKNERNKNKSNYDKFDKKSNNRNSRSNNLNLNNAEEVIDITQLKYQNQTAIAKTDNIKKVISKNPDEFISVMVKDVLENYDSLKDDGATKIATQEKIKTNKYLKFDTVSVDTEIALLNEVAKSNQTVGVEQITAETEESLSIVDKVDDITIPEVVVEQEKPAKVVKETNQTSEAKPKKEKQTTTKNNKKEKPAEKEMKQNQAKPEYINYSPAIDFESQALI

SEQ ID NO: 4164 - protein, 161 aa, Unknown
  Musa x paradisiaca
SSMMVSSAATFTRVSPAQSSMVAPFTGLKSASAFPVTRKPNADLSHLPSNGGRVQCMKVWPIEGLKKLETLSYLPTLKDEALLKQIEYLLRSKWIPCLEFSHEGFVGRENHRSPGYYDGRYWTMWKLPMFGCTDAVQVVKEVEECKKEYPKAFIRIIGFDN

SEQ ID NO: 4165 - protein, 305 aa, Ralstonia eutropha
MKADNILQTIGNTPHIRIRRLFGNGHEVWIKSERSNPGGSIKDRIALSMVEDAERRGVLKPGGTIVEPTSGNTGIGLAMVAAVKGYKLILVMPDSMSIERRRLMLAYGATFDLTPREKGMKGAIARAEELIASIPGAWMPQQFENPANIDVHARTTAQEILADFPEGLDALITGVGTGGHISGCAQVLKQKWPQLKVFAVEPTASPVISGGAPAPHPIQGIGAGFIPENLKTDLLDGVIQVDAEPAREMARRCAREEGILVGISSGATLAAIASKLPELPAGARVLGFNYDTGERYLTVEGFLPA

SEQ ID NO: 4166 - protein, 77 aa, Spinacia oleracea
MKEQKWIHEGLITESLPNGMFWVRLDNEDPILGYVSGRIRRSSIRILPGDRVKIEVSRYDSTRGRIIYRLRNKDSND

SEQ ID NO: 4167 - protein, 342 aa, Synechococcus elongatus
MTATASSASTETFSRADWLRGYESQTEERDYWIDDIEGEIPAELEGTVFRNGPGLLEIGGQSLHHPFDGDGMISAIAIRQGRAYFRNRYVRTEGFLAEQKAGKILYRGVFGTQKPGGWLANIFDLGLKNIANTNILYWGDRLLALWEAAEPHRLDPQTLETFGLDRLDGLLADGDPFSAHPRIDPGSERTGGQRRLVNFAVKTGPSSRIRLYEFDESGRCVEQQERVIPGFAFLHDFALTPNYAIFFQNPIRFNPLPALLGQRTAGQCLASDRNKSTQILVIPRDPKAPLQTFETESCFVFHHANAFETADGAIVVDSVCYDEFPMLEPDRNFKEVDFDLEG

SEQ ID NO: 4168 - protein, 95 aa, Brassica napus
  misc_feature (43)..(43): Xaa can be any naturally occurring amino acid
SENHLILISIFVGVTIVTKAKEPACFSSVIPGWFSEMSPKWPXATYGKVLVLDGVIQLTERDECACQEMITHLPLCSIPNPKRVSQSKTFALFYL

SEQ ID NO: 4169 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 4170 - protein, 528 aa, Glycine max
MEVAANARNPAAKRKFDDAVSNGVAAPADVDLSLLEAIEKSQNAVEALDLRALKKHVLSFERRLKDNIEARLKYPNQPDRFADSEVELHEELQKLKVLAGAPELYPDLVNLNVVPSIVDLLNHDNTDIAIDVVQLLQDLTDEDVLDDNDDSARVLVDALVDNSALELLVQNLHRLNDSDPDENAAVYGSLATVENMIEVKPAVAELVCEKTKLLKWLLGKIKVREFDSNKQYASEILAILLQSSTVNQKKLGQMNGVDVVLQAVAMYKSKDPKSSDEEEMLENLFDCLCCLLMPLENKERFVKAEGVELMIIIMKQKKLAYGSAIRALDFAMTKYPPACERFVDVLGLKTAFAAFMGKIPLSKKNKKERYQEDLEERIVSLIASLFGGILRGSRRERLLSKFVENECEKIDRLMELYIRYSDRVKAETERLNQVELDDLEMDEDEKYNRKLESGLYTLQLIAVILGHLWCSEHPQMRGRIELLLKQNKLSKKHIKDILQEYHDNIGDLDGPEEKERAQTKIQKFITAL

SEQ ID NO: 4171 - protein, 610 aa, Pseudomonas aeruginosa
MCGLAGWVDYTRKLDDEFPAIFAMTDTLALRGPDAEGIWKHRNALLGHRRLAVIDLSGGVQPMSYRFPTGQEVTLVYTGEVYNHDALRERLRRAGHEFRTRSDTEVVLHAYLQWGERCCEYLTGMFAFAVFDGRDGHLLLVRDRLGIKPLYYARHREGLLFGSEIKSILAHPEFAARLDAVGLVDLLTLSRGTSQTPFREVQELLPGHLLSWRPNSQAKLRRYWEVRRQEHADDLQSTVQRTRELVTRALGAQLHADVPVCSLLSGGLDSTALTGIAQRIAKAEHGGDINSFSVDFVGQAEQFRSDDLRPDQDQPFALLAAQYIGSRHRTVLIDNAELVCERAREEVFRAKDVPFTFGDMDTSLHLMFGEIRRHSTVAISGEGADELFGGYGWFRDPQAVAAARFPWASRVRLPAGFIDAGFNRRCDLLQYQQASYDDGLRQVEHLAGDSPEERRMREFSHLHLKRWMVLLLERKDRLSMCNGLEVRVPYTDHELVEYVYNVPWSIKSRDGEEKWLLKRACADYVPEAVLKRRKSPYPTSANLGYERFLRGSVRRLLEDAVNPVFGIVSREFLAAELEHPEGYFNTQVSRHNLETALALEGWLRLYGLSA

SEQ ID NO: 4172 - protein, 604 aa, Arabidopsis thaliana
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHIVGSLVKPRKRQEGSSLMFKVLKERGSLDRSDHRWAAWRSPASSADGDVYIRFEMNVENDDSSSQSFASVSSRDQEVGDVRFSGGYGLGQDLSFGVCKKVVQVSFLTYLFLKFLSLV

SEQ ID NO: 4173 - protein, 109 aa, Shigella flexneri
MLEKLEVVVNERREEESAAAAEVEERTRKLQQYREMLIADGIDPNELLNSLAAVKSGTKAKRAQRPAKYSYVDENGETKTWTGQGRTPAVIKKAMDEQGKSLDDFLIKQ

SEQ ID NO: 4174 - protein, 409 aa, Aspergillus nidulans
MRLIHAVLGLLAGAAPALVAASPAAPIGNGRDQVSKAVGRHFEIDGKVQYFAGTNCWWLGNLLNDFEVELAVSQIAETGYKVVRTWGFFGVNDPSNPGQPVYYQVLNESLYEGGLGINYGSNGLSFILLRSPAIKRSPNRHLNAGIRRLDTVVSLAERYDIQLVLTFMNNWNDFGGINIYSNAFGSNATTWYTDKKSQRAYREYIKFIVNRYKGSSAIFAWELGNEPRCKGCDPSVIYNWAKSVSAYIKKLDKKHMVALGDEGWLCPPEGDGTYAYDCSEGVDFVKNLEIETLDYGTFHLYPESWGYNYSWGSEWVLQHDAIGKRFNKPVVFEEYGTPLNHTQLERPWQLTTVKETQVAADFIWQFGTVLPVEGTEWGDVNSIYYGTEEYEVLAVQHAWEMARKKVPRH

SEQ ID NO: 4175 - protein, 303 aa, Ipomoea trifida
KLCRLFTILDSCYAIYRFYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 4176 - protein, 321 aa, Streptococcus pneumoniae
PDINKDPGAEDKYKEVQEAYETLSDDQKPAAYDQYGAAGTNGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKVPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKVALKEFAA

SEQ ID NO: 4177 - protein, 747 aa, Bacillus subtilis
MCGLAGIINLAAPRSQECTFHILKGMADAISYRGPDDEQYHIDSKVGFAFRRLSILDLVNGQQPFLNEDGSIVVMVNGEIYNYKELKASLHNHMFKTTSDCEVIVHLYEEKGIGFVDDIIGMFSIAIWDKNKNKVFLVRDRFGIKPLFYTELKHELIFASEIKSLFSHPHCPRQFNWKEALSDICLSGEAASNHKETTSFFVNIQNLDAGHYLEINLTTNERKTASYWSLQDILLRQGYRENLHPDDLIEGYRELLADSVHRCLQSDVEVGLFLSGGIDSAAVAHFAAEKQDLHTFTVLSQSTFTNEDAKYAHWLAKDLHLPNHQVLYQLGNDELLQPESYKHLLWICETPFCGPEQLYKFHLHKYAKAIRPNLKVMLTGQGSDEFNGGYSTTLSPAENPSWEGFIESVNTMEMNRLHRLQGNIFRVWEEHFGLSPINLSYLKSNDSSQADPWQSYVLTKYRDLQMYNCWHEDRIAAANHIENRVPFLDHRLVEWVCGIPDGLRKDLLWDKSVLRKSLTNELHTSYTHRPKVPFFYGKDVRYTHKMMFHLLKKNNYQLIEEAFSHSDASSIIQVEHIHAIMTYLEDDPEFTNFEFLLRLVNMGLLSKMTKETPSVQLDITSHLESITIKDWHSQEGDIASRLNISANKCEGQDILALNPGVTLLRPESDSEHCIYIAEEGFIQFIVSEEDVGAWLHILCDINGKDTLHTILDRHGVSLEEVAKYIQEAIEHNIILIKQKNLPEGAYR

SEQ ID NO: 4178 - protein, 569 aa, Ostreococcus tauri
  misc_feature (95)..(101): Xaa can be any naturally occurring amino acid
MSDIELSLRGTMVSRAPDDRAEELRRAIAACRARGLMRATAWACEQLCGMEEVGDGTSTPRAAGRRARADEDGMDVATTPSASVIEIGEDDDVYXXXXXXXFLREYATFLAGEKSKGQSCAFGGANVDGGGDGVDSTQTPSIGARKIGPDPSAGTNVELESLNEWLQAQDASGSKDGFLTFLHGIVCRESGQHGHAKALLAEACRKYPLNWSAWQALIPLLTSEGEEQALDLPREHWVYRWFIGVFQLEMQKNKESLETFVAMGREFPQSKLLLGHMAEAHYNLREFDEAQEIYKDIRDIDPYRIDGMDNYSNVLYVKDSFAELSHLAHHMVGTDKYTPETCCVIGNYYSLKSMHAKAVVYFKRALKLNPRYLSAWTLMGHEYVEMKNPAAAIDAYRHAVDINPRDYRAWYGLGQTYEILQMPYYALYYYQQAVKLRPSDPRMWCAMGQCYESDQLRMFTSAIRCYQRAVANDEREGIALSKLATLHREKNEKAAAHYYLLNLKRLDEESSGSVDSNEKIDALEFLAQFYKKEGRYDEAEQACVRLLDAPGAAKHAAKALLREIHSQRF

SEQ ID NO: 4179 - protein, 325 aa, Streptococcus pneumoniae
HPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYDLNLNFVQAALGDTVDIPTVHGDVELVIPEGTQTGKKFRLRSKGAPSLRGGAVGDQYVTVNVVTPTGLNDRQKVALKEFATAGD

SEQ ID NO: 4180 - protein, 338 aa, Burkholderia xenovorans
MNLQRFPRYPLTFGPTPIQPLARLSKHLGGKVHLYAKREDCNSGLAFGGNKTRKLEYLIPEVLAQGCDTLVSIGGIQSNQTRQVAAVAAHLGMKCVLVQENWVNYSDAVYDRVGNIQMSRILGADVRLVPDGFDIGFRKSWEEALESVRAAGGKPYAIPAGCSDHPLGGLGFVGFAEEVRQQEAELGFKFDYVVVCSVTGSTQAGMVVGFAADGRADRVIGIDASAKPAQTREQITRIARQTAEKVGLGRDITSEDVVLDERFAGPEYGLPNDGTLEAIRLCARMEGVLTDPVYEGKSMHGMIEMVRNGEFPEGSRVLYAHLGGVPALNGYSFIFRNG

SEQ ID NO: 4181 - protein, 322 aa, Streptococcus pneumoniae
PQISQEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEVKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFATA

SEQ ID NO: 4182 - protein, 430 aa, Solanum lycopersicum
MEEAEFIPSSSLTKTTSLYPSQFLHVSTHKPRLSLTPLRKSKICCSVISNAPVPVAKEPTKKTECFGVFCLTYDLKDEEETSSWKKLINVSVSGAAGMIANHFLFKLASGEVFGPDQPVTLKLLGSERSIQALEGVAMELEDSLFPLLREVSIGIDPYEVFQDAECSLLIAPKPRGPGMERSGLLDINVQIFAEQGKALNAVASRNVKVIEAGNPCNTNALICLKKAPDIHAKNFHALTRLDENRAKCQLALKAGVFYDKVSNMTIWGNHSTTQVPDFLNAKINGFPVKDVIRDSKWLEEEFTEKIQKRGGVLIQKWGRSSAASTAVSVVDAMRSLVTPTPEGDWFSTGVYTNGNPYGIAKDIVFSMPCRSKGDGDYELVKDVLMDDYLRSRIKKSEDELLAEKRCVAHLTGEGIGICDLPGDTMLPGEM

SEQ ID NO: 4183 - protein, 363 aa, Magnaporthe grisea
MAPPEVHHLFHNPIADHSFSADRQTLAIARDSTVELYGRAEKGFRLQDELKGHDKTVTSVDIAPSSGRIVTCSQDRNALVWEPSPTGYKPTLVLLRINRAATYVRWSPSETKFAVGSGDRVIAICYFEEENDWWVSKHLKKPIRSTITTVAWHPNSVLLAAGSTDAHARVLSSFIKGVDTKPEPTGWGERLPFNTVCGEYLNNSAGWVHAVAFSPSGEALAFAAHDSSITVVYPGGPDQPPRALISINTQLLPFMGLVWNGESEIIAAGYDCEAFRFRGGEGGWQLSGSLESKGRPGADAEREESALNMFRQMDLKGKVKDDTQLKTVHQNTITTIRSFQESGSGLVKMSSSGVDGRIVIWDV

SEQ ID NO: 4184 - protein, 762 aa, Vibrio vulnificus
MSFRIKTIIGIACIEIIMLMLLVFSAMNFMRQSNQEQFIQKANATSQMFARASKDALLSLDLATLDDLTQEILSLPDILYVDIRNNDQQLAFAGALPKVSADWQADDHVSLGDLVFDVSEKITVDGLTYGEIRMGFNTTAIQTALDEASKAIVLIAVLEIILVALFSYFLGSYLSQNLYQLTRAAERVANDGPGFQLQLKAKDEIGKVAAAFDSMSHNLATSYQELEQARTQAELANESKSRFLASMSHEIRTPMNGVLGLLGILGETKLDNHQQNLVHTAKESGELLLSIINDILDFSRMEANTLILYPRPFELKSCVEEIVNSFEPLAKTKGLYLSLTFNDECDYVVVGDSNRYRQVLLNLLGNAVKFTQKGSVSLHVTTQNEGDKLYIRCEINDTGIGIAPDAMAILFEEFTMVDQGYSRTREGSGLGLAICKRLAQLMEGEINVESEVGKGSCFVFSVEMPLAEHDTVTQQAQPDNDSVCTLLQGKRILVAEDNTANQMVIKAMFERLGVAIDLANDGYEAVSMASNHHYDIIFMDISMPGKDGMQACKEIRQLPDAKQAATPIIALTAHALYGDKEKFLRSGMNGYLSKPLRSRHLIEELNNILSASNHHDTAHKPLETEKTNHMQITLTSEKNTTAPLVDELIIQQMIRDTSAEVMPMLIEHYIEESERRLVKIDQAIAHSDFQQLEFELHTLGSSSLALGNRRLSNLARKLERLCVAKEYDAVMEDASGIAQLAHDSLSALNERKQLGFVEPNSI

SEQ ID NO: 4185 - protein, 298 aa, Streptococcus bovis
PGAEEQYKKVQEAYETLGDEQKRAAYDQYGPAGANGGFNGGAGGFGGFDGAGFGGFEDIFSSFFGGGGGMRNPNAPRQGDDLQYRVNLTFEEAVFGVEKEVAYNRESTCSTCSGSGAKPGTSPVTCSRCHGSGVINVDTQTPLGMMRRQVTCDVCHGTGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLRGKGAPKLRGGGQGDQHVTVNIVT

SEQ ID NO: 4186 - protein, 431 aa, Rhodopseudomonas palustris
MSEKPTSDVLNRRRFLGAAGLGAAGLAGAGSMLPSLAAKASEAAKPDPAITEIKDWNRYLGDGVDKRPYGVPSKFEKDVIRRDVSWLTASPESSVNFTPLHALDGIITPSGLCFERHHGGVAEIDPAQHRLMIHGLVDTPLVFTMDDIKRMPRVNKIYFLECAANSGMEWRGAQLNGCQFTHGMIHNVMYTGVTLKTLLEQAGVKSNAKWLLLEGADSAGMDRSLPLEKALDDVMIAYAMNGEALRPENGYPLRAVIPGWQGNLWVKWLRRIEVGDMPWQTREETSKYTDLMPDGRARKHTFVMDAKSVITSPSPQMPLKFKGRNVLTGIAWSGRGTVKRVDVSMDGGRNWCEARIDGPVLNKSIVRFYVDFDWNGEELMLQSRAIDETGYVQPTKAELRKIRGVNSVYHNNGIQTWLVHPDGVTENVEIA

SEQ ID NO: 4187 - protein, 322 aa, Streptococcus mitis
PDINKEPGAEEKYKEVQEAYETLSDDQKRAAYDQYGAAGANGGFGGAGGFGGFNGAGGFGGFEDIFSSFFGGGGASRNPNAPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNDRQKAALKEFAAA

SEQ ID NO: 4188 - protein, 102 aa, Glycine max
  misc_feature (80)..(80): Xaa can be any naturally occurring amino acid
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 4189 - protein, 316 aa, Francisella tularensis
MANHHKLIILGSGPAGYTAAIYAARANLKPVIITGMQPGGQLTTTTDVYNWPGEPDGIMGPELMEKLQKQAERFDTQIVYDTINAVDLQNKPFKLVGEVEQYTCDTLIIATGATAKYLGLESEEKFMGKGVSACATCDGFFYKNKDVAVVGGGNTAVEEALFLSNIAKSVTLIHRRDTLRSEKILIDKLMEKAQHGNINIIWNTTLEEVLGDDMGVNALRIKNIKTNEESQMGVAGVFIAIGHTPNTSIFAGQLEMENGYIKVKSGLAGDATQTNIKGVFAAGDVADHVYKQAVTSAGTGCMAALDAEKYLDNLDQ

SEQ ID NO: 4190 - protein, 225 aa, Geobacter sulfurreducens
MKKDILEKGAILQRDRETYAIAPHIPGGITDTATLRKLCDVADKYGVKELKLTSAQRIALFGVKEEDLDAIWSDLDQQPGAAIGLCVRSVKICPGTTWCKRGVQDSVSLGLKIDAIYHAMELPNKMKMGISGCMLNCAETMLKDVGVVGTPKGWRIYVGGNAGARPRIGDLLVELGPDEDKVLAVIADLVEWYRSSGSEQRLGRVVEQMGFDAFKTAVLGAKATP

SEQ ID NO: 4191 - protein, 173 aa, Vitis vinifera
MSRNMEPLSVGRVVGDVVDGFTPSVKMSVTYNSNKQVANGHELMPSVVTAKPRVEVGGEDLRAAYTLIMTDPDAPSPSDPYLKEHLHWIVADIPGTTDASFGKEIVSYEPPKPVIGIHRYAFILFKQRGRETVMPPASRDHFNTRKFAEDNGLGSPVAAVYFNAQRPTAARRR

SEQ ID NO: 4192 - protein, 398 aa, Mycobacterium avium
MSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGEQIGELVARLHRAEGVDVRLGVGVAQVRGDTHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 4193 - protein, 804 aa, Zea mays
  misc_feature (331)..(331): Xaa can be any naturally occurring amino acid
  misc_feature (355)..(355): Xaa can be any naturally occurring amino acid
MEDVLTPPPQPELAGEKRKREESSLDASIEDAPSAPASTCSAEDAAGSDVARHPMWKTSLCSFFRRRGAGAEGCSHGDSCRYAHTEEELRPRPDGTWDPTSDRAKELRKVAAEAQEEAEEEVTVDEQSLDKCLVGLPRGWTADRLKSLLQDQAISTNAQLILVLGFIGQCLGISYATAKKKKGMTVGFVTFQSVEQLTNAVQVLKENPSDGKQIKIVDANRRSHQKAHAGAPVSNTGTATENGSSPTTPAEETSVPESVSSSKKGARDAVTPLAHMTYIDQLEHKKQSMAQILKKLTRNARKACPPTIPHPDWVFKSKEIEQTEQNTGAVXGGLPCKFEGILESPVVNGYRNKCXEGRCPAEAVVSQNAESQISEVMLIVQVCSTSVDEALMKEEFDKLSAALVQGAATCSPPLPLTTIVVQDHKGISNAAPTDCPLIPLLVPKGDKLDGTSEDKTRIHDHISNLKFSISPTAFFQVNTLAAERLYALAGDWANLNSDTLLFDVCCGTGTIGLTLAQRVGMVVGIEMNESAVSDAHRNALINGIKNCRFVCGKAEDVMGPLLTEYLGSPQQQAAASKSNSEIDDTSKTEDMIGCASYDGENIDSSKQRHDNAEGQQPMDTSVDHPTCASEVDGMDVVDCNHDENNVASGEQNCGEASLINGKPIETSSDNSLEQGKTCKDGSSSPNNNVLAANACQFKNVVAIVDPPRVGLHPTWWELSHRVTRYISCNPDSLVANGIELCTPTPEKQEKNKGNRGWRSMSSAGLARQRTKSMPNSEPFIPKRAMAVDLFPHTPHCEMVMLFER

SEQ ID NO: 4194 - protein, 297 aa, Zea mays
MKSRLCIRADVLLLRRFAPFLFPRPRTSPPPDPATSHRRSPPSDPPRANSPPPSTRRIPDELGEVLIWIFVECAMVDFVRRLASALLKCCDLDIPNRPKGLEDPERLARETVFNVNEIEALYELFKKISSAVVDDGLINKEEFQLALFKTNRKDSMFADRVFDLFDTKHNGILEFEEFARALSVFHPSAPIDFKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 4195 - protein, 632 aa, Desulfovibrio desulfuricans
MCGIAGYIGRRCLPDDAVRRCHAAMRHRGPDGSGTFRRCTADGRHVLLLHARLSILDPDPRSGQPMQRGGGVLAFNGELYNFSEVRERLERGGLAFDTTGDTEVLLRALDPQGRSLLCGGHAAEDLLHGMAGALDACEGMWAFAYFDASRGTLVLGRDRFGEKPLYYLRDDDGGLYFGSEPKLLAALTGRPLRPDTEHLRRYLVNGYKSLYKTRQTFFAGLRQVPAGTMLAADAGGLRGLCYWERPHAAHDPVQEDMSFADAVRGTRERLIRSVELRLRADVPLAFCMSGGIDSNSLICIARRVFGYDVHGFTVMNTDARYEERECVEHVVRELGLRHTSVSPSVAGFLDGLRTLVRAHDAPVLTISYYVHWLLMQRIRQQGYAISISGTAADELFTGYYDHHNLYLAAMYGSGALYDKALENWRRHVAPVVRNPYLQDPEVFVHAPQERGHIYLHNDRFAGALRQPFDEPFTEHAYHAVPLRNRMLNELFHEAVPVILHEDDLNAMYHSVENRSPFLDRDLFDFSLRIPVRHLVRDGMAKAVLREAMRGIVPDMILDNRRKVGFNAPVLDFLDVRDSAVRAQVLADSPVWDFVRRDAVAQLLDGRSLGNSESKFLFNILCCKMFLEDCADA

SEQ ID NO: 4196 - protein, 513 aa, Arabidopsis thaliana
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDQPFAFPFVDFPNGLPIRVSRIL

SEQ ID NO: 4197 - protein, 165 aa, Campylobacter jejuni
MKNIVLGGGCFWCVEAVFERLKGVINTEVGYSGGKPNPSYESVCNGDGNIEVVKINYDEKQISLLEILTLFFKIHDPTSIDKQGGDIGIQYRSIIFYENEEDKILAQNFIEEQQKIFSKKIVTKISRLQTYYKAENYHQHYFINNPDQGYCQAVIAPKLQKIQSD

SEQ ID NO: 4198 - protein, 315 aa, Glycine max
  misc_feature (93)..(93): Xaa can be any naturally occurring amino acid
  misc_feature (136)..(136): Xaa can be any naturally occurring amino acid
MMASPTSPRVLFLSLFVTLSMILHLSSARKLSESDPQLQFQYHRGPLLTGKISVNLIWYGKFKPSQKAIVADFITSLSSSKPLTAQPSVATWXWKATDKYYKNSFPKLALSLGSQIVDENYSLGKSLTTNQILKLXSKGPQRNAINIVLTSAEVAVEGFCSSRCGTHGSSVGARVNGKRYKFAYMWVGNSETQCPGQCAWPFHQPIYGPQNPAPLVAPNNDVGLDGMVINVASLLAGTVTNPFGNGYFQGPKEAPLEAGSACTGVYGKGAYPGYAGNLLVDPTTGASYNANGVNGRKYLLPALVDPKTSSCSTLV

SEQ ID NO: 4199 - protein, 161 aa, Unknown
  Musa x paradisiaca
SSMMVSSAATVSRASPAQSSMVAPFTGLKSASAFPVTRKPNADLSHLPSNGGRVQCMKVWPIEGVRKFETLSYLPTMKDEALLKQIEYLLRSKWIPCLEFCPKGFVWRENHRSPGYYDGRYWTMWKLPMFGCTDAVQVAKEVEECKKEYPHAFIRIIGFDN

SEQ ID NO: 4200 - protein, 571 aa, Unknown
  Nocardioides sp. JS614
MTQGLTPDPPENNPDWFKSAVFYEVLVRSFRDSNADGTGDFRGLVEQLDYLQWLGVDCLWIPPFFPSPLRDGGYDVADYTGVLPEIGTIEDFRYFLDEAHQRGLKVIIDFVMNHTSDQHPWFQASRSDPQGPYGDFYVWSDTDELYEEARIIFVDTEPSNWTWDPVRQQYFWHRFFSHQPDLNFDNPAVHDAMLDAIRFWLNMGLDGFRLDAVPYLYERPGTNGENLPETHEMLKKVRKVVDDEYPGRILLCEANQWPQDVVEYFGDFAVGGDECHMAFHFPVMPRIFMAVRRESRFPISEILEQTPAIPENCQWGIFLRNHDELTLEMVTDEDRDYMWGEYAKDPRMKANIGIRRRLAPLLDNDTNQMELFNALLFSLPGSPVLYYGDEIGMGDNIWLGDRDGVRTPMQWTSDRNAGFSSANPGKLDLPLIQDPVFGYQSVNVEAQLENTSSLLHWMRRMIHARRNHPAFGLGTFHDLGGSNSTVLSYVREYTTEDGSEDIILCVNNLSRFPQPVELDLRRFEGRRPVELIGGVPFPEIGELPYLLTLAGYGFYWFRLTAPETSEEGLLL

SEQ ID NO: 4201 - protein, 154 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDVAPGLLDLALGCFLPALRACERLHGLSLIDASATPLLD

SEQ ID NO: 4202 - protein, 161 aa, Unknown
  Musa x paradisiaca
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 4203 - protein, 356 aa, Arabidopsis thaliana
MSLVSDLINLNLSDSTDKIIAEYIWVGGSGMDMRSKARTLPGPVTDPSQLPKWNYDGSSTGQAPGEDSEVILYPQAIFKDPFRRGNNILVMCDAYTPAGEPIPTNKRHAAAKVFSNPDVAAEVPWYGIEQEYTLLQKDVKWPVGWPIGGYPGPQGPYYCGIGADKSFGRDVVDSHYKACLYAGINISGINGEVMPGQWEFQVGPAVGISAADEIWVARYILERITEIAGVVVSFDPKPIPGDWNGAGAHCNYSTKSMREEGGYEIIKKAIDKLGLRHKEHIAAYGEGNERRLTGHHETADINTFLWGVANRGASIRVGRDTEKEGKGYFEDRRPASNMDPYIVTSMIAETTILWNP

SEQ ID NO: 4204 - protein, 423 aa, Pseudomonas putida [sequence omitted]

SEQ ID NO: 4205 - protein, 161 aa, Unknown
  Musa x paradisiaca
SSMMVSSAATVSRASPAQSSMVAPFTGLKSTSAFPVTRKANADLSHLPSNGGRVQCMKVWPIEGKKKFETLSYLPTLVNEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 4206 - protein, 581 aa, Leptospira interrogans
MLEYSLDSLHSYIFDSIKARVNMTSKKSTSKKKSPNQLDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 4207 - protein, 718 aa, Unknown
  Nocardioides sp. JS614
MTPGLWRDRGERAPVWPGRSWPLGSTWSAEATNFAVHAPRATAAWVCLFDEEGRERRHPLTEQELGIWHGAIPGVAPGTRYGYRVDGPWDPAQGLRFNADKLLLDPFARAVSGDLTLDPAIFGYVEGAPDRRSDTDSAPYVPRSVVLGDDDFDWDDDAPPRHPWQDSAIYEMHVKGMTALHDRVPEELRGTYAGLATPAVVDYLKDLGITAVELLPIHQFVSETSLLERGLVNYWGYNTIGFFAPHNAYSSSGDRGQQVTEFKAMVKAFHAAGLEVILDVVYNHTAEAGTTGPTLSFRGLDDRGFYYRTGGDGHAEPFEDTYWDVTGCGNTVDASNPFALRLILDSLRYWVTEMHVDGFRFDLMSALTRVHRQIDMRSHLLTAIGQDPVLRHVKLIAEPWDASMDGYRVGEFPPPWVEWNDQYRDEIRDFWRNHTSGIRGVATRLAGSSDLYLDDGRSPYASVNFVTAHDGFTMRDLVTYERKRNEANGEDNRDGTDNNRSWNHGVEGESHDPALVAIRRRQVANMMATLCLSNGVPMITAGDERGRTQGGNNNAYAQDNETSWIDWRPDDAWLDVYEVTKTALRLRREHPALRQRHWFEGRPTLIGGPKDLAWLHPSGREMSGDDWHDPTLRAVGMFVSGAPLRAPGPRGEQQADKSFVLWFNSDWLPQRVTLPENDWVRAGEVVLSTDFRLPVGTPVKAGDQVHIGRRTVVVFRET

SEQ ID NO: 4208 - protein, 154 aa, Oryza sativa; identical to SEQ ID NO: 467

SEQ ID NO: 4209 - protein, 322 aa, Kineococcus radiotolerans
MAPRDDRTVLGTWPTPVEAAPRLAAAIGLGPGDLLVKRDDLVGLAGGGNEVRELERTLGAALAEGARTVVTSGAPQSNHARLTAAAGARLGLDVVLVLEGSPPAAPGGNLLLDALLGARIVWAGDVSPGELAARVEAEAEDLRAGDGAGGVAVVPFGGSSVLGARGYVDAGAELLEQVPDLDVVVVAVGSGGTMAGLVHALGAHRVLGVDTGAVDDPEQRVRGFAAGLAAQDGTPAPGALRLRRDEVGAGYGVLTARVRQALTLVARTEGIVLDPVYTGRAAAGLLTAVEQGEIRPGQRTVLLHSGGLPGLFGHPDAASLTG

SEQ ID NO: 4210 - protein, 204 aa, Pisum sativum
FLPDSKHVTASEDDNWILGCLLLLASSVFWSCWMIMQVPISSSCPDHVLSTFWMCLFATIQSAMFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 4211 - protein, 374 aa, Pediococcus pentosaceus
MAANKDYYDILGVSKDASDDEIKKAYRKLSKKYHPDINKAPDAEQKFKDVNEAYEVLGDSQKRAQYDQFGSADPNAGFGGGGFGGQGGFSDFGGGFEDIFGSFFGGGQRQSPNQPRQGEDLQYQMSLKFEEAIFGKKTTIKYSREALCKTCGGSGAKEGTSPVTCHKCNGTGTIQVTQNTPLGRMVRQQTCDVCNGTGKEIKEKCPTCGGTGHTSQQHEVKVSVPAGVEDGQQMRLQGQGEAGFNGGPYGDLYIIFQVQPSDMYERDGSEIYYNQTISFVQAALGDEIEVPTVHGKVKLKVPAGTQTGTNFRLKGKGAPRLRGNGTGDQHVKVKVTVPKKLNSGQKEALKQFAKASGEEPSGHGKSGFFDKFMN

SEQ ID NO: 4212 - protein, 530 aa, Burkholderia xenovorans
MLDANLKTQLKTYLEKVSRPIEIVASVDDSAKSQELLALLNDIATLSERVNVIERRGDAERKPSFSIGEPGKETGIRFAGIPMGHEFTSLVLALLQVGGHPLKLEDAVIEQIRNLDGDYQFETYFSLSCQNCPEVVQALNVMALINPRIRHVAIDGALFQNEVEARQIMAVPTMFLNGEVFGQGRSGVKEILAKLDTNAGARAAKELEKKPVFDTLIVGGGPAGAAAAIYSARKGIATGVVAERFGGQVLDTLAIENFVSVTETEGPKFATALEQHVKSYEVDIMDVQRAEALIPGRINEVRLANGAVLKAKTIILATGARWREINVPGEREYRNHGVAYCPHCDGPLFKGKRVAVIGGGNSGVEAAIDLAGIVREVTLFEFGATLRADEVLQRKLRSLANVTVVTQAQTTEITGDGKKVNGLVYKDLRSGEVKQVELEGVFVQIGLVPNTEWLKGTVELSKHGEIVVDARGATSVPGVFAAGDVTTVPFKQIVIAVGEGAKASLSAFDYLIRNSEEVEVVSEAEAEVAV

SEQ ID NO: 4213 - protein, 204 aa, Pisum sativum
FLPDSKHVTASEDDNWILGCLLLLASSVFWSCWMIMQVPISSSCPDHVLSTFWMCLFATIQSAIFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 4214 - protein, 310 aa, Streptococcus mitis
EKYHPDINKEPGAEEKYKEVQEAYETLSDDQKRAAYDQYGAAGANGGFGGAGGFGGFDGAGGFGGFEDIFSSFFGGGGASRNPNSPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPT

SEQ ID NO: 4215 - protein, 182 aa, Brassica rapa
VPGVPSIDKITFVLLRLDDGVVLDERVFVHDFVNLAYNMGVFMYDDLLAILSLRYQKIHLLQIRDSGHLVDARAIGYFCREDDELFLNSSSQAMMMTTTQDKNKQQNREDDGDNGLNHTQLNADNNSFLSGIKQRLLSFVFREIWNEESDNTVRVQSLKKKFYSHFQDYVDLIIWKVQFLDR

SEQ ID NO: 4216 - protein, 226 aa, Triticum aestivum
  misc_feature (85)..(85): Xaa can be any naturally occurring amino acid
AYLGDTTEQVCTKKQAGTGPEFPGSRRPPPPLVSSTSQLSFHMGSRVCLAAAVVAVAVAAAAADVAADRAECSDKLVALATCLTXVQGQGQAPTPDCCRGLKTVLHTSPKCLCVLVKDRDDPGLDLKLNVTRALGLPAACSAPANISDCPRLLNLPPNSKDAEVFEQFAKQQAAQSSPSGASSAPSTGAQKNAAARMRWLGVGRVGVAARAAPLLFFAVPFLLLVR

SEQ ID NO: 4217 - protein, 334 aa, Penicillium chrysogenum
MVHSKVVIIGSGAGAHTAAIYLSRAELQPVLYEGMLANGTAAGGQLTTTTDVENFPGFPSGIGGAELMDNMRAQSERFGTEIITETISKLDLSSRPFKMWTEWNDDEGSEPVRTADAVIIATGANARRLNLPGEETYWQNGISACAVCDGAVPIFRNKPLYVIGGGDSAAEEAMFLAKYGSSVTVLVRKDKLRASNIMADRLLAHPKCKVRFNTVATEVIGENKPNGLMTHLRVKDVLSNAEEVVEANGLFYAVGHDPASGLVKGQVELDDEGYIITKPGTSFTNVEGVFACGDVQDKRYRQAITSAGSGCVAALEAEKFIAETETHQEAKPVL

SEQ ID NO: 4218 - protein, 584 aa, Bordetella pertussis
MNEPAPLGATVCAPGKIRFRLWAPSAPPALALEIEGRAPIALRPGPDGYAQAIVDGAPGLRYRYRLAADCVVPDPASRLQDGDVHGHSVVVGPDRYPWRHTGWRGRPWQDSVIYEAHAGLCGGYAGLRRRLPEVARLGVTLLELMPIADFPGPRNWGYDGVLPYAPDTAYGTPDELKALIDAAHGLEMGVMLDVVYNHFGPDGNYLHRYAADFFDARADTPWGAAIDYRQQAVQRYFIDNALYWLRKYRFDGLRLDAVHAMGRTDWLAGLAREARAACPDRRVHLVVENDANQASLLEQGFDAQWNDDAHHVLHHLLTGERQGYYADYAQAPAALLARALGEGYVYQGQAAPTRGGRARGEPSAHLPPWAFVLFLHNHDQVGNRADGLRLTSLLAPGSPALRAAIALQLLAPHIPLLFMGEEYGSTAPFFYFTSHGPELAAAVRAGRAREFAASMHDCDPPPDPNDPDTYRRSCPWPPPGAERQAWFEYYRELLRLRARLLGERLTGARADGAAALGPAAVRAAWRLGDGARLTLYANLLPGSVIVPAPPAGQLAYATLAGAGQDLVAGVLRGGCALALWEPAP

SEQ ID NO: 4219 - protein, 706 aa, Bordetella pertussis
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPAAAWAHTVIYEAHVRGVSMLRSDLREPIRGTCAALSDPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRHWAVHYRVDGFRFDLGVTLGREGTGFDAGSGFFDALLQDPVLARVKLISEPWDVGPDGYQLGRHPPGMAEWNDQFRDTARRFWRGDAGMAGALATRLTASRDVFDHRHRRPWSSINFAAAHDGFTLQDVVSFAERHNEANGEDGADGHGENYSSNWGVEGAASSAAIRETRARVQRALLATVMLADGTPMLLAGDEFGNSQGGNNNAYCQDGPMGWLDWAVAQSTPGRALTAYAARLAGLRRAHPSLRATRYGDPAHQWQEGLGAIDWFNGRGAPMTSADWDAPEGRLLVLRRALPDPAQPGRVDVTLLLCNAAAEPRPCVLPAPTLAWTLALDSASPEAPAAPCDGGEAIVGARAVLLLTASVDGAHAP

SEQ ID NO: 4220 - protein, 417 aa, Pseudomonas syringae
MFSRDLTIAKYDADLFAAMEQEALRQEEHIELIASENYTSPAVMEAQGSVLTNKYAEGYPGKRYYGGCEYVDVVEQLAIDRAKELFGADYANVQPHAGSQANSAVYLALLQGGDTILGMSLAHGGHLTHGASVSSSGKLYNAVQYGIDGNGMIDYDEVERLAVEHKPKMIVAGFSAYSQILDFPRFRAIADKVGAYLFVDMAHVAGLVAAGVYPNPVPFADVVTTTTHKTLRGPRGGLILARANADIEKKLNSAVFPGSQGGPLEHVIAAKAICFKEALQPEFKTYQQQVVKNAKAMAGVFIERGFDVVSGGTENHLFLLSLIKQDISGKDADAALGRAFITVNKNSVPNDPRSPFVTSGLRFGTPAVTTRGFKEAECKELAGWICDILADLNNEAVIDAVREKVKAICAKLPVYGA

SEQ ID NO: 4221 - protein, 1113 aa, Bordetella pertussis
MPATHPAPDPLWYKDAVIYQLHVKSFFDANDDGVGDFAGLLAKLDYIVELGVNTIWLLPFYPSPRRDDGYDIADYRGVHPDYGSLADARLLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTLDAAILTGASADDYQQELAGYEVLAGTIGQRLAQMHSVLARAGELPGFAPRPASERDAALAGERAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 4222 - protein, 424 aa, Oryza sativa
MNALAATSRNFRQAPRLLGLESKLEKSLLIPFPEIKVKRGRSVTPLSVQVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 4223 - protein, 892 aa, Metarhizium anisopliae
MPQSESNSEPGFQQKTVVFPPSPPSTVGRSRRCSADGNSNDITFPVSPTIANNDALIYPLPPTNSQKSVRPEDLKTPDSHVERDARLIRLTGTHPFNCEPPLRDLYDEGFLTSEDLHYVRNHGPVPQCDDGDMDHWTFTVDGLVENPFTLSVRELIASYEQVTYPITLVCAGNRRKEQNVVRKSKGFSWGSAGLSTALWTGVALGDLIAKAKPRRGARYVCFEGADKLPNGYYGTSVKLNWCLDPNRGIMVAHKMNGCVLHPDHGKPVRVVIPGQIGGRSVKWLKRITVTEKPSDNWYHIYDNRVLPTMVTPEASADLPDTWKDERYAIYDLNTNSVICYPAHNETLLLNGDSSTYKVRGYAYGGGGKRITRIEVTLDKGKTWRLANIDYPEDRYRLAPDGERLYGGRVDMWWRETSFCWCFWELDVDIGDLKTTTDIMVRAMDESLMVQPRDMYWSVLGMMNNPWFRVVVHDIGHALQFEHPTQPALIPGGWMERIKKAGGNLTNGSWGEKLAGQTEDVMGQEPEQDVCMTNPRADRLVTMCELKSHSGEQEPWFIVDGQVYDGTPFLEGHPGGSASIFGAAGQDVTEEFVTIHSENAKAMMPAYHIGKLDEDALAQLSGETNECDPSRSVFLDSKVWTKATLQEKISVSSDSKIFRFKLDHAEQEVGLPVGQHLMMRLRDPVTRESIIRAYTPISEGTDRGCLDVLIKIYHGTPERRGGKMTQALDSIPVGHFVDFKGPVGKFEYLGRGLCSISGKPRHVSRFNMICGGSGITPIFQVFRAMIKGADDSTECVILDGNRVEEDILCRLELDQMASSAKHRCSLLHCLSRPSSTWEGRTGRIDKDLISSEIGSPRLDKDDIVLVCGPEQMEKGVCETLRVLGWPDENIVVF

SEQ ID NO: 4224 - protein, 468 aa, Unknown
  marine gamma proteobacterium HTCC2080
MNAPLPFQLQITSRPVLLIGTGEAAEAKARLLQERDADITHWHTTPSKDERTHVERCNRDPKTRYVLVVIAEVNAWTEALMPWLDSERLLVNVVDAPQLSQGFIPAIVSRGRIQIGIGTGGSSPVLARFVRTRLEQALPQGLERLAEFADRWQLRVRQILDTVSTRRQFWERHLSGPAGQAALNNEPDLADSILATALDADHSPQGRVTLVGAGPGDASLLTLKGLQRLQEADVVLYDKLVSPEVLSLARRDAQMEDVGKRRGHCPTPQDSINARLVELGEQGLTVCRLKGGDPYLFGRGGEEALALVQAGIPVEVVPGITTASATAAATGIPLTHRRVARSVRYITGHLALQQTDTDWQALAQAQETLVIYMGFTHLQSIAQRLQEAGLKATTPFALIQNATTPRQQVVHGQLNGVDEAAAELCLEEGPILVIIGEVTRLAQELAPKAVDDVLKSQHTDPLYWLQSA

SEQ ID NO: 4225 - protein, 309 aa, Oceanicola granulosus
MIELGTQDQPQQPPATDLIKEGSDQTFMADVVEASQTVPVIVDFWAPWCGPCKTLGPALEAAVTKHKGAVKMVKVDVDRNQGVAGQLQVQSIPTVYAFWKGQPVDGFQGALPPSQIDEFVAKLAAMGPGAEGEDEGLGAAVEAAEAMLAEGAAADAAETFAAILQEDGENAEAYGGLVRAYLALGEVDQAEAILNGAPASITETAPLESARAAIELARQAENAGPVAELRAKVEADPADAQARYDLATALHASGDTAGAVDELLELFRRDREWNDGAAKAQLFTIFDALKPTDPVVLNGRRKLSSLIFS

SEQ ID NO: 4226 - protein, 933 aa, Oryza sativa
MEERSRWESECGREMWALRYGVRRENRYIWPKSTRFGASSIFGGLNAVSVGGPFSSRICHISDGGPDEGSPGDALRRVRGFWWWWGQCGGRWMGIPEVVVPPRAAGPRRYKGLVPWRFQPGFVRPPPVKPPAAAAAVAGGGVAGTPGGKGRGLGASGEGVGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 4227 - protein, 278 aa, Glycine max
MAATTATATSYFFGTRLNNPTTLNNGRFHALLNFGKKKAAAPPPKKKEVKVKPSGDRLVWFPNAEPPEWLDGSMIGDRGFDPFGFAKPAEYLQFDLDSLDQNLAKNVAGDVIGTRVEVADVKPTPFQPYSEVFGIQRFRECELIHGRWAMLGALGALVVEALTGVAWQDAGKVELVEGSSYLGLPLPFSLTTLIWIEVIVIGYIEFQRNAELDPEKRLYPGGRFFDPLGLANDPEEKARLQLAEIKHSRLAMVVFLIFAIQAAVTGKGPISFLATFNK

SEQ ID NO: 4228 - protein, 579 aa, Schizosaccharomyces pombe
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPFVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 4229 - protein, 157 aa, Musa acuminata
VSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 4230 - protein, 175 aa, Debaryomyces hansenii
KYLDESYTKHKIIPDVVDKFDTQGLLTIEYNEQDHVALGNTLKVENTQHHPVIQFTLNSPGQENDFEISNNDKFTLVLTDPDAPSHKDHKWSEYAHWIVTDLPLNANSNDVESAESLTTVLDYSKGKELLSYQGPAPPPKTGKHRYVFLLFREDPSVSKFETPKDRPNWGIGIES

SEQ ID NO: 4231 - protein, 302 aa, Gibberella zeae
MVLYNGFDSITDVPDLLGKVILVTGGTSGLGRSAITTLAAHNPSHIYFTGRSSSAAESLIKDISPIPSTFLECDLTSIANMHAAAKKFRHDRLDLFIANAGVMAVDGLTKDRLELQFGVNHVGNATLFMALLPIMLKTAEEPNSDVRFVSLTSLGYRGHPKNGIEFDTLQSKQEDMSFGTWGRYGQSKLANIVFAKEIQRRHPKITSVVVHPGVIATGLVTELSFWKRMFVYVTNPRMMTVEQGGLNTVWAATSGDVKKGDEKVAFYEPVGKGNAGDEMCFSQELGKKLWEWTEEKINSTKM

SEQ ID NO: 4232 - protein, 501 aa, Streptomyces avermitilis
MTSSTETTSTTPQVAVNDIGNEEAFLAAIDETIKYFNDGDIVDGVIVKVDRDEVLLDIGYKTEGVIPSRELSIKHDVDPNEVVKVGDEIEALVLQKEDKEGRLILSKKRAQYERAWGTIEKIKEEDGIVTGTVIEVVKGGLILDIGLRGFLPASLVEMRRVRDLQPYVGKELEAKIIELDKNRNNVVLSRRAWLEQTQSEVRQTFLTTLQKGQVRSGVVSSIVNFGAFVDLGGVDGLVHVSELSWKHIDHPSEVVEVGQEVTVEVLDVDMDRERVSLSLKATQEDPWQQFARTHQIGQVVPGKVTKLVPFGAFVRVDEGIEGLVHISELAERHVEIPEQVVQVNDEIFVKVIDIDLERRRISLSLKQANEAFGGDPASVEFDPTLYGMAASYDDQGNYIYPEGFDPETNDWLEGFESQREVWETQYAEAQQRFEQHQAQVIKSREADAQAEAEGAAAPAAGGSGAGVSGGSYSSESDDNSGALASDEALAALREKLAGGQS

SEQ ID NO: 4233 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDK

SEQ ID NO: 4234 - protein, 347 aa, Colwellia psychrerythraea
MNNKKTTSIKRIALLTSGGDAPGMNAAIRSVVLAAHHYHIEVIGFYHGYNGLVCEEHIAMAEPLTLLKVNSIIHLGGTILKSARCQLMHEAKGLQLAADTLNDKNIDALVVIGGDGSFSGLLALQAYWSGQMIGIPGTIDNDLDGTDYTIGFATAVNTGIEAIDKIRDTADAFERIFIVELMGRHCGHITFNVGIACAAEQVLSFENFNANEQSSKLQQLATEITTAKKNRHSSYIIVIAENLWPGGAVELARQLHLQADIECTPCILGHIQRGGSPIAKDRILATKMGVAAVQALIDGESNIMVAEQNNAMNFITLDEAIKHKKVVSKQLIDAQQNILALTAQTQC

SEQ ID NO: 4235 - protein, 429 aa, Unknown
  Nocardioides sp. JS614
MSTQHDEHDAAGATGVADQVVAAAERARAASHGLALATRAEKDAALQAMAEALLTREPEVLAANGEDVARAEANGTPPNIVDRLRLTQERVAAMAQGLRDVAALPDPVGEVLRGSTLANGLEMRQVRVPFGVVGMIYEARPNVTADAAGICLKSGNAVLLRGSSSARSSNAAIVAALRDAIAGTGLDPDVVQQVPGDSHDSVKALMRARGHVDVLIPRGGAGLIRSVVEESTVPVIETGVGNCHVYVDRAADLDKALAIVLNAKTHRTSVCNAAESLLVHADLADTFVPRVVAALQEAGVTVHGDERFQAEDGVLPATDEDYGQEYLSLDISAAVVPDLDGAIAHIRRWSSQHTEAIVTEDLAAARRFTAAVDSAAVLVNASTRFTDGGEFGFGAEIGISTQKLHARGPMGLTEMTSTKYVVTGDGHVR

SEQ ID NO: 4236 - protein, 115 aa, Glycine max
  misc_feature (80)..(80): Xaa can be any naturally occurring amino acid
MGQRYENNVFKSHISNIEAAPGMTQTVHLPPPLQTDPTIRGKQNGKPKGSRNAKSAAHRPYADSTNSTAVNNCRSDSSLXLLTKKFASLIHDAKDGTLDLNRTAEILEVQKKRIY

SEQ ID NO: 4237 - protein, 831 aa, Ralstonia eutropha
MKVSRRDFIKQTAIAATASVAGIPLGTEAANFVTDSEVTKLKWSKAPCRFCGTGCGVTVAVRDNKVVATQGDPQCEVNKGLNCVKGYFLSKIMYGQDRLTKPLLRMKNGKYDKNGEFAPVTWDQAFDEMERQFKRVLKEKGPTAVGMFGSGQWTVWEGYAASKLYKAGFRSNNIDPNARHCMASAVQGFMRTFGMDEPMGCYDDFEAADAFVLWGSNMAEMHPILWTRITDRRLSHPKTRVAVLSTFTHRSFDLADIPIIFTPQTDLAMLNYIANYIIQNNKVNKDFVNKHTVFKEGVTEIGYGLRPDHPLQKAAKNAANPGDSKPITFDDFAKFVSKYDADYVSKLSGVPKDKLRQLAELYADPNVKVMSLWTMGFNQHTRGSWVNNMVYNVHLLTGKIATPGNSPFSLTGQPSACGTAREVGTFSHRLPADMVVTNPKHREEAERIWKLPPGTIVEKPGYHAVLQNRMLRDGKLNAYWVQVNNNMQAAANIMEEALPGYRNPANFIVVSDAYPTVTALSADLILPSAMWVEKEGAYGNAERRTQFWHQLVDAPGDARSDLWQLMEFSKRFKVEEVWPAELVAKKPEYKGKTLFDVLYRNGQVDKFPIKEVSTEYHNAEAQAFGFYVQKGLFEEYASFGRGHGHDLAPFDRYHEERGLRWPVVNGKETRWRYREGSDPYVKAGTGFQFYGNPDGKAVIFALPYEPPPESPDKEYPFWLATGRVLEHWHSGSMTRRVPELYRAFPNAVVFMHPEDAKAMGLRRGVEVEVVSRRGRMRSRVETRGRDAPPRGLVFVPWFDASQLINKVTLDATCPISLQTDYKKCAVKIVKV

SEQ ID NO: 4238 - protein, 372 aa, Oryza sativa
MDDPMLNAVKEEESHGDGGGLEVVAGEDGAAAVAAGLAPGPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLFKNIKRRKPPSHTASNQQSFGPYLEVGHFGYDAEIDRLKRDKQLLMAEVVKLRQEQQNTKANLKAMEDRLQGTEQRQKQMIAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASQQQQIGPQGELNDNFWEELLNEGLVGEENDNPVVEDDMNVLSEKMGYLNSNGPTAGE

SEQ ID NO: 4239 - protein, 274 aa, Streptococcus pyogenes
MGLGSDSLPVKISLFDVDTYLADSMQFHLEYILRLFPKSGVHYLMPTFRGEAVDHRHLSQFYHSECEIEGDLHYVMNLVDRYIKFLVSEILRECRDSIFAITKDVSHLESFIDRKIPIITFEEACTILENEIDSLEYNDEHHFYVLTDVGEKKLMEHFEGVVWVKNYPCKSVPFYQRFSTDHLFAYNADLLLGIGETVGCGERCETYEEVVENMNYLQVDASEYSWYLEMKKTRPMKSSGFGLGVERLIAWILKCDDVRKVQLISRENGIDYLP

SEQ ID NO: 4240 - protein, 225 aa, Chara vulgaris
MFNSEKVIQRLLSTKAHFGNRTPTSDFQPYLYGLRNEIAIIDLERTLLYLRRACNFIEYIIRSNGHILFVNTNPQNNQIIQKMAKETCQSYINHKWIGGFLTNWKHIFHVQAHFQHFENLSLKALDTAQHIRKVPRYKKMKKCFEGIVTNDIPDCLVIMNANQNSMAILEASQLHIPIVCLIDSDIPSKLQQRIHYPIPVNDDSLEFIYLFCHLITQIVNYSRIV

SEQ ID NO: 4241 - protein, 601 aa, Mycobacterium tuberculosis
MNEAEHSVEHPPVQGSHVEGGVVEHPDAKDFGSAAALPADPTWFKHAVFYEVLVRAFFDASADGSGDLRGLIDRLDYLQWLGIDCIWLPPFYDSPLRDGGYDIRDFYKVLPEFGTVDDFVALVDAAHRRGIRIITDLVMNHTSESHPWFQESRRDPDGPYGDYYVWSDTSERYTDARIIFVDTEESNWSFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPGDVVEYFGDPNTGGDECHMAFHFPLMPRIFMAVRRESRFPISEIIAQTPPIPDMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRIPMQWTPDRNAGFSTANPGRLYLPPSQDPVYGYQAVNVEAQRDTSTSLLNFTRTMLAVRRRHPAFAVGAFQELGGSNPSVLAYVRQVAGDDGDTVLCVNNLSRFPQPIELDLQQWTNYTPVELTGHVEFPRIGQVPYLLTLPGHGFYWFQLTTHEVGAPPTCGGERRL

SEQ ID NO: 4242 - protein, 329 aa, Arabidopsis thaliana
  misc_feature (70)..(70): Xaa can be any naturally occurring amino acid
  misc_feature (132)..(132): Xaa can be any naturally occurring amino acid
MQSQTNPNPSLPDDLILSCVARVSRLYYPALSLVSKSFRSLIASPELYKTRSLLDRTESCLYVCLKLNPXDEKPRWFTLFRKHTGTLKSSGYVLATVPFPHTPLESSSSSIVSVCSSIYNIGGYELPSSSVXILYCTSNTWHEGPRLRVKLMSCTACVLDEKIYVSGRCKDGDSMTFQVFDTNTQTWDPLSVPCSETKHDFHYKIVRFDGKLHLVSYKGNVWYTIVKGDISTSVWWYHSEEREWRDLKGMVGLPKFPIDACLRMVDYGGKMAVLWDDYLPGRRKKMIWCAEIALERRGSLEIWGKVEWFAHVLTVPRQYEFVKVLAATL

SEQ ID NO: 4243 - protein, 314 aa, Glycine max
MWFLGWKGASGFSASSTAEQVTQGIDGTALTAIVTGATSGLGLETTRVLALRGVHVVMAVRSLDSGKNVKETILKEIPSAKIDVMELDLSSMASVRKFAADFNSSGLPLNILINNAGVMATPFTLSQDNIELQFATNHLGHFLLTNLLLETMKKTVGVCNQEGRIVILSSEAHRFAYREGIQFDKINDESGYSSYFAYGQSKLANILHANELARRLKEEGVEITVNSLHPGSIITNILRYHDYINALANMVGKYFLKNVQQGAATQCYVALHPQVKGISGEYFMDSNKGNPASLAKDSELAKKLWEFSLSLTNP

SEQ ID NO: 4244 - protein, 331 aa, Aspergillus nidulans
MQSVLQPIIGPKKTAEDLSGRVAIITGGAFGIGYEISRTFVQNGARVIMVNRKEDQGQEAIDKIKEEAGSDAKIEWVPCDMGNLAQIREVASRFVEKEERLDLLILSAGINVHQYGETHDKIERHFQVNWLGQFYLTNLLWPLLRKTAKLPDTPAPRVVFESSEQHRAAPSGVKFGSLEEINNPDLGPLERYGRTKLAIILGVKYGLLEKVIKPNGDNIYALSVHPGAVNTAMQQQWKDAYPGLFGKLLTTVMLAAGRNVEQGSYSALYAAISPEVEEKGWNGYYLKDVGQPGKESSLASDSVLGAALWDLSHRMIRDILGNDAVADWASA

SEQ ID NO: 4245 - protein, 219 aa, Roseovarius nubinhibens
MTHIHPLKNAALALSILLGCWASANPAEAAETRTLTVAGGCFWCVESDFESVPGVSEVVSGYTGGKVKNPDYKQVTRGGTGHYEAVQIHYDPARVSRDTLLSMFFRSIDPTDAGGQFCDRGASYRSAIFVSNPAEKAAAEAAKAKAAKQLGQKIVTPILPAATFYEAEAYHQDYYKGTKLVVTRAGPKKQSSAYKFYREACGRDQRVKQLWGKSAPFTG

SEQ ID NO: 4246 - protein, 891 aa, Phaeosphaeria nodorum
MSVAIENKAGVPLPPPTEHQPQPYAASKSIQLPPSPPETVNGDDSKSNASNSEPDFALPPPTTIPTKTLDVDQKTPDAHVPRDPRLIRLTGVHPFNVEAPLTDLFNEGFLTSPELFYVCNHGAVPEVHDSECLDWEFSVEGLVANPLKITLRQLLEEYENVTYPITLVCAGNRRKEQNVVRKSKGFQWGPAGLSTALFTGVVMKDIIERAKPLKRAKYVCMEGADKLPNGYYGTSVKLNWVMDPNRGIMLAHGMNGEMLRPDHGKPLRAVIPGQIGGRSVKWLKKLIITAEPSDNWYHIYDNRVLPTTVDPDEAAKNPKWWMDDRYAIYDLSPNSAIARPAHDEKLEIKSAPKSYKVEGYAYSGGGRRITRCEVSLDKGKTWRLANIDYAEDKYRAHEDRELFGGRLDMDWRETSFCWCFWNLDIAIAELQETDDIVVRVMDEAMCIQPRDMYWSVLGMMNNPWFRIVIHKEGDTLRFEHPTQPALMPGGWMERIKKAGGNLTNGYWGERINGQEPEHAAIEDAKEIKMTKDGVDKQISIDELRKHDNAENPWFVVNGEVYDGTAFLEGHPGGAQSIVSVAGLDASDEFMAIHSETAKAMMPDYHIGSLDEASRKVLAEGEPVNESTEPRPVFLDARIWNRALLHAKTPVSWDTRIFTFKLDHDQQALGLPTGQHLMIRLRDPVTREASSASYTPISQTSKLGFCDVLIKVYADTQEKVGGKMTKALDAIPVGHFVDFKGPIGKFEYLGNGRCSINGKQRSVKKLYMVCGGSGITPIFQVLRAVMQDKNDPTHCTVLNGNRLVEDILCREDLDVFARENPERCKLLYTLTKGPEDWEGLRGRIGKELLGEQCKVDSEGSSLVLICGPEALEKSTHKALNEMGWRDEDLMFF

SEQ ID NO: 4247 - protein, 463 aa, Medicago truncatula
MHRLDRGDVWKNKARSLQLQLRDRFRVAVDRHWRRRHNRTISPDADGYFSSTLQRWLNRIRDFRRDSLPSSTSFYRKRVMRDFSSEEESTILRMMQAVAVPILGNVCHVFMNGLNRVQVYGLEKLHTALLERPKGKPLLTVSNHVASMDDPLVIASLLPPQVLLNARNLRWTLCATDRCFKNPVTSAFFRSVKVLPVARGDGIYQEGMDLALSKLNNGGWVHIFPEGSRSRDGGKTMGSCKRGVARFVLDGDSMPVVIPFVHTGMQEIMPIGASIPRIGKMVTVIVGDPINFDDILNMEKGPDVPRKRLYDAVAARIGDRLYELKAQVDTLAMEQETRLQDRSPHSSERVSGILQQVDWELFGMNDFLSSADDDSMQTPETVVLPNTSVSEQHQQSHSKRVGFSYRMRGYMDQMELMSFAARGLFMNNNETKDSSGFSREIRPLKAWKQFFDAHVLKQWNYSM

SEQ ID NO: 4248 - protein, 447 aa, Unknown
  Rhodococcus sp. RHA1
MSTRDQVAEIYEQVRLRNAGEPEFHQAAAEVFESLQVVLDHHPHYADSGLIERLCEPERQIIFRVPWVDDSGNVHVNRGFRVQYNSVLGPYKGGLRFHPSVNLGIVKFLGFEQIFKNALTGLPIGGGKGGSDFDPKGRSEAEIMRFCQSFMTELHRHIGEYTDVPAGDIGVGGREIGYLFGQYKRLTNSYESGVLTGKGLTWGGSQVRREATGYGVAYFVAEMLKAANSSLDGKTVVVSGSGNVAIYAIEKVHQLGGIAIASSDSSGYLVDEKGIDLELLKEIKEVRRGRISEYADTVPHARFVPNGSIWDVPCDVALPCATQNELDEAAAKTLVANGVQAVAEGANMPTTPQGVQVFRDAAVAFAPGKAANAGGVATSALEMQQNASRDSWGFEYTDERLAGIMRGIHERTVATAAEYGMPGDYVHGANIAGFVKVADAMISLGVI

SEQ ID NO: 4249 - protein, 468 aa, Bacillus subtilis
MFNSIGVIGLGVMGSNIALNMANKGENVAVYNYTRDLTDQLIQKLDGQSLSPYYELEDFVQSLEKPRKIFLMVTAGKPVDSVIQSLKPLLEEGDVIMDGGNSHYEDTERRYDELKEKGIGYLGVGISGGEVGALTGPSIMPGGDRDVYEKAAPILTKIAAQVGDDPCCVYIGPKGAGHFTKMVHNGIEYADMQLIAEAYTFLRETLRLPLDEIASIFETWNQGELKSYLIEITAEILRKKDEKTGQPLIDVILDKTGQKGTGKWTSMQAIDNGIPSTIITESLFARYLSSLKEERMAAQDVLAGPEAEEKHLDKDTWIEYVRQALYMGKVCAYAQGFAQYKMSSELYGWNLPLKDIALIFRGGCIIRADFLNVISEAFSEQPNLANLLIAPYFTDKLHAYQTGLRKVVCEGISTGISFPCLTTALSYYDGYRTGRSNANLLQAQRDYFGAHTYERTDMDGVFHTNWSE

SEQ ID NO: 4250 - protein, 509 aa, Bacillus subtilis
MVLDANIKAQLNQYMQLIENDIVLKVSAGEDDTSKDMLALVDELASMSSKISVEKAELNRTPSFSVNRVGEDTGVTFAGIPLGHEFTSLVLALLQVSGRPPKVDQKVIDQVKKISGEYHFESYISLTCHNCPDVVQALNMMSVLNPNITHTMIDGAAYKAEVESKNIMAVPTVYLNGESFGSGRMTLEEILAKMGSGTDASEFADKEPFDVLVVGGGPAGASAAIYTARKGIRTGVVAERFGGQVLDTMSIENFISVKATEGPKLAASLEEHVKEYDIDVMNLQRAKRLEKKDLFELELENGAVLKSKTVILSTGARWRNVNVPGEQEFKNKGVAYCPHCDGPLFEGKDVAVIGGGNSGIEAAIDLAGIVNHVTVLEFAPELKADEVLQKRLYSLPNVTVVKNAQTKEITGDQSVNGITYVDRETGEEKHVELQGVFVQIGLVPNTEWLEGTVERNRMGEIIVDKHGATSVPGLFAAGDCTDSAYNQIIISMGSGATAALGAFDYLIRN

SEQ ID NO: 4251 - protein, 182 aa, Listeria monocytogenes
EERGFRQVTGFKLGPWNYRFGRRQKKAFVESVRRALYFSKMACYAQGFAQMRAGSEEYNWDLQYGEIAKIFRAGCIIRARFLQKITDGYNQDKNVKNLLLDPYFKDIAHNYQGDLCTVVAEAVKAGIPVPTFTAAISYYDSYRSEVLCANVIQAQRDYFGAHTYERVDKPGVFHTEWPQVED

SEQ ID NO: 4252 - protein, 511 aa, Haemophilus influenzae
MIIVNAFKKSLIVAASFASLSLFNSATAELVYKPLEQPVEPAKPDLKIESVNEKFAEKYPNQYNSWRSTAKGNGEKIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAAKDKAEGRPHNNLSFNSAARTEKRAEICANCHVEYYFAGDIKQVTFPWDNGQTADDIEKYYDDIGFTDWTHSLSKAPMLKAQHPDFEIWSLGMHGKNGVTCVDCHMPKVQGADGKVYTDHQIQNPFEAFDRTCANCHDQSKEKLRDIVTSRKKEVKDVMGRLEDQIVKAHFEAKAAWDAGATKEEMEAALMDIRHAQWRWDYTAASHGGHMHAPEVVLHVLASGLDKVADARTKLAVILTKHGVKTPVQIPDISTADKAWKVMGIDIEKERKAKEEFLKTVVPQWEQQAREKGLLVDPPAQK

SEQ ID NO: 4253 - protein, 425 aa, Wolbachia endosymbiont
MTNVSERIYDSKNSLKFLDDEIYQSIERELQRQRSQLQLIASENFASKAVMEAQGSFLTNKYAEGYIGKRYYCGCEYVDEVENLAIERLCKLFNVRFANVQPHSGSQANQAVFASLLTPGDTILGLSISCGGHLTHGAAPNLSGKWFKSIQYAIDRGTCLLDMDEVERLALEHKPKLIIAGASAYPRRMDFKRFREIADKVSAYLLADIAHYAGLIAAGEYPSPAKYAHIITSTTHKTLRGPRGGVVITNDEALHKKVQSAVFPGLQGGPLMHVIAAKAVAFKEALAPEFKAYIKRVVENAKVLAQALQKHGLSVITGGTDSHIVLVDLRPQKLTGKGAVDSLERAGITCNKNSVPFDMEKPTITSGLRFGTAAETTRGLKAENFKEIADLINEVIQGLINGNNSDVERIVKNKVKKICDDFPIY

SEQ ID NO: 4254 - protein, 369 aa, Dendrobium crumenatum
MACSPIGFEGYEKRLEITFSEAPLFVDPHGHGLRALTRPQIDSILEPAKCTIVSQLSNKHFDSYVLSESSLFVYPCKMILKTCGTTRLLLSIPVILDLAAELSLSVTAVKYSRGSFIFPGAQPAPHRSFSEEVAVLNQFFGGLGSGGNAYVIGNPAHPNLNWHVYYASEKPEQPMVTIEMCMTGLNTEKASIFFKNSVPRHESSAKEMTKRSGICDIIPEMKICDFEFDPCGYSMNGINKQALSTIHVTPEDGFSYASYEAMGFKPSAISYRNLIERVLRCFEPANFSVAVTIFGGRPFACSYGQKVSVNGYNCKNLVQQDLSGGGLLLYQSFKASSDGSASPRSILYCWEAEAEDEEENGVKCKKKLF

SEQ ID NO: 4255 - protein, 323 aa, Triticum aestivum
  misc_feature (58)..(58): Xaa can be any naturally occurring amino acid
  misc_feature (67)..(69): Xaa can be any naturally occurring amino acid
  misc_feature (71)..(74): Xaa can be any naturally occurring amino acid
  misc_feature (76)..(80): Xaa can be any naturally occurring amino acid
  misc_feature (82)..(83): Xaa can be any naturally occurring amino acid
  misc_feature (89)..(89): Xaa can be any naturally occurring amino acid
  misc_feature (99)..(99): Xaa can be any naturally occurring amino acid
  misc_feature (102)..(103): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(111): Xaa can be any naturally occurring amino acid
  misc_feature (114)..(114): Xaa can be any naturally occurring amino acid
  misc_feature (116)..(117): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(131): Xaa can be any naturally occurring amino acid
  misc_feature (138)..(138): Xaa can be any naturally occurring amino acid
  misc_feature (142)..(143): Xaa can be any naturally occurring amino acid
MAASTAAVLSPPTVAGLLLAPSPRAAVSFRGASSSAARRSVTTRGGGGPFLKKGHTPXQTQGGGRFXXXNXXXXNXXXXXPXXNGKTHXEAGDERAKEXAGXXKXNDPXGXNPXDXXAXGTXGHXDANNXXATTSNGXDPPXXGGAPPRRPAPAGAGRGKRPRHQPHNKRRGGTTAGRGRGGERTTNPDRQRNRGRAPRGHRRKKKKKRGGGPRGPPEGPSQPGPSSRDKGAPKGGDKKQGTGAANAGTGKRETGEPGKGTEPGGGTKGTTTHKQSAKGKKNKGTGGKQRASAPPETRPPAPTRDTQHESHGPKGAAHTPEPR

SEQ ID NO: 4256 - protein, 335 aa, Unknown
  Populus alba x Populus tremuloides
MVVASPTQIHGEKLLAIELPVIDLSGERSMVSNLIVKACEEYGFFKVRNHGVPHDIIARMENESSNFFAKTFDEKQKAGLANSFGYGCKNIGFNGDTGEVEYLLFNTNPLSIAERSKTISNDPTEFSSAMSGYIEAVRELACELLDLMAEGLWVPDRSVFSRLIRDDDSDSIIRLNHYPPMPILCKDKDSSSPCNHNRVGFGEHSDPQILTILRSNDVGGLQISLNDGVWVPVTPDPSAFCVNVGDLLQAMTNGRFVSVRHKALTNSYKSRMSMAYFAAPPLNARIAVPPEMVTPIKPALYRPFSWAEFKKAAFALRLGDSRLGLFRMEEYEQVA

SEQ ID NO: 4257 - protein, 482 aa, Vibrio vulnificus
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKKEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 4258 - protein, 158 aa, Streptococcus pneumoniae
MTSLYDFSVLNQNNQATPLDSYRGKVLLIVNTATGCGLTPQYQGLQELYERYQDQGFEILDFPCNQFMGQAPGSAEEINAFCSLHFQTTFPRFAKIKVNGKEADPLYVWLQDQKSGPLGKRVEWNFAKFLIGRDGQVFERFSSKTDPKQIEEAIQTLL

SEQ ID NO: 4259 - protein, 515 aa, Geobacter sulfurreducens
MTMSTASRTNCLVYLIGAGPGDPGLITVRGRECIARADVVIYDYLANDELLSFARPDAELIYAGKVGGQHNRAQWQINELLVRKALEGRIVARLKGGDPFVFGRGGEECEALVTAGVPFEVVPGVTAGIGAAAYAGIPLTHRNVTTSVAFVTGHESPGKKSSDIDWEGLSLGSGTVVFYMGVKSLPHITENLMAHGRRADTPVALVRWGTRPEQEVLVGTLADIADKVRRTGFKAPAITVVGEVVRLRKTLRWFDNRPLFGRSIMVTRAADQAGEFSVMLRSLGARVLECPTIAIAPPESWDDLDSAISRIDTFDWAIFTSFNAVRFFFQRLDAAGRDSRALGACRICVVGPKTAEALAPYGIRPDLVAADYKGEGVIEALRDVPLAGKRVLFPKGDRARDVIPTGLAAFGAHVEAPVAYRNAAPDALPAGTIEELEDRRIHCVTFTSSSTVQNLAAILGENRMLHLLEGVIIASIGPITSRSCRELGLQVHIEPQEYTLAALTAEMVRHFSAPA

SEQ ID NO: 4260 - protein, 357 aa, Silicibacter pomeroyi
MARFHDLEVTDIHKTIRDAVVVTLKPANGAASEFDFTQGQYLTFRRAFEGEELRRSYSICSGKDDGVLQIGIKRVDGGAFSTWANEELKVGDTVQAMPPMGGFHTPLDPGAEKQYLGFAGGSGITPVLSIIKTTLAREPRSQFTLVYANKGVNTIMFREELEDLKNLYMGRFNVLHILETDAQEIELFTGLVTEEKCGQLFEHWIDIQHVDTAFICGPEPMMLGIAAALRAHGLSDAQIKFELFASAQPGRAKRKAVSSEAAKGANQTRAAITLDGATQSFDMPKDLSILDAALQNSLDAPFACKAGVCSTCRCRVLEGEVEMVANHALEDYEVEKGYVLSCQAYPLTDTVVVDYDQ

SEQ ID NO: 4261 - protein, 382 aa, Haemophilus influenzae
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKTCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVTSTRSGYAGDLICRIVVETPVNLTSEQKELLQKLEESLQGKDLSKHAPKSSGFLDGVKKFFDNLGKSDK

SEQ ID NO: 4262 - protein, 476 aa, Bacillus cereus
MQNKIIVMFQKDFRLYDNPALFEAVQSGEVLPVYIQDETFSIGSASKWWLHHAVIDVKKQLEALGSTLIIRKGRTEEEILSLIEQLDITAVYWNICYDPDRLQSNQKMKMMLEDKGIICKEFNSHLLLEPWIIKKKDNTEYKVFTPFYNAFQKQVIPKPFSRVQSIKWGNSLPASLSVSELQLLPIIPWTSHMEVIWDPTEEGAYKTFKKFFSSKLVSYSEGRDFPGQNVHSMLAPYLSFGQISVKLMFHYLINKSTERQCSLFEKQVNSFIRQLIWREFSYYLLYHYPFTVYKPLNKSFENFPWDKEEELLRVWQKGKTGYPFIDAGMRELWQTGFMHNRARMAVASFLVKHLLIPWQEGAKWFMDTLLDADIANNTMGWQWVAGSGADASPYFRIFNPITQGEKFDKNGEYIRRWVPELRDIPNKYIHKPWEAPEHILQKSNIKLGDTYPFPIVDHKAARERALCAYKSMKEFV

SEQ ID NO: 4263 - protein, 152 aa, Haemophilus influenzae
MHTTTRTLTQHKRIALVAHDSCKKNLLNWTQKHKEALKPHILYATGTTGHILERETGLSIQSLLSGPMGGDQQLGGLIAEKKIDMMIFFWDPMNAAPHDPDVKALMRIATVWNIPVAINQSSADFLLTSVLFEQDVEIDVLDYEGYLKERLA

SEQ ID NO: 4264 - protein, 965 aa, Thermus thermophilus
MDPLWYKDAVIYQLHVRSFFDANNDGYGDFEGLRRKLPYLEELGVNILWLMPFFQSPLRDDGYDISDYYQILPVHGTLEDFKRFLDEAHGRGMKVIIELVLNHTSIDHPWFQEARKPGSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVFLPLLWSPQRREGPGLFARTHGQPGYFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGAVEEDLARLAYDVERAVHLALEALEAELWAFAEEVADYLHAAFLQAYRSALPEEALEEAGWTRHMAEVAAEHLHREERPARKRIHERWQAKAGKA

SEQ ID NO: 4265 - protein, 1012 aa, Glycine max
MRVLFLFLFFQFLHFHFPKTLSAPISEYRALLSLRSAITDATPPLLTSWNSSTPYCSWLGVTCDNRRHVTSLDLTGLDLSGPLSADVAHLPFLSNLSLASNKFSGPIPPSLSALSGLRFLNLSNNVFNETFPSELSRLQNLEVLDLYNNNMTGVLPLAVAQMQNLRHLHLGGNFFSGQIPPEYGRWQRLQYLAVSGNELEGTIPPEIGNLSSLRELYIGYYNTYTGGIPPEIGNLSELVRLDAAYCGLSGEIPAALGKLQKLDTLFLQVNALSGSLTPELGNLKSLKSMDLSNNMLSGEIPARFGELKNITLLNLFRNKLHGAIPEFIGELPALEVVQLWENNFTGSIPEGLGKNGRLNLVDLSSNKLTGTLPTYLCSGNTLQTLITLGNFLFGPIPESLGSCESLTRIRMGENFLNGSIPRGLFGLPKLTQVELQDNYLSGEFPEVGSVAVNLGQITLSNNQLSGVLPPSIGNFSSVQKLILDGNMFTGRIPPQIGRLQQLSKIDFSGNKFSGPIVPEISQCKLLTFLDLSRNELSGDIPNEITGMRILNYLNLSRNHLVGGIPSSISSMQSLTSVDFSYNNLSGLVPGTGQFSYFNYTSFLGNPDLCGPYLGACKDGVANGAHQPHVKGLSSSFKLLLVVGLLLCSIAFAVAAIFKARSLKKASGARAWKLTAFQRLDFTVDDVLHCLKEDNIIGKGGAGIVYKGAMPNGDHVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNHEAHVADFGLAKFLQDSGTSECMSAIAGSYGYIAPEYAYTLKVDEKSDVYSFGVVLLELITGRKPVGEFGDGVDIVQWVRKMTDSNKEGVLKVLDPRLPSVPLHEVMHVFYVAMLCVEEQAVERPTMREVVQILTELPKPPDSKEGNLTITESSLSSSNALESPSSASKEDQNPPQSPPPDLLSI

SEQ ID NO: 4266 - protein, 242 aa, Mannheimia succiniciproducens
MAQVSMRDMLQAGVHFGHQTRYWNPKMKPFIYGPRNGVHIINLEKTVPMFNGALAELTRIASNNGKILFVGTKRAATEAVQAAALDCQQYYVNHRWLGGMLTNWKTVRQSIKRLKDLETQSQDGTFDKLTKKEALVRTREMEKLELSLGGIKDMAGLPDAIFVIGADYEHIAIKEANNLGIPVFAVVDTNSNPDGIDFVIPGNDDATRAIQLYVTAAAAAVKEGRSQQTATEEKFAEEVAAE

SEQ ID NO: 4267 - protein, 301 aa, Gossypium barbadense
LPLTMTAACGVDCANLKSAFFLDVIFIAVTTYVSVLAAKEVPLGSVEMSTASHEERPEHSGGNAEEAFLWELFGTFRYFSGTIWIILFVTALNWIGWFPFLLFDTDWMGREIYGGQPNEGANYNSGVRMGAVGLMLNSVVLGITSVLMEKLCSKWGAGFIWGVSNIVMALCFLSMLILSYVTDHMDYIGHDLPPAGIMIAALLIFSILGFPLAVTYSVPYALISTRIESLGLGQGLSMGVLNLAIVIPQVVVSMGSGPWDELFGGGNSPAFAVAGVASLTSGLIAILAIPRSSPQKIRALP

SEQ ID NO: 4268 - protein, 344 aa, Zea mays
  misc_feature (63)..(63): Xaa can be any naturally occurring amino acid
MLPRGAADKIISHTLAGAMLSGLGLWHLFNHMRLLVSLAPTAPSASSSRVAVLAPAAWFPAPXGVRRLEPIAMLAAGAYGLATQMLAYSPMPFRADGSIPPERLPNHEHAIIYASLLVYAGSAIYLDDDDDRAGPRHAAPAPTTLCMLLLAALFAQELFVFHVHSSTDDHAGVEARLHWFLQASAAACLAAALLGAARLPADLQLAAGLVRSASLAFQGLWCVVIGVAWVPGMLPAGCYLDGSGVHLRCRGEDSLRHAIAVVNLQFGWCMVLVTLLVVGIYVYVCKRYPAGAWSHGEVYGRLPEAEAADEDDDDSHHHDMETPNCKQLAAHDDVHEFTSLEIDV

SEQ ID NO: 4269 - protein, 370 aa, Debaryomyces hansenii
MVSITEQTAILAKYLDLSQNGKVLAEYVWIDADGNSRSKCKTLDKKPSSVEDLPEWNFDGSSTGQAPGHDSDVYLRPVAFYADPFRKGDNIIVLTECWNNDGTPNKFNHRHESAKLMKAHADEEVWFGLEQEYTLFDQFDQPYAWPKGGFPAPQGPYYCGVGTGKVYARDLIEAHYRACLHAGVDISGINAEVMPSQWEFQVGPCEGIQMGDELWIARYLLQRVAEEFGVKVSFHPKPLKGEWNGAGCHTNVSTKSMRLPGGMKSIEVALSKLAKRHKEHMLLYGADNDQRLTGRHETASIEGFSSGVANRGASVRIPRSVAKEGYGYFEDRRPASNIDPYLVTGIMVETICGSIPDADMFKEYARESSD

SEQ ID NO: 4270 - protein, 187 aa, Enterococcus faecium
GIEYGDMQLIAESYDLMKNILNLSVEEMADIFKEWNQGELDSYLIEITADILTRKDDEGTGKPVVDVILDAAGNKGTGKWTSQSALDLGVPLPLITESVFARYISAYKEERVQASKILSRTNDFEFTGDKKELVEKIREALYFSKIMSYAQGFAQLRVASKEFDWDLPFGEIAKIWRAGCIIRARFL

SEQ ID NO: 4271 - protein, 487 aa, Unknown
  marine gamma proteobacterium HTCC2080
MNAEAKLINVAQRNCDFHRGFLALQDERNNWVSNIRGNLPKDLTGTLFRNGPGAMNAGSEAYAHWFDGPGMISAVTFIDGKVHFKNRYVRTPKYLGDRQQGRVSSRGFGTQIKGGWRKNILKPLSNPANTGVSWHGDKLCAFYEGGQPYRLNPETLETLGPEYYGSTLNPRTTISAHGKIHPRTGNQINFGINLVGLGWRGIKCALDVHDIPANGHNVRSCRIPLDRFPFLHDFGLTENYAIFVVSSVNFKLGGPLLGTTTLSENLRYNDQQAMRGIVVDLRTMTVAQEFELPPGIVVHFANSFEADSELVTDFFHATSTEGFAWLGDVFDVQTVAGAQLQRLRINLKTGHTSLEAFDHAPAGEFPAWNTNRTGLRSEHCFYVGHAPGREHGFFNSFVTLNTHTGAFTQTDVGENRYTSEALFTAKACPKTQDDGYLLAVVYDARSHRSEIQIRDAQNPEEEIAAVLLDHHIPFGFHGHFTANTFLK

SEQ ID NO: 4272 - protein, 498 aa, Colwellia psychrerythraea
MSETSNQNQHNQHKPRLSFWQIWNVSFGFLGVQFGFALQNANASRILSDLGADLHSLSLFWLVAPIMGLIIQPIVGSASDKTWNRLGRRNPYILAGGVAAAIGMLLMPNSATLASFITPLFFGAMMLALMDASFNLAFQPFRALVSDMVPAEQRNVGYSIQSFLINIGAVFGSILPFVLTNVIGLENTASSGQVAPSVIWAFYIGATVMLGSVLWTVLRTKEYQPGTNGLAELEEQKESQSLSEKLVEFFSLVKTMPKTMKQLALVQFFSWFALFIMWVYTMPAIAQHIWGIDAKWFDPTYLESVGTIPAHIAKAKGTAGDWVGIIFAAYSLFAAIASIFMAKVANKIGRKLTYSLSLLAGGIGYLSIMLVHNPELTLVNLGITQISVPQGAVSLFLPMIGVGIAWAAILAMPYAILAGSLPVKQTGVYMGIFNFTIAAPQIVSGIFAGWILTAVFDNQAIYIIMLAGISMLLGAISVYFVKEDTEQAIVTKQVNLTS

SEQ ID NO: 4273 - protein, 603 aa, Triticum aestivum
  misc_feature (40)..(40): Xaa can be any naturally occurring amino acid
MAAEVEMGAGGALLEGGAGGRRGGRRRQPLGWRCMPFIIXTETFEKVGSVGVRANLTVYLVKRYNIGRLAAANITNIFYGTLNFAPLLGAFISDAYLGRFRTLAYGSFFSLLGMLGLTLSASVPALKPPGCSQTAQLGGHCDSPSTLQLSVLYISLAFLTIGGGAIRPCSLPFGVDQFDMTDEKSRKGLNSYYNWYYGTTTAALVFSMTILIYIQNSISWPIGFGIPTFFMLMSIIILFMGTRLYVHVPPEGSIFTGIAQVLVASFKKRRLKLPHPDNINQQELLLFSPPIGGHRIFRLPLTSQFRCLNKGAIVRDGDINDDGSARNSWELCSIQQIEEVKCLLRIVPICIVRIICFVALAQQFTYIILQTLTMDCHLGTHFEIPAGSVISISLIALTAFLPIYGRILVPIARRFTGVESGITLLQRQGIGLVISPISMVVAGLVEHKRRNSALSNGGKSPMSVMWLAPQLILMGIAEAFNAVGQIEFYNKQFPEQMLTLAGSLFFVTLAGANYLSTALANITRKVTTRDGHTSWLTDDINLGKLDYYFYFIALIGVLNLFYFLICSHYYQYKSMSLHAEESIKVHTKEEAEAEADANTAPKK

SEQ ID NO: 4274 - protein, 518 aa, Funaria hygrometrica
RSSTKKSRKERRPNPFAQDGYHGNLQILKNQPKARILDKYVLGRELGRGEFGITYLCTDKETQEIFACKSISKKKLRTAVDVEDVRREVAIMKHLPEHPHVVTLKGAYEDDNAVHLVMELCEGGELFDRIIARGHYTERGAAQVTRTIVEVVQACHRQGVMHRDLKPENFLFANKNENSPLKAIDFGLSVFFKPGEKFSEIVGSPYYMAPEVLKRNYGPEVDVWSAGVILYILLCGVPPFWAETEQGVAQAILRGILDFKRDPWPKVSDSAKSLVRHMLEPDPKARYIAQQVLDHPWLQNAKKNPNVPLDAVRSRLKQFSAMNKLKKRALQVIAEHLGGEEIDGLKEMFEKLDSDNTGAITFEKLKMGLIEIGSQLTEHEVRLLMEAADVDGNGTLDYGEFVAATVHLQRLDDDEHLRRAFDVFDVNESGFIEVEELREAVGQSLMGSPSESDVVQAILSEVDLDKDGRISYEEFAVMMRRGTDWRKASRQYSRDRFNSLSMRLLRDGSLNPPSYSMR

SEQ ID NO: 4275 - protein, 161 aa, Musa acuminata
SSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 4276 - protein, 311 aa, Staphylococcus epidermidis
MSITYPGTVYLIGAGPGNPNLLTKKAERLIRSADVILFDRLVNPFILQYASSQTKVINVGKKPYCKHIQQEEINQKIVEVANQYQCVVRLKGGDPAIFGRITEEVQTLENHHIHYEIVPGVTSASAAVATMNMGLTMRSIAPSVTFSTGHFKDSVNHDTDIRNLINGGTLAIYMGVKRLGQIIKQIESYTNEDYPIAIVFNASCYNEKIVIGHLSTIEEQLVSQQLEGHPGICILGNILDDINRTLLNNNKNDKGNLYLIKGDKERAIAKAETLYDEGIQCLIDFDHSYHISQQNVYNEMIKHKSIKTIYV

SEQ ID NO: 4277 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTLKDEALLKQIEYLLRSKWIPCLEFCPKGFVWRENHRSPGYYDGRYWTMWNLPMFGCTDAVQVAKEVEECKKEYPHAFIRIIGFDNNRQVQCVSFIAYKPTGY

SEQ ID NO: 4278 - protein, 422 aa, Coccidioides immitis
MSSNGPVQRKPPAPELASDSTSYRGDTGRHKYARPEGNYGLFLQIVRSLLIVTWFNCCCISIVATQAIGLPLYLVNKRWFYSYMAMTKRFFGITITALTQWSSPTPVRISGDSSMQGQFSLRNDGTVVTKFPERLVLIANHQVYTDWLYLWWVSYTSNMHGYIYIILKESLKYIPFIGQGMMLYGFIFMARKWIEDKPRLQHRLQKLKTSHGKSPDGLPVFDPMWLLIYPEGTNLSRNTKRRSDAYCEKQGIAPRKHTLLPRSTGLFFCLQKLRGTVDYVYDCTVGYEGPPKGSYAESYFTLRSTYLRGRPPKAVNFYWRRFAILDIPLNDQKEFEDWIYKRWGEKDQLLERFAETGRFPPFEPETTSSTGFKEERNQATGSANDGYIESEIRLRHWSEAGRVFTILITLGLVLKFLPQIWN

SEQ ID NO: 4279 - protein, 801 aa, Staphylococcus epidermidis
MAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTAFTSLKVSGCDLYSAGQIVEDEDVHGVEIFNSVDNIYKKVYLSQGQVVGAVLYGDTDDGSRFYNMMKKHETLEDYTLVSLLHKGDEDAGTSIADMSDDETICGCNGVDKGTIVNAITTKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYLRIMEAKKAVENEPWETIVENKEAQKIFEVEKV

SEQ ID NO: 4280 - protein, 180 aa, Musa acuminata
MASSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDNNRQVQCISFIAFKPPGY

SEQ ID NO: 4281 - protein, 182 aa, Mycobacterium tuberculosis
MTSNQKAILAGGCFWGLQDLIRNQPGVVSTRVGYSGGNIPNATYRNHGTHAEAVEIIFDPTVTDYRTLLEFFFQIHDPTTKDRQGNDRGTSYRSAIFYFDEQQKRIALDTIADVEASGLWPGKVVTEVSPAGDFWEAEPEHQDYLQRYPNGYTCHFVRPGWRLPRRTAESALRASLSPELGT

SEQ ID NO: 4282 - protein, 152 aa, Brassica napus
  misc_feature (2)..(3): Xaa can be any naturally occurring amino acid
  misc_feature (12)..(13): Xaa can be any naturally occurring amino acid
  misc_feature (16)..(16): Xaa can be any naturally occurring amino acid
  misc_feature (19)..(19): Xaa can be any naturally occurring amino acid
  misc_feature (26)..(26): Xaa can be any naturally occurring amino acid
  misc_feature (29)..(29): Xaa can be any naturally occurring amino acid
  misc_feature (35)..(35): Xaa can be any naturally occurring amino acid
  misc_feature (40)..(41): Xaa can be any naturally occurring amino acid
  misc_feature (47)..(47): Xaa can be any naturally occurring amino acid
  misc_feature (49)..(49): Xaa can be any naturally occurring amino acid
  misc_feature (51)..(53): Xaa can be any naturally occurring amino acid
  misc_feature (63)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(85): Xaa can be any naturally occurring amino acid
  misc_feature (91)..(91): Xaa can be any naturally occurring amino acid
  misc_feature (100)..(101): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (125)..(125): Xaa can be any naturally occurring amino acid
MXXSMLSSAAVXXSPXQAXMVAPFTXLKXSAAFPXTRKAXXDITSIXSXGXXXTCMKVWPPDXKXKFETLSYLPDLTEVELXKEXDYLLRXKWIPCVEFXXEHGFXYXEHXSTPGYYDGRYWTMXKLPLVGCTDSAQVLKEVQECKTEYPNA

SEQ ID NO: 4283 - protein, 335 aa, Mannheimia succiniciproducens
MSIQASPVTILGAGSYGTALAIALSRNGYPTYLWGHNPTACAQMAQERQNARFLPDISFPEALRVESDLKSAVEKSKDLLIVVPSHVFGEVIQQIKPFLHNRHRIIWATKGLERGTGRLLQNLVEQELGSQYPLAVLSGPTFAKELAAGLPTAITLAAENEQFAKEFQARIHCSKHFRVYINNDMVGVQLGGAIKNVIAISAGMSDGMGFGANARTALITRGIAEISRLGVSLGANVNTFMGMSGLGDLVLTCTDNQSRNRRFGMMLGQGVDARTAMDEIGQVVEGYYNTKEAYMLAQKQGIEMPITEQIYQVLFCGKDAKEAATALLGRKSKVE

SEQ ID NO: 4284 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 4285 - protein, 235 aa, Thermosynechococcus elongatus
MVTTEPALADLQEQLYNGNEKSQLAAMSTLSTAGTEGYHLLQEFLKDSATFSPPPAPWIRGQAYRLLFHSPEASVQAFLQQHYPQGVIPLRSDRGVDYQELAKLLVAEKFEAADRLTTQKLCELAGPLAQKRRWLYFTEVEQLPIPDLQTIDQLWLAFSLGRFGYSVQRQLWLGCGQNWDRLWEKIGWRQGKRWPRYPNEFIWDLSAPRGHLPLTNQLRGVQVLNALLNHPAWTA

SEQ ID NO: 4286 - protein, 464 aa, Bacillus anthracis
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 4287 - protein, 502 aa, Arabidopsis thaliana
MEVEGKGGEAGTTTTTAPRRFALPVDAENKATTFRLFSVAKPHMRAFHLSWFQFFCCFVSTFAAPPLLPVIRENLNLTATDIGNAGIASVSGAVFARIVMGTACDLFGPRLASAALTLSTAPAVYFTAGIKSPIGFIMVRFFAGFSLATFVSTQFWMSSMFSGPVVGSANGIAAGWGNLGGGATQLIMPIVFSLIRNMGATKFTAWRIAFFIPGLFQTLSAFAVLLFGQDLPDGDYWAMHKSGEREKDDVGKVISNGIKNYRGWITALAYGYCFGVELTIDNIIAEYFFDRFHLKLQTAGIIAASFGLANFFARPGGGIFSDFMSRRFGMRGRLWAWWIVQTSGGVLCACLGQISSLTVSIIVMLVFSVFVQAACGLTFGVVPFISRRSLGVVSGMTGAGGNVGAVLTQLIFFKGSTYTRETGITLMGVMSIACSLPICLIYFPQWGGMFCGPSSKKVTEEDYYLAEWNDEEKEKNLHIGSQKFAETSISERGRATTTHPQT

SEQ ID NO: 4288 - protein, 334 aa, Oryza sativa
PRVAPRRPRVCSPISRGSRRRIESSRVLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESLLHLVFRLCGGQ

SEQ ID NO: 4289 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGAHSAFDAIGGAYAENLPVILISGAPNNNDHAAGHVLHHALGKTDYHYQLEMAKNITAAAEAIYTPEEAPAKIDHVIKTALAKKKPVYLEIACNIASMPCAAPGPASALFNDEASDEASLNAAVDETLKFIANRDKVAVLVGSKLRAAGAEEAAVKFTDALGGAVATMAAAKSFFPEENPHYIGTSWGEVSYPGVEKTMKEADAVIALAPVFNDYSTTGWTDIPDPKKLVLAEPRSVVVRRIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKLL

SEQ ID NO: 4290 - protein, 371 aa, Bacillus anthracis
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLEFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 4291 - protein, 201 aa, Chlamydomonas reinhardtii
  misc_feature (75)..(75): Xaa can be any naturally occurring amino acid
MLLTRKNVAVRPARAARRDVRAMSLLGNLFGGGSKPTSSTSNFHQLSALDIDKKNVDFKSLNNRVVLVVNVASKXGLTAANYKEFATLLGKYPATDLTIVAFPCNQFGGQEPGTNAEIKAFASARGFSGAGALLMDKVDVNGANASPVYNFLKVAAGDTSDIGWNFGKFLVRPDGTVFGRYAPTTGPLSLEKYIVELINSR

SEQ ID NO: 4292 - protein, 511 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQAARGVSFLPGIKQRLLSFIFRKTWNEESDQTLRVQHLKKKFYFHFQDYVDLIIWKVQFLDRHHLFIKFGSVDGGVSRSTEQNSAFFAVYNMETTDIVSLYQNSSEELYSLFEYFYDHFHTNPQNSSHGNFISSHSNNVHALDQLRTIKNKANSTSQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 4293 - protein, 1072 aa, Unknown
  Frankia sp. CcI3
MPDVTQYDDTPYADGPATAADGPATTATTATISPASSHARSGAPRQGSAAAVGRNGARRLPAAAIPRFADRHIGPDPSSQREMLDALRVESLAALTDAAVPASIRDHDLDLPAALSEPAVLAALRAFGSRNRPVSSMIGLGFHPAVMPGVIQRNVLENPAWYTAYTPYQPEISQGRLEALLNFQTMITDLTGLAVAGASLLDEPTAAAEAMQIAFRTAKGSRATFLIDADTLPQTVSVVATRAEALGINVVVADLAAGLTAVGPAQLDAAFGLLLSYPGPAGVLRDVRAVIASARERGIVVTIAADPLALTLLRAPGDLGADIAVGSTQRFGLPLSFGGPHAGYLAVRKGLERSLPGRLVGVSVDADGAPAYRLTLQTREQHIRREKATSNICTAQVLPAVLASMYAVYHGPEGLAGIARRIHGHAVRLAEGLRAAGVTVVHDAFFDTVLAAVPGRATQVVADALARGVNLRLVDDDHVGISCNETTGQAELEAVRSAFGVGPEATAGITWTGTGTGTEIRTGAWTGSVAAANDHLVARADQADQADQADQAADEPVALPAELVRTDPYLQHPVFHDHRSETAMLRYLRRLSDLDLALDRGMIPLGSCTMKLNATTEMAAVTWPEFADIHPFAPLDQAAGYLAMIQDLERWLAQITGYAGVSLQPNAGSQGELAGLLAIRAYHRDHAVPGSVVRNICLIPSSAHGTNAASAAMAGMRVVVVSCDDDGNVDLNDLARKARANADALAALMVTYPSTHGVYEEGIGQACAIVHEAGGLVYVDGANLNALVGLARPGQFGADVSHLNLHKTFCIPHGGGGPGVGPVAVVEKLLPYLPNHPLRPEAGPATGVGPISGSPWGSAGILMIPWAYIRMMGADGLRRATSVAVLNANYIAHRLHPYYPVLYAGRDGLVAHECILDLRPLTKLTGVTVDDVAKRLIDYGFHAPTMSFPVAGTLMVEPTESEDLGEIDRFCDAMISIRAEADKVGDGIWPRTDNPLHNAPHTAQMVTANEWSHAYPRSVAAYPVASLRAAKYWPPVRRIDGAYGDRNLVCTCPPVGSFAAEPVDEQILAGAR

SEQ ID NO: 4294 - protein, 125 aa, Zea mays
  misc_feature (67)..(67): Xaa can be any naturally occurring amino acid
MSFAAGSSEDQLNSSPLAMDRRPARTRSDPPHSSRGAVHDAVAVEQKQHRRPQGTGAPPVYFTAELXLACLFVAVSLALLPLVLPPLSPPPSLLLLVPVGLLAVLLALAFVPLDAHSHLAVGSSR

SEQ ID NO: 4295 - protein, 107 aa, Erwinia carotovora
MVIKPFKLEDVREALSSVGIQGLTVTEVKGFGRQKGHAELYRGAEYSVNFLPKVKIDIAIADDQLDEVIDVISKAAYTGKIGDGKIFVAELQRVIRIRTGETDEAAL

SEQ ID NO: 4296 - protein, 208 aa, Salmonella enterica
MTGKKRSASSSRWLQEHFSDKYVQQAQKKGLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALEMCRDVLAPGGSFVVKVFQGEGFDEYLREIRSLFTKVKIRKPDSSRARSREVYIVATGRK

SEQ ID NO: 4297 - protein, 356 aa, Camellia sinensis
MSLLSDLINMNLSDSTEKIIAEYIWIGGTGLDLRSKARTLSGPVNDPKKLPKWNYDGSSTGQAPGEDSEVIIYPQAIFKDPFRKGNNILVMCDAYTPAGEPIPTNKRYNAEKIFSHTDVVAEEPWYGIEQEYTLLQKDVKWPIGWPKGGYPGPQGPYYCGAGADKAFGRDIVDSHYKACLYAGINISGINGEVMPGQWEFQVGPAVGISAGDELWVARYILERITEIAGVVVSFDPKPIEGDWNGAGAHTNYSTKSMRKDGGYQVIKKAIEKLGLKHKEHIAAYGEGNERRLTGRHETADINTFLWGVANRGASVRVGRDTEKAGKGYFEDRRPASNMDPYVVTSMIAATTILWKP

SEQ ID NO: 4298 - protein, 84 aa, Burkholderia brasilensis
LIKPFKLDEVREALAEVGLTGLTVTEVKGFGRQKGHTELYRGAEYVVDFLPKVKIEVVVANEQTDQVIDAIIGAARTGKIGDGK

SEQ ID NO: 4299 - protein, 556 aa, Thermotoga maritima
MKVVKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 4300 - protein, 380 aa, Burkholderia vietnamiensis
MERASGRKAVIVGGSVGGLFAATALRARGWHVRVFEQSARELDSRGGGIVLQPPIERAFAFGGVALPANAGVDSIERIYVDAQDRVVQRLTMPQTQTGWNVIYTALKHALPDDVIHAGDAFERFQQDGERVVAQFASGRVETADLLIGADGARSTVRAQLLPDVRPAYAGYVAWRGLVDEHALPEQVLYLLRERFTFQQGGAHLFLTYLVPGADGAIEPGKRRVNWVWYRRLASERLPSLFLTRDGTQRDGSLPPGAMRDDNRAELVDAADRMLAPTLATLVDTTPAPFAQAIYDLAVERMAFGRTVLLGDAACVVRPHTAAGVAKAADNAVALAAALHDVAPGAAFDAALATWDADQRAASALVSARGIALGARLMGAA

SEQ ID NO: 4301 - protein, 351 aa, Bordetella pertussis
MSQARPATLRVAVLGAGSWGTALAAAASRRHPTVLWARDGAQAQAMAARHENTRYLPGVALPHALQVSADLAQALAHLAHDPAHALIILGVPVAGMTPLCTELAARLPALGLQAVPLVWTCKGFEEQTARLPHETVQAALGAMPGLAAGVLSGPSFAREVAQGLPVALTVASGSSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 4302 - protein, 431 aa, Thermotoga maritima
MQMFCYQCSQTANGTGCTEYGVCGKSPTVARLQDNLVFAIKGISAYYYHARELGYDDPEIAGFLDEALYSTLTNVNFDAQSFVEYALEAGRMNLKAMQLLKKAHIETYGEPTPVEVETGTKKGKGIIVTGHNLKALEELLKQVEGTNVYVYTHSEMLPAHGYPGLRKYKNLIGNLGKAWYDQRKLFAEYPVAILGTSNCVLIPSESYRDRMFTTSIARLPGVKHIDGYDYTEVIEKAKSLPDLEEKPGSYKLRTGFSTSVVVSLADKIKELVEAGKIKHFLVVGGCDVPFKRNEYYREFVQKLPKETVVITLACGKFRINDLDLGDIDGIPRLIDVGQCNDTIVAIEIAQALAKVFGVEVTELPLTLVLTWMEQKAVAILWTLLALGLKNIYVGPVLPAWVNEDILKVLTAEFGLKTISEPEKDIKEILKV

SEQ ID NO: 4303 - protein, 971 aa, Myxococcus xanthus
MSLNWKYQEPFAGRHNGPDDTELKQLLSALGVDSLDAFIDQAVPPAIRAKEPLKLATARGEHELLAALESIAAKNQVFRSFIGMGYHDTHTPNVILRNVFQNPGWYTQYTPYQAEIAQGRLEALLNFQTLVMDLTGLEVANASLLDEGTAAAEAMALALAVHQKGEESGAAFFVSDGCHPQTVEVVRTRAQPLGVEVVVGDHRTVDLSSKKFVGALVQYPTTDGAVHDYRAFGEQVHAAGGLFVVAADLLSLTLLTPPGEFGADVAVGSAQRFGVPMGYGGPHAGYFATKNAYTRVMPGRIIGVSEDAQGRRALRMALQTREQHIRREKATSNICTAQVLLAVIASMYAVYHGPSGLKAIAERVHGLTVLLARGLAKLGLKLKNDQYFDTLRVELSAAHVRAVLGAAEAARMNFRRIDEKTLGVSLDETTRPADVEDILAAFATGTGKSSAPVLADLVGDGVESAVSQALRRSSAYLTHPVFNSYHSETEMLRYIRRLEAKDLSLTHSMIPLGSCTMKLNATAEMIPVTWPQFGRLHPFAPTSQAAGYKVIFEQLEQMLTQVTGFAGCSLQPNAGSQGEYAGLLVIRAYHQSRGQGHRDVCLIPSSAHGTNPASAVMAGYKVVVTKCDENGNIDLDDLRAKAEAHKDALAALMVTYPSTHGVFEEEIREICAIVHERGGQVYMDGANLNAQVGLTSPGLVGADVCHINLHKTFCIPHGGGGPGMGPICVASHLVKFLPGHPVIQTGGSEAIGAISAAPWGSASILLISWMYIAMMGGEGLTQATKLAILNANYVAERLNAHYPVLYRGKRGKVAHECIVDLRPLKKTAGVEVEDVAKRLMDYGFHAPTVSFPVAGTLMIEPTESESKAELDRFCDAMIAIRQEIRDIEEGRMPKDNNVLKHAPHTARVVAAPEWNRPYSREQAVFPTPWVRDNKFWPSVGRLNSVLGDRKLVCSCPPIEDYMTPEPKAATA

SEQ ID NO: 4304 - protein, 404 aa, Geobacter sulfurreducens
MKAVEIKQGVFWVGAVDWAVRDFHGYETPRGTTYNNFLIMDEEITLIDTVKYDFADLTIKNIAGIVDPARIKNIIINHIENDHASSLDRIMALAPQATIYISDKGRKGIERFFDLSNWNVKSVKTGDTLCIGARTLEFLETPMLHWPDSMVTYSRHDRILFTQDAFGQHVASASRFDDEFEKSDSAAELEDAVVDYYANILMPFGQMIKTKIAEIQAKGFDIDIIAPDHGLIWRANPGKVLSMYMDMANGKANESVAIIYDTMWQSTEKMAVPIAEGIRAEGLDCRVVKLRATPMSVAIKEFWKSRGALIGSPTLNNILYPSVAEFLTHLRGLRPKNRIVGAFGSYGWGGGAVRDAYEEFKKMGLQAVEPGFQIPYRPSRADEEGAFEFGRNFARQVIEYHKGF

SEQ ID NO: 4305 - protein, 492 aa, Saccharophagus degradans
MTDEILVNCGPTETRVALVENGVLQEVYLERTRAKGFVGNIYKGKVVRVLPGMQAAFVDIGQERAGFIHVSDIETLPEGAESRPRSDIDIREVVREGQELLVQVTKDPIGTKGARLTTQLSVSARYLVYMPNTPHIGISNRIEDAEERERLRTIVEKLAAEHAEEFPDGGFIIRTVAEGATEEEMRADIPFVYHLWHDLADSVKKAKAPSIIYEDLPLFMRTIRDFMRSNIEKVRIDSRESYARMDKFAKHYAPEIGGRLEHYPGERPLFDLYGVEEEIQRALDKKVVLKSGGYLVVEQTEAMSTIDVNTGAFVGSRNLEETIFKTNLEAAAAIARQLRLRNLGGIIILDFIDMLDKEHQRQVLRTLEKCLEKDRAKTSITGVSELGLVEMTRKRTRESLGQAMCESCPVCRGRGILKSPETVCYEIFREILRDARAYENEKFMVLASQVVIDLLLDEESANVADLESFIGRTIEFRVETVYNQEQYDIVLV

SEQ ID NO: 4306 - protein, 843 aa, Thermotoga maritima
MKTKLWLLLVLLLSALIFSETTIVVHYHRYDGKYDGWNLWIWPVEPVSQEGKAYQFTGEDDFGKVAVVKLPMDLTKVGIIVRLNEWQAKDVAKDRFIEIKDGKAEVWILQGVEEIFYEKPDTSPRIFFAQARSNKVIEAFLTNPVDTKKKELFKVTVDGKEIPVSRVEKADPTDIDVTNYVRIVLSESLKEEDLRKDVELIIEGYKPARVIMMEILDDYYYDGELGAVYSPEKTIFRVWSPVSKWVKVLLFKNGEDTEPYQVVNMEYKGNGVWEAVVEGDLDGVFYLYQLENYGKIRTTVDPYSKAVYANSKKSAVVNLARTNPEGWENDRGPKIEGYEDAIIYEIHIADITGLENSGVKNKGLYLGLTEENTKGPGGVTTGLSHLVELGVTHVHILPFFDFYTGDELDKDFEKYYNWGYDPYLFMVPEGRYSTDPKNPHTRIREVKEMVKALHKHGIGVIMDMVFPHTYGIGELSAFDQTVPYYFYRIDKTGAYLNESGCGNVIASERPMMRKFIVDTVTYWVKEYHIDGFRFDQMGLIDKKTMLEVERALHKIDPTIILYGEPWGGWGAPIRFGKSDVAGTHVAAFNDEFRDAIRGSVFNPSVKGFVMGGYGKETKIKRGVVGSINYDGKLIKSFALDPEETINYAACHDNHTLWDKNYLAAKADKKKEWTEEELKNAQKLAGAILLTSQGVPFLHGGQDFCRTKNFNDNSYNAPISINGFDYERKLQFIDVFNYHKGLIKLRKEHPAFRLKNAEEIKKHLEFLPGGRRIVAFMLKDHAGGDPWKDIVVIYNGNLEKTTYKLPEGKWNVVVNSQKAGTEVIETVEGTIELDPLSAYVLYRE

SEQ ID NO: 4307 - protein, 549 aa, Haemophilus influenzae
MSESFAQLFEESLKVLETRQGSIVSGTVVAIQKGFVLVDAGLKSESAIPVAEFLNAQGELEIQVGDTVNVALDAVEDGFGETKLSREKAVRHESWIELEKAYEEKATVIGLINGKVKGGFTVELNGVRAFLPGSLVDTRPAREADHLLGKELEFKVIKLDQKRNNVVVSRRAVIESENSQEREQVLENLVEGSEVKGVVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVNLGDTVEVMVLEIDEERRRISLGLKQCKANPWTQFAETHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVEGYIRSVDLTSEVAVGDVVEAKYTGVDRKSRIVHLSVKAKDQAEEAAAVASVNNKQEDIVIPNAMAEAFKAAKGE

SEQ ID NO: 4308 - protein, 608 aa, Magnaporthe grisea
MATWSGRAAIKGGSDTMRMVLLTCNAVGVTFTWGVEMTYCTPYLLSLGLTKGQTSLVWIAGPLSGLIVQPVIGVISDTWTSKWGRRRPFIMMCSVIVAMGLLTLGFTRDIVSFFIPSSAAGAAAAAAAEVPTAIRRDHPENNGFTGFLTIALAVLALYTTDFAINAVMSCARSLIVDTLPMHKQQDGAAWASRMSAIGHILGYGAGAIDLVALLGTTLGETQFKQLTLIAASGILFFSTLTCWAVSERVLVAPAPEPKGLVAGGERFKVPRQIWSTLMTLPVRIQAICWAVFWSWIGWYPFLIYSSTWVGETYFRYDVPADAKSSSDALGEMGRIGSYALTVYSIITFLGAWLIPPLVRSPEDDDEDDDGIPVTSQAAKSQSFLHSWFPGVARSLGQLGHLKPDLLTVWTFGYIMFAFAMFMAPLASSFRFATILVALCGIPWTISMWAPTALMGVEVNRMTHGITGQPYRRLSTSSAVELLTPVIRVNGEETEVVAAAAAPSSAPQAALLEDGNGTRVGGGGGELSGIYFGILNIYTTLPQFIGTFISAVVFAILEPGKSPELSHGGGGEELPQAPSDGPNAIGICLFIGAISAVGAAYATRRLRYL

SEQ ID NO: 4309 - protein, 441 aa, Schizosaccharomyces pombe
MNKFQLPKTLKSLWHHPHNGELISINGWVRSIRKLKNVCFAMVSDGTCQQALQVVTSPEQSKKLSYGASVNIEGQLAVSKNAKLGLQQYELLAEKIKIYGQINDDNYPIQKKHLTTEMLRQIPHLRLRTAKQGEIFRLRSDSLKALRQFFSSKDFTETNPPIITSSDCEGAGEVFTLTPQETHKNKSFERDDQKHFFDRPAFLTVSTQLHLEALALGLSRVYTISPAFRAEQSHTSRHLAEFWMLEAEVAFMTSLSQLTSLMEDMIKYTLNSLMEQNYHRDHWDQLLKPWKCMTYSEAIEELSAVKKTWKYPPKWGNDLSSEHEKYLCEILHKTPVFVTDYPQKIKPFYMKSSGPDTVAAVDLLVPQVGELAGGSLRKDHLDEYKTYPPELQWYLDLMKYSNAPHGGFGLGIERLIAFLEGENTNVKETIPFPRSVGSIFA

SEQ ID NO: 4310 - protein, 271 aa, Unknown
  Synechococcus sp. WH 5701
MSAAMPDPAEAAGEHLGTVYLVGAGPGDPELITLKAQRLLQCCDALVYDSLVPTALLELTPAGCERHFVGKRRGHHSVPQPSTNAVLVDLARRHRTIVRLKGGDPFLFGRGGEEAAHLASHGVPVQVVPGVTAGIAAPAYAGIPITHRKAGSSVTFVTGHEEIDKGRPGVDWRGLARSSDGLVIYMGLHNLRRICDELIAGELASDTPAAVIQQGTVSGQRQLVSTLGELADAAEAEGYGSPSIVVIGQVVLERVPACAPQPADVEMPIPF

SEQ ID NO: 4311 - protein, 511 aa, Unknown
  marine gamma proteobacterium HTCC2080
MEVVSRRFLIKGLVAGVALAGQSITLANSQRPMPYGKRSPTFFVHNDLPWALETRRSQFGFGPITPASHFFVRNNLPMPPAAVTGVGDNWSFEVQGCKQSGSLTLGDLKRMPIRTVATVLQCSGNGREFFAHDPSGSQWSVGAAGCALWTGVSVADIFEHFGGVAGDAAFLTASGGEELPEGIDKNAVVVERSVPIAKGLEDCLLVWEMNGAPLPAVHGGPLRLVVPGYFGVNNVKWVRQLAATPEESSAKIQQSGYRLRAQGESGGPQHPSMWRMPVKSWLNGPGAEGEPVLAGMNTLYGVAFSGERGIRSVEVSLDSGKTWQLAELVGPDLGPNAWRTFSFQTELGAGNHRVVTRAVDTLGEQQPQQSQDNHRGYGHNGWEDHVLEITALKELPKMAAIIESNQEHSLGSVTEATATVVPKPSLVLSDQALLGKTIFTAKAQPGCGVCHSLEDAKAQGVVGPSFNTLKPSLAQLRSAITQGVGAMPAYGGQLSTDEVEALAAYVFEASR

SEQ ID NO: 4312 - protein, 1249 aa, Magnaporthe grisea
MADAATLAAVAAIVENIATNSGAPGKNASFRSSTYVQLPGPESDEKKQLERELAALVIRVQQLETRANAAPATIFPDTPNETAYSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 4313 - protein, 407 aa, Clostridium perfringens
MRYIVVGASAAGISGAKTLRELDKDAEIILVSKDENVYSRCILHHYISGHRDIEALDFTDRDFFEKYNIEWKKGLEVKSIDDREHIIGLSNGESLKYDKILLATGASAFIPPVENLREAKNVVGLRNLEDAIKIKEEAEKVKNVVVLGAGLVGIDAIAGLVGKNLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNVPDDSYTEEIDISGENYKKIIHKDGKIYGAIIQGDLSYAGVLTQLIKEKIHVSKVKKPLFEIDYADFFNIKENLEYTY

SEQ ID NO: 4314 - protein, 268 aa, Unknown
  Nocardioides sp. JS614
MATAQVSTTELQRFRLDDRVAIVAGGSGGVGVRTCAALAGVGAKVAVIGRSEAGLAAARSAVEDAGGEALVITGDMTQKEAADDAIAQTLGAFGRVDVLVNGIGGGAGTALHAAEDYPQADWNRILDLNLTTALLVSQAAARAMVAGGRGGAILNISSVRGQLGIDAGFSAYVAAKGALDALTRQHATEWAKHDIRVNTISPTFVRTEQAAELLAAPGFYDNLVSRIPLHRIAETDDLVGAVLFFCTDASSFVTGQLLTLDGGLTATQ

SEQ ID NO: 4315 - protein, 181 aa, Musa acuminata
MASSVMVSSAAAVVSRASPAQSSMVAPFTGLKSTSAFPVTRKANADLSHLPSNGGRVQCMKVWPIEGKKKFETLSYLPTLVDEVLLKQIEYLLRSKWIPCLEFSHEGFVWRENHRSPGYYDGRYWTMWKLPMFGCTDATQVAKELEECKKEYPRAFVGIIGFDNNRQVQCISFIAHKPDGH

SEQ ID NO: 4316 - protein, 499 aa, Xanthomonas campestris
MSEEILVNVTPRETRVAVIENGMLQELHIERGWRRGVVGNIYKGKVQRVMPGMQAAFVEVGLERAAFLHANDVVRPAPAPASVVDTEETPIPPPPAASVPIVELLRDGQDIVVQVVKDPIGTKGARLTTQISIPSRYLVLLPQSKVVGVSARIEDEAERLRLKTIVSEVSAQHGGFGYIIRTNAEGQPAEALAEDIAYLSRVWNVVERRGREASACSIIYEDLSLPLRAVRDLIRKDVEKVKVDSNETFVQLQAFVAKYMPVLAERLELYTGDRPIFDLYGVEDEIGRALDKQVPLKSGGYLVIDQTEAMTTIDVNTGSFVGQRNLEETVFRTNLEAAQAVARQLRLRNLGGIIIIDFIDMDDPEHRRQVLRTLEKALARDHAKTTVYEFSPLGLVEMTRKRTVESLERQLSETCGQCGGRGTIKTAETVTYEIFREITRAVRQFDAARLLVIASSKVVARITDEESAAVAELEEFLGKSIRFQSDDQYLQEQFDVVLL

SEQ ID NO: 4317 - protein, 229 aa, Gossypium barbadense
MQIFVKTLTGKTITLEVESSDTIDNVKTKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLPLVLRLRGGF

SEQ ID NO: 4318 - protein, 341 aa, Pseudomonas putida
MTEQQPVAVLGGGSFGTAVANLLAENGVPVRQWMRDPAQAEAMRVNRENPRYLKGIRLHDGVEPVNDLLATLQASELIFVALPSSALRSVLAPHAELLRGKGLVSLTKGIEAQSFKLMSQILEEIAPEARIGVLSGPNLAREIAEHALTATVVASEHEDLCQQVQAVLHGRTFRVYASADRFGVELGGALKNVYAIIAGMAVALGMGENTKSMLITRALAEMTRFAVSQGANPMTFLGLAGVGDLIVTCSSPKSRNYQVGYALGQGQSLEEAVNRLGEVAEGVNTLKVLKTKAQQVQVYMPLVAGLHAILFEGRTLNQVIEHLMRAEPKTDVDFISISGFN

SEQ ID NO: 4319 - protein, 319 aa, Listeria monocytogenes
MKRIAILTSGGDAPGMNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRLGARSVELLLENRGGLAVGIRENRIVENDISEILKEKHTLDQKLFDLASILSI

SEQ ID NO: 4320 - protein, 692 aa, Clostridium perfringens
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWIDQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPSKPTLDYEQIIKGINKEEIKGLWVICTNPRHSFSNNEEFKKAMKNLDFFVVQDIYEDTDSSKECDLYLPSVPAIKKEGFLINTERRLSAMVPVLEKEEDELSDYEIFLGIGEALGMGSLLDKWRTPKDAFNLLRECSKGMPCDITGVTYERLRGSKGIQWPCREGEELEADERRLFEDGKYYTPSGKAKFIFEDVTENPNATNEEFPFNLNTGRGTVGQWHTHTRTREIQAVTNIVSQKAYVDINRKDAERLDIKENDEVLIHSSNGHTSKFIARLTDNLKEKDLYAPIHYIETNLLTPSVFDPYSKEPSYKTVQVNIEKVRK

SEQ ID NO: 4321 - protein, 429 aa, Triticum aestivum
  misc_feature (304)..(304): Xaa can be any naturally occurring amino acid
  misc_feature (396)..(396): Xaa can be any naturally occurring amino acid
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDXARGNIKVLMATNRPDTLDPALLRPGRLDRKVEFGLPDLEGRTQIFKIHTRTMNCERDIRFELLARLCPNATGADIRSVCTEAGMYANPAARXRKTVTEKDFLDSVNKVIKGYQKFSATPKYMVYN

SEQ ID NO: 4322 - protein, 365 aa, Arabidopsis thaliana
MLMSKEDESQMTFSMLPDDLVLNCLARVSKVYYPSLSFVSKKFRSLIASTELQELRSFLGCTSSGLYVCLRFRTNTDYRQICFTLRQKISSSAKILVPISSLDSPFDYRSGVVAVGSDIYAIGGRNLNNSASSKVMVMDCRSHTWREAPSMRVARDDFPSTCVLNGKIYVIGGCKNLDSTNWIEVFDTKTQTWEFLQIPNEEVCRGFNYKIVGYKEAIHVSSLENNRATFMTYEIHKGRWREPHLSLSHGFHFSNCVIENVFYRYSYEMLQWYDSCRKIWKNLKGFVRRSIMNPRGEGVKMVNYGGNIVLLWEECVTIKKKLIWCEEVVIEKKHQGEIWGLLKWSDVVFITDEKNQLVRALAPDV

SEQ ID NO: 4323 - protein, 284 aa, Gloeobacter violaceus
MSALTVAALQTAFVEDVATNVERVSALVREAAERGAQIILPSELFESHYFCRVERDQFFDLARPAEGHPTIAHFQAIAAELGVVIPVSFFERAGQSHYNSIAIVDADGRCLGTYRKSHIPDGPGYEEKFYFRPGNTGFRVWRTRYATIGVGICWDQWFPEAARAMVLMGAEVLFYPTAIGSEPESPDLDTKDPWQRAMVGHAVSNVIPVVAANRTGTEGNQTFYGHSFICNHRGDTVAELGRKEEGVITASFDLAEVRRHRASFGFFRDRRPELYGLLTTADGQ

SEQ ID NO: 4324 - protein, 394 aa, Carboxydothermus hydrogenoformans
MKYLIIGNSAAGIFAAESLRKLDPAGEITVLTDEPYEVYGRCLTSYFIAGDIVEEQIFIRPKDFYEKNRINLKKGEKVVRIDFNEKKVITFKNSYQYDRLLIASGARAKKLSLPGSNLPGVFTLRTLDDAKNILDYSRKAEQAVIVGGGLVSLKGAYGLLKRGVKVTVVVASRQILSQVLDYEAAGLVQQNLEKQGMKFLLGEDVLEFLGEDKIFEVKLTNGQVIKADLVLIGKGVTPNVDFLPEPEKFLEGIPVDQYLRTPWEGVWAAGDVAKTFDVAHGKYRVNALWPIAAEQGRVAAMNMVGQNYVYQGSIGMNSLEFFGYNTIAAGITRQEEGYTVIKRRQGANYLKLVLEGEKLKGYILSGEVRGAGKLTQLIRSGSKIKQFPSFLKIF

SEQ ID NO: 4325 - protein, 382 aa, Oryza sativa
MEDAHHHHWTMVERRGTQLWASGRPFIIHGFNTYWLMSFAADQATRPRVTAAIAEAAEAGLNVCRTWAFSDGGYRALQTAPFHYHEDVFRALDFVVSEARRHNMRLILSLCNNWEDYGGKAQYVRWGKEAGLDLTSEDDFFSDPTIKSYYKAFVEAVVTRINTVTNETYKDDPTILAWELINEPRCPSDPSGDTLQAWIEEMASYVKSIDPVHLLEIGIEGFYGLSTPELLPVNPDEYSGHAGTDFIRNHQAPGIDLASIHVYSDTWLPHSIKENHLQFVDKWMQQHIDDAANLLGMPIVVGEFGVSVKDGKFGNEFREDFMKTIYRIFLSSWKEGVIGGGCLLWQLFPEGAEHMDDGYAVIFAKSPSTLSLLANHLRCLEC

SEQ ID NO: 4326 - protein, 297 aa, Magnaporthe grisea
MGLELVRTLAKTGMRVFFTARDPAKGAKVREMLRAEDASFKLELVVVELKSLKSVEAGARHILDRADRLDLLMNNAGIAATPHGFTQDGYEQQFGVNYLAHFYLFQMLKPLLLKTAAEHGVQVRVVSTSSTAHTASTVLPAGDYGTADPNGRGYEPGVSYAHSSTARIWFCNEAERRYGPRGLHAISTHPGGFASGLMDSADEQARAALARAIEMPHIRRIWKSVEQGAATNALAGVGREYDGHGGFYMEDCGVARPVPDHLDWAGHGYKSWAFDEAGEKRLWLDSLEMLGLQDDQE

SEQ ID NO: 4327 - protein, 124 aa, Zea mays
  misc_feature (82)..(82): Xaa can be any naturally occurring amino acid
  misc_feature (90)..(90): Xaa can be any naturally occurring amino acid
  misc_feature (109)..(109): Xaa can be any naturally occurring amino acid
FPSCLCEKGLFPHDVRSTHVSRRLKAIANRIIGEGACRSCSEYCHMCHKHRRDQKELKCHCMRETHQRNMHVLGMSTDRVVXGFSKEFLXSFLSFIRHADRHSRLTATXVYNKYIVDRYHVHMN

SEQ ID NO: 4328 - protein, 954 aa, Thermosynechococcus elongatus
MMVSSPPQLEINLETDAEFVARHIGITPSDLPKMLSLLGYGSLKELINAVIPPEIRLQRPLALSEGLSETAALQKLRTLAQQNQVWRSYIGMGYYNCITPSVIQRNILENPGWYTQYTPYQAEIAQGRLEALLNFQTLVSDLTGLAIANASLLDEATAAAEAMTLSFNACRQRGANRFLVAQDCHPQTLAVLRTRALPLGIQIVPIDPIAGELPWENAFGLLLQYPASDGAVRSPQALIAAAHERGLLVTVATDLLALTLLRPPGELGADIAVGSSQRFGVPLGYGGPHAAFFATREDFKRQLPGRLVGVSHDALGQRALRLALQTREQHIRREKATSNICTAQVLLAVVASMYAVYHGPDGLRQIAERIHQRTVRLAAGLEAAGYQLYYSEFFDTLRIGLGNLPVPVLKERAAAARINLRYFDDGSAGISLDETTTEKDVADLLALFGARPAEVEGGDRLPAALKRQSPYLQHPVFQDYHSEHALLRYIHRLQAKDLSLTTSMIPLGSCTMKLNATAEMLPISWPEFNQLHPFAPQEQAQGYQALFRELAAMLAEITGFDAISLQPNAGSQGEYAGLLVIRQYHHSRGESQRNVCLIPTSAHGTNPASAVMAGMQVVAVNCDAQGNIDVADLAAKAETYGDRLAALMITYPSTHGVFETGICQICDIIHRYGGQVYMDGANMNAQVGLCRPGDFGADVCHLNLHKTFCIPHGGGGPGVGPIGVKAHLAPFLPTTQVIPQGSETGPVTAAPWGSASILPISWMYITLMGGVGLTRATAIAILNANYIAKRLEPYYPVLYKGAHGLVAHECILDLRPLKKSAGIEVEDIAKRLMDYGFHAPTVSWPVPGTLMIEPTESETKAELDRFCEAMIAIRSEIAEIEAGVSDRQQNPLKNAPHPALMLATEPWPYPYSREVAAYPAPWLREYKFWPAVARIDNAYGDRHLVCTCSMPLTN

SEQ ID NO: 4329 - protein, 175 aa, Triticum aestivum
MVPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVAEVKKEYPDAYVRIIGFDNMRQVQCVSFIVFKPPGCEKSGKA

SEQ ID NO: 4330 - protein, 1067 aa, Oryza sativa
MLRRCNQHRLSTLSPSSRKILISRPSAAFTALPRTPIASNNLQNSVRTLATGLSQTSKHVPTTSIFAPLDTFTRRHVGPQPASVQKMLEYLGYESMDAFLKDCVPQDIRLEENAIRDEGAGGIWALSEGELLRRAKEIGKKNKVTRSFIGLGYHQAVLPQVILRNMLENHGWFSQYSPYQAEISQGRLGSLINFQTLTTALTGLDIANASLLDEGTAAAEGMIMAFGHLREKRKTFFVDRSVLPQTVAVVKTRVAPFGINVVVGNVKKLLSEEHGDKAQHKDLIGVLLQYPDVRGEVADWKAVADRTHKLGGLVSCATDFLALTMLKPPGEWGADIAFGNAARFGVPLGYGGPHAAFFACSDALKRRMPGRLIGLSKDKEGRPAYRLALQTREQHIRRDKATSNICTAQALLANTSAMYAVYHGPEGLRAIAEKVHGLARIVKAAVEKLGHKVVNETFFDNLTIRRSGTAATLVHESAVAAGINLRRVDDQHVAVSFDESHSLEDIVDLLNVFVSNQKGPRRINQIQPYTTESLVEFADSLNVPAPRATRSSLGELSSGENIPAIDSPAIPSDLARTSPFLTQPVWNSHHSETDIIRYMHYLQDKDLSLVHAPIPLGSCTMKLNSTTSMTPFTWDEFSRIHPFAPEDQALGYKEMMDELAQDLSLLTGLPGCSLQPNSGAQGEYAGLSVIRAYHLSRGEGHRNICLVPASAHGTNPASAIMAGMKVVPVKVLATGYLDMEDLKAKATQHSKDLAAFMVTYPSTFGVFESGVEDACSIIHENGGQVYLDGANFNAMVGLTSPGKVGADVCHLNLHKTFAIPHGGGGPGMGPICVGEHLIPFLPGHPVVPTGGSDAIGPISASPYGSASILSISWAYIKMLGATGLKFATQVALLNANYAMARLQDHYRVKFVNNKGRCAHEFIIDLAEFEDTAGLKVMDIAKRLQDYGIHPPTCSWPLSTAMLIEPTESEGLRDVDRFCDAMIKIRQEIEDIAQGKQPRGNNLIVNAPHPQQVVTADTWDRPYTREEAAYPDARLRRAKFWPPTSRVDDAYGDKNLFCECGSVDEYAS

SEQ ID NO: 4331 - protein, 295 aa, Hordeum vulgare
MHSCNDHGQKVKLNVVQADSAAHGVTAHGARTPPASAVALKPALIRVPSPPVGVTAARAETPLPFPASPACPPLPFLIPSSTPPRPDPVVRPRTNQMASARRLLQTYPGQFQAAEPPDALGADSDVVVILAALLCALLCVVGLAAVTGCARSRRGAGGARSAAPDAAAPSKGLKKRALMALPRLAYEDAVAARGAMAGEEREGVLLSECAICLSEFADKEEIRVLPQCGHGFHVACVDAWLRAHSSCPSCRRVVVVIVADAAPRGMPPQPKRCRKCEAMEEASSSSSSAAAQFLP

SEQ ID NO: 4332 - protein, 72 aa, Unknown
  Candidatus Desulfococcus oleovorans Hxd3
MAKEEAIKVEGTVLETLPNAMFKVELANKHQVLAHISGKMRMHFIKILPGDKVTVELSPYDLTRGRITYREK

SEQ ID NO: 4333 - protein, 99 aa, Cyanidium caldarium
MTSYKVKLTNEKEGIDVEINCPNDQYILDAAEEQGIDLPYSCRAGACSTCAGKLISGTVDQSDQSFLDDEQIKEGFVLTCVAYPTSNCTILTHQEEALY

SEQ ID NO: 4334 - protein, 266 aa, Zea mays
MDFSGEIDDFSLQLIREQLLGGEASLPIVTNAAAYSASVVHHPTQAEFHQPAAFLPQPSHVAYVDLTNEYAADATVASAGGEAAFRAEPVMIRFGGEPSPVSDSDPSRRPLLTISLPPASHAWGPAAVPLEAPGAAALDANDFRKYRGVRQRPWGKFAAEIRDPKKRGSRVWLGTYDTAIEAARAYDRAAFRMRGAKAILNFPNEVGTRGADFLAPPPPPPQAAATPRPRPGPEPEPSQPSPSRPRRPGRRRRRCLPRQRPPRPRR

SEQ ID NO: 4335 - protein, 256 aa, Streptococcus agalactiae
MAVISMKQLLEAGVHFGHQTRRWNPKMAKYIFTERNGIHVIDLQQTVKLADQAYEFVRDAAANDAVILFVGTKKQAAEAVAEEAKRAGQYFINHRWLGGTLTNWGTIQKRIARLKEIKRMEEEGTFELLPKKEVALLNKQRARLEKFLGGIEDMPRIPDVMYVVDPHKEQIAVKEAKKLGIPVVAMVDTNADPDDIDVIIPANDDAIRAVKLITSKLADAVIEGRQGEDADVDFAQEAQADSIEEIVEVVEGSNND

SEQ ID NO: 4336 - protein, 84 aa, Burkholderia tropica
LIKPFKLDEAREALSAIGVSGITVTEVKGFGRQKGHTELYRGAEYVVDFLPKVKIEAAVSDDIVDQAIEALERAARTGKIGDGK

SEQ ID NO: 4337 - protein, 467 aa, Bacillus subtilis
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 4338 - protein, 510 aa, Streptococcus agalactiae
MVLDKEIKAQLAQYLDLLESDIVLQADLGDNDNSQKVKDFLDEIVAMSDRISLESTHLKRQPSFGIAKKGHESRVIFSGLPMGHEFTSFILALLQVSGRAPKVDEDIIKRIKGIEKTINLETYVSLTCHNCPDVVQAFNIMAVLNPNITHTMIEGGMYQDEVKSKGIMSVPTVYKDQEEFTSGRATIEQLLEQLDGPLDAEAFADKGVYDVLVIGGGPAGNSAAIYAARKGLKTGILAETFGGQVIETVGIENMIGTLYTEGPKLMAQIEEHTKSYDIDIIKSQLATGIEKKELVEVTLANGAILQAKTAILALGAKWRNINVPGEEEFRNKGVTYCPHCDGPLFEGKDVAVIGGGNSGMEAALDLAGVTKHVTVLEFLPELKADQVLQERAAKTDNLTILKNVATKDIVGEDHVTGLNYTDRDTNEEKHIDLEGVFVQIGLVPSTSWLKDSGIELNERQEIVVDKFGSTNIPGIFAAGDCTDAAYKQIIISMGSGATAAIGAFDYLIRQ

SEQ ID NO: 4339 - protein, 485 aa, Pseudomonas syringae
MSEEILINITPMESRVAVVENGVLQEVHVERTQRRGIVGNIYKGKVVRVLPGMQAAFIDIGLDRAAFIHASEISMREGPAVESIASLVHDGQSLVVQVTKDPIGSKGARLTTQLSIPSRYLVYMPRTAHVGISLKIEDEAERERLKKVVSDCVAQEGIKEAGGFILRTAAEGAGADEILMDIRYLRRLWDQIGDQIKTVSPPTVIYEDLGLALRTLRDLVSPRIEKIRIDSRETFQKTTQFVAELMPEIADRLEHYPGERPIFDLYGVEDEIQKALERKVPLKSGGYLVIDPAEAMSTIDVNTGAFVGHRNLEETIFKTNLEAATAIARQLRLRNLGGIIIIDFIDMEDGEHQRQVLRTLEKQLERDHAKTNIIGITELGLVQMTRKRTRESLEQVLCEPCHCCVGRGKLKTPETICYEIFREILREARAYQAVGYRVLANQRVVDRLLDEESGNVAELESFIGRTIRFQVETMYSQEQYDVVLL

SEQ ID NO: 4340 - protein, 299 aa, Vibrio vulnificus
MDLENKPVLVVGGGEVASRKIEALLNVGAKVTIVSPTLVDELHRWVEENRCYWVKNFYSSELMDGAYVQVWATTNNPSLNHQVYRDAKQRNLLVNVVDDKPYCDFITPSMISRGRVQIAISSGGASPVLIRNLRESLEAVLPQNLSLLAEFAESKRVAVKERFPTVEERRMFWELFFDLPEVKSSQNHRELETLFAQAIKGELQRTAQCTWIGCTEDVELLPIKALRYMQKAELVLAPEQIHPAFLEMVRRDAQRLSYETPAQLSEKIQQAKLEPIKICVLFAKNSQEFSFLQQGDLII

SEQ ID NO: 4341 - protein, 84 aa, Burkholderia kururiensis
IIKPFKLDEVREALAEVGLTGLTVTEVKGFGRQKGHTELYRGAEYVVDFLPKVKIEVVVANEQTDQGDHAIIGAARTGKIGDGK

SEQ ID NO: 4342 - protein, 387 aa, Oryza sativa
MALQVQAALLPSALSVPKKGNLSAVVKEPGFLSVSQKAKKPSLVVRAVATPAAPVASPGAGTSKADGKKTLRQGVVVITGASSGLGLAAAKALAETGKWHVVMACRDFLKAATAAKAAGMAAGSYTVMHLDLASLDSVRQFVDNFRRSGMPLDALVCNAAIYRPTARQPTFTADGYEMSVGVNHLGHFLLARLMLDDLKKSDYPSRRLIILGSITGNTNTLAGNVPPKAGLGDLRGLAGGLRGQNGSAMIDGAESFDGAKAYKDSKICNMLTMQEFHRRFHEETGITFASLYPGCIATTGLFREHIPLFRLLFPPFQRFVTKGFVSEAESGKRLAQVVGDPSLTKSGVYWSWNKDSASFENQLSQEASDPEKARKLWDLSEKLVGLA

SEQ ID NO: 4343 - protein, 168 aa, Zea mays
MAAASSATSVHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGDNIKWNFSKFLVDKEGHVVERYAPTTSPLSIEKDIKKLLGSY

SEQ ID NO: 4344 - protein, 368 aa, Brassica napus
MSLSAIGFEGYEKRLEVSFFEPSLFLDTHGKGLRALSKSQIDEILAPAECTIVSSLSNDELDSYVLSESSLFIFPYKIIIKTCGTTKLLLSIEPLLRLSGGVSLEVKSVRYTRGSFLCPGGQPFPHRNFSEEVSVLDGHFANMGLSSVAYLMGDDDETNKWHVYSASAPAKNSNGDNNVYTLEMCMSGLDKDKASVFFKNESSSAGSMTDNSGIRKILPQSQICDFEFEPCGYSMNSVEGDASSTIHVTPEDGFSYASFEAVGYDFTTMDLSQLVSRVLTCFEPKQFSVAVHSSVAQKSYDHSGLSVDLEDYGCRETTVGVSRRRERNSDVSEVREAGNVLWFSEIDLKCEWSSNSSCTSEDEKEEGI

SEQ ID NO: 4345 - protein, 471 aa, Robiginitalea biformata
MQANNQYAFGLIGLGVMGRNFILNVAEKGFTALGYDLDPGQVEALKREGGNLDRVNATNSLEAFVQGLETPRKIMLLVPAGPIVDSVIEELLPLVSAGDLIIDGGNSFFRDTDRREAYLKEKNIHFFGAGVSGGAEGARRGPSLMPGGDRDAYREVQPIFEAVAAKFEGTPCVAYLGPKSAGNYVKMVHNGIEYGLMQLTAEAYDLLRRAGGLGNAEIQEVFARWNRGRLQSFLVEISSEILGRKDDLDSGDLIDKVRDQGKQKGTGKWTSQNAMDLGIPVPTIDIAVSMRAISAFKQDRERADTLFERPGAGSVDTEKLIADCEAALYFSFLLTYAQGLHQLAEASETYGYELDLATVARIWRAGCIIRAALLEDIASAYETAPELVNLVFSENFREPLQKAATPARRLVSLGVSAGIPVPGLASALSYFDSYTTGRLPMNLVQAQRDYFGSHTYQRTDRDGTFHTDWDA

SEQ ID NO: 4346 - protein, 129 aa, Burkholderia pseudomallei
MRLLHTMLRVGDLDRSIKFYTELLGMKLLRRQDYPDGKFTLAFVGYGDERDHTVIELTHNWDTKSYELGTGFGHLALEVEDAYKACEQIKAQGGKVTREAGPMKHGTTVIAFVEDPDGYKIEFIQRNAH

SEQ ID NO: 4347 - protein, 584 aa, Vicia faba
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 4348 - protein, 539 aa, Lophopyrum elongatum
MGYQVVAAQLARLSGALGTSDHASVVSINLFVALLCACIVLGHLLEENRWLNESITALIIGLCTGVVILMTTKGKSSHVLVFSEDLFFIYLLPPIIFNAGFQVKKKQFFRNFMTITLFGAVGTMMSFFTISLAAIAIFSKMNIGTLDVSDFLAIGAIFSATDSVCTLQVLNQDETPFLYSLVFGEGVVNDATSVVLFNALQNFDPNSKIDAIVILKFLGNLCYLFVSSTFLGVFTGLLSAYVIKKLYIGRHSTDREVALVMLMAYLSYMLAEPLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 4349 - protein, 724 aa, Unknown
  Synechococcus sp. WH 5701
MECDSRCTTCPVPAPAKAQCPYCGVGCGLELKPPAADANSPDLPDAAEAIWTVRGDRQHPSSLGQVCVKGATVAETLGRNRLSTPLWREQRDQPFQAISWERAFTILVERIQAIQAEQGSSGIAMYGSGQFLTEDYYVANKLIKGALGTNNFDANSRLCMSSAVSGYKLSLGSDGPPCCYDDLDLAGTVVLIGTNTAECHPVLFQRLLKRKRRQKDALQLIVVDPRATATSDAADLHLAIRPGTDLVLLHGVGHLLLQLGAVDPERVAATADGFAELAALWAGWTPERVCALCGIEEEALRRLAAIWAASAGVLSLWSMGVNQSVEGTATVTGIINLHLVSGQIGKPGAGPFSLTGQPNAMGGREAGGLAALLPGYRSIHEASHRAAIEQHWGFPPGAISERDGLSVWEQIEAMERGELGLWWVAATNPLVSLPWLDRVRQAVARCPLVVLNEAYAGTETEAVAHLVLPAAQWSEKAGVMTNSERRVTLSQAFRQPPGEARPDWSIFAEVGRRLGFAKQFAYGSSAEVYAEFAAITAGRICDHSGLSHDLLAEHGPQQWPFPAGTAPGGGQARLHTQGVYHTANGKARLLAQQPLGLGEPPDASFPLVLTVGRYLGHWHTMTRTIHVERVRRSHPEPLLEINPADAERCQLVDGGQARVSSRRGSLSVKVQITERIRPGTVFLPMHWGAAQEQACEANRLMHALGCPVSKQPELKAAAVQVERA

SEQ ID NO: 4350 - protein, 322 aa, Yersinia pestis
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTQGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 4351 - protein, 288 aa, Escherichia coli
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAVHTAAFALPQYLQDALASQPS

SEQ ID NO: 4352 - protein, 474 aa, Schizosaccharomyces pombe
MGGSDFEDDELFKDLYGEENEKKVESASGNQETSNVTPTKENEGYEELEKSGEAGAERTKENPFREEPGADFDRSGSDQQYSAEAEANQEDDLNETSQQAPDPSSYDIRGQALSSATWDNAEDGENSKNDNYNENQSALTGSGAMESNEDNAEETSPFNREDGKMFIGGLNWETTDDSLRDYFEQFGEVLDCTVMRDSTTGRSRGFGFLTFKNPKCVNEVMSKEHHLDGKIIDPKRAIPREEQEKTAKMFVGGVPGDCTEEEFRNFFNQFGRVLDATLMMDKDTGRPRGFGFVTYENESAVEATMSQPYITIHGKPVEVKRATPKASLRDSHDRHQHGYHGNANPYYAQNMNMYGGMTPAMMAQYYRQMQQYMEAMRNMPAAAGAVPYPQPVMPAGMADWQQQQQQGAAYFDPSKMNQGTGDGVPFSPSMPSGSSRGGYHGRNPGGPNRQRYRGRRDGRGGNTGGGHSFHPYRR

SEQ ID NO: 4353 - protein, 492 aa, Schizosaccharomyces pombe
MSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDEIADVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 4354 - protein, 296 aa, Bifidobacterium longum
MRMARQEPTMKGSNTMAQITMSDMLKAGLHFGHQTRRWNPKMKQFILTQRNGIHIINLFKSLDMIDKAYDFIKTTVAHNGTVLFVGTKKQAQEAIANQATRVNMPYVSERWLGGMLTNFQTVSKRVNRLKELEEMDFTDVHGSGLTKKELLLLEREKDKLNKQLGGIRNMNRTPSAMFVVDITKEALAVEEAHKLGIPVVAIVDTNADPDTVEYPIPANDDAIRGIELLTSLMADAVAEGLLERSGANKAEGEAAEQPMAAWEKELLTNEAPAEASAEAAAPAAAEGETAEAPKAE

SEQ ID NO: 4355 - protein, 240 aa, Zea mays
MADAGNEAEGLTLLGLHVSPFALRVRMALSLKGLSYEYIEQDLFHKGELLLSSNPVHKKVPVLIHHGKPICESLAVVEYVDEVWPGAAATILPADPHGRATARFWAAYIDGKLFPAWTGIMKAATEEARADKLRETHAAVLNLEKAFAEISSSSSNDGAAFFGGDSVGYLDLALGCSLPWFGALRAMLGVEIIDAAQAPLLVAWAERFGETPVAKEVLPQPDEAVAYAKKIQAYWASAKN

SEQ ID NO: 4356 - protein, 217 aa, Oryza sativa
MDDSHDLASPTSPDTASSSSSSTSTSSSSATVAPKKRPRNDGRHPTYRGVRMRSWGKWVSEIREPRKKSRIWLGTFATAEMAARAHDVAALAIKGRTAHLNFPDLAHLLPRPATAAPKDVQAAAVLEVAAADFPSVSVDANAKSPDTCSVASAASPQPPPPDAEADPDSTLFDLPDLLLDLRYETSSSLSCGASWAVDDDVAGGVVFRLEEPMLWDY

SEQ ID NO: 4357 - protein, 182 aa, Escherichia coli
MVRDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 4358 - protein, 161 aa, Musa acuminata
SSMMVSSAATVSRASPAQSSMVAPFTGLKSTSAFRVTRKANADLSHLPSNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 4359 - protein, 510 aa, Streptococcus mutans
MALDAEIKEQLGQYLQLLECEIVLQAQLKDDANSQKVKEFLQEIVAMSPMISLDEKELPRTPSFRIAKKGQESGVEFAGLPLGHEFYFVYLGSVTGFRASAKVETDIVKRIQAVDEPMHFETYVSLTCHNCPDVVQAFNIMSVVNPNISHTMVEGGMFKDEIEAKGIMSVPTVYKDGTEFTSGRASIEQLLDLIAGPLKEDAFDDKGVFDVLVIGGGPAGNSAAIYAARKGVKTGLLAETMGGQVMETVGIENMIGTPYVEGPQLMAQVEEHTKSYSVDIMKAPRAKSIQKTDLVEVELDNGAHLKAKTAVLALGAKWRKINVPGEKEFFNKGVTYCPHCDGPLFTDKKVAVIGGGNSGLEAAIDLAGLASHVYILEFLPELKADKILQDRAEALDNITILTNVATKEIIGNDHVEGLRYSDRTTNEEYLLDLEGVFVQIGLVPSTDWLKDSGLALNEKGEIIVAKDGATNIPAIFAAGDCTDSAYKQIIISMGSGATAALGAFDYLIRN

SEQ ID NO: 4360 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 4361 - protein, 159 aa, Streptococcus pyogenes
MPNLYDFTVKAQDGSDISLVDYKEKVVLVVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLG

SEQ ID NO: 4362 - protein, 426 aa, Nicotiana tabacum
MAVIISSKVLLIQLFVLVLGSFSKLSHGELWLELPLPFDWPPAEIPLPDIPSPFDGPTFVLPPPSPLPSPPPPSPSPPPPSPSPPPPSTIPLIPPFTGGFLPPLPGSKLPDFAGLLPLIPNLPDVPPIGGGPPVNQPKPSSPSPLVKPPPPPPSPCKPSPPDQSAKQPPQPPPAKQPSPPPPPPPVKAPSPSPAKQPPPPPPPVKAPSPSPATQPPTKQPPPPPRAKKSPLLPPPPPVAYPPVMTPSPSPAAEPPIIAPFPSPPANPPLIPRRPAPPVVKPLPPLGKPPIVSGLVYCKSCNSYGVPTLLNASLLQGAVVKLICYGKKTMVQWATTDNKGEFRIMPKSLTTADVGKCKVYLVKSPNPNCNVPTNFNGGKSGGLLKPLLPPKQPITPAVVPVQPPMSDLYGVGPFIFEASSKMPCDKN

SEQ ID NO: 4363 - protein, 106 aa, Roseovarius nubinhibens
MATVAVTDDTFDAEVKNSDIPVVVDFWAEWCGPCKQIGPALEEIAAEMGGKVKIAKVDVDSNPNSAAQMGVRGIPALFIFKNGEVVSNRAGAAPKAALQSWIEESI

SEQ ID NO: 4364 - protein, 233 aa, Oryza sativa
MAGGGDELKLLGMWASPYVLRVKLALSLKGLDYEYVEEDLKNKSELLLSSNPVNKKVPVLIHNGKPVCESQIILQYLDEAFPDAGATLLPADPHERAVARFWAAFCDDTIAKASQQASSGKTEEEKAEGEKKVVEALEKMEVGLSECSKGKPFFGGDTVGYVDIVLGSFLAWVRAGDAMKGVKRFDPATTPLLAAWAERFVELDVAKAAMPEVDKLIELAMARMAGAAAAATN

SEQ ID NO: 4365 - protein, 121 aa, Staphylococcus aureus
MTTTPYDIIGKEALYDMIDYFYTLVEKDERLNHLFPGDFAETSRKQKQFLTQFLGGPNIYTEEHGHPMLRKRHIDFTITEFERDAWLENMQTAINRAAFPQGVGDYLFERLRLTANHMVNS

SEQ ID NO: 4366 - protein, 61 aa, Oryza sativa
LLGHNSMIYFIDDVETSPAAQNLALRDLPLRDILFLSERTVIGVGFDCNPMIFSADETGLW

SEQ ID NO: 4367 - protein, 990 aa, Rhodopseudomonas palustris
MTPLRFPSNLPLRAVAFDEDQSMPHRRPIDAANDFVRRHIGPSPQDIAAMLATAGAGSLEQLVAETLPYAIRHREPLKLGAPLTESEALAHMSELGAQNQVFTSLIGQGYYGTILPTVIQRNILENPAWYTAYTPYQPEISQGRLEALFNFQTMICDLTGLDVANASLLDEGTAAAEAMALAERAAAKNAKAFFVDADTHPQTIAVLRTRAEPLGWRIIVGNPETGLEGADVFGALLQYPGSSGRLSDPRAVIAALRKKGALAVVAADLLALTLITPPGELGADIAIGSAQRFGVPMGYGGPHAAYMAVRDSLKRSLPGRIVGLSIDSHGQPAYRLALQTREQHIRREKATSNICTAQVLLAVINAMYAVYHGPDGLAAIARRVHRRTAVLAAGLQQLGFAPTHGNYFDTLTIEVGDRRDAIVARAEAENINLRINASSLGISLDETTTPATVEALWRAFGGSLDYAAVERDAGDALGTALPAALKRTSDYLTQPAFQDYRSETELLRYMRKLSDRDLALDRAMIPLGSCTMKLNATTEMMPLTWPEFGSLHPFVPKAQAAGYHALFERLETWLAEITGYDAVSLQPNSGAQGEYAGLLTIRGYHLSRGEPHRKVCLIPSSAHGTNPASAAMAGMDVVVVACDAHGDVDVDDLRAKAEAHSADLAAVMITYPSTHGVFEEHIREICDIVHAHGGQVYLDGANLNAQVGLARPGSYGADVSHLNLHKTFCIPHGGGGPGMGPIGVKAHLAPFLPGHPAEGEPLNGGLHGGGTVSAAPWGSASILTISYIYILMMGAAGLKRATEIAILNANYIAAKLHPHFPVLYRNPRGRVAHECIIDPRALKTSTGVTVDDIAKRLIDYGFHAPTMSFPVPGTLMIEPTESESKAEIDRFCDAMIAIRREIAQVEAGRYPIEQSPLRHAPHTAHDVTSAEWTRPYPRTEGCFPAPNSRTDKYWSPVGRVDNVYGDRNLICSCPPVEDYALAADYARAAE

SEQ ID NO: 4368 - protein, 166 aa, Thermotoga maritima
MSDRPRRYKIFMDKKKRIALIAHDRRKRDLLEWVSFNLGTLSKHELYATGTTGALLQEKLGLKVHRLKSGPLGGDQQIGAMIAEGKIDVLIFFWDPLEPQAHDVDVKALIRIATVYNIPVAITRSTADFLISSPLMNDVYEKIQIDYEEELERRIRKVVEGEEEET

SEQ ID NO: 4369 - protein, 197 aa, Pseudomonas putida
MVERKASVERNTLETQVKCSINLDGSGKARFDIGVPFLEHMLDQIARHGLIDLDIECKGDTHIDDHHTVEDVGITLGMAFAQAIGDKKGIFRYGHAYVPLDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 4370 - protein, 408 aa, Burkholderia vietnamiensis
MNDRNSTKRNAAIVGGSLGGLFAANLLLRNGWDVDVFERVPDELSGRGAGIVTHPELFDVLRAAGVRIDASIGVNVEARITLARDGSLASERPLPQTLTAWSKMYHVLRAALPDQHYHAGAVVADVADGPDRASVTLADGSVVHADLVIAADGLRSAIRETFLPDARLQYAGYVAWRGLVDERELSDTTHATLFGKFAFGLPPREQILGYPVAGRHNSTQPGERRYNFVWYRATREDTDLPNLLTDATGKQWAGGIPPTLIRPDVLAAMEDAAHALLAPQFAEVVSRAAQPLFQPIYDLEVPHMTFDRIALLGDAAFVARPHCGMGVTKAAGDAMALVQALGAHADTLDALHAYSDTRTAFGAAIVQHARHLGAYMQAQLQNDTEREMAERYRTPEIVMRDTAVPPQL

SEQ ID NO: 4371 - protein, 415 aa, Bacillus thuringiensis
MNEVLAKGKKAKEIARELVLKSTEQKNEALSAIADQLILETAYILEENKKDIEEGKAKGFSDSLLDRLMLNEQRIVDMTEGIKQLIELRDPVGECVSAWERPNGLSIQEMRVPLGVVGMIYEARPNVTVDAATICLKTGNAVILRGSSSAIHSNKAIVAVIHRALKQTSLPQESVQLIEDTTRDSAKQLFTMNDYLDVLIPRGGKQLIDTVVREASVPVLETGAGNCHVFIDETADKQMAFDIIINAKTQRPSVCNAIETIVLHEKWAEQYGSELFSSLKKRGVELRGDQKALAMDSSIVLASEEDWGTEFLSLTLAVKLVSSIEEAIHHINTYGSMHSEAIISENEENVSKFFVSVDAAALYHNASTRFTDGSEFGFGAEIGISTQKLHVRGPMGLPALTSTKYVIRGNGQIRK

SEQ ID NO: 4372 - protein, 938 aa, Unknown
  Azoarcus sp. EbN1
MKTKATCPYCGVGCGVLIEHDGRRITGVAGDPEHPANFGRLCTKGATLHLSARPETRLLYPELRAARGLARERVGWDTAIATAAERFAATIREHGPDSVAFYISGQLLTEDYYVFNKLVKGLIGTNNIDSNSRLCMSSAVAAYKQTLGADAPPCSYEDFAQTDCLLIAGANPSYAHPVAFRRIEDAKAARPEMKIIVVDPRRTDTAATADLHLAILPGTDIWLYNAMLNVLLWEGYVDNAFIREHTEGFEALRDHVRDVTPAIAAEVCGLGRRGAEDIVTAARWWGEAKAAMSLWCQGLNQSTHGTHNGTALIALSLATGKIGRPGCGPFSLTGQPNAMGGREVGGMANLMSGHRDLANPEHRAEVARLWGVEDVPSTPGLTAIELFDAAYDGRIKALWIACTNPAQSLPEQERVREALARCDFVVLQEAYCNTETAPFADLLLPAATWGEKEGTVTNSERRITRVHRALTPPGEARADWRIVCDFAHELGPRIGKEAARLFPYAVPSEIFAEHAASTAGRDLDITGLSYDLLDSAGPQQWPFPKAANVVDAANRTRLYADGRFPTADGRAHFVVPTQALTAERADARYPLHLTTGRLRDQWHGMSRSGKVARLYNHVDEARIEMHADDLALRGLKSGDLVHVRSRRGDVVLRAEASSEIRSGQAFIAMHWGGNSLNSAGANALTLRDFDPYSKQPELKHAAVQVEKAVLPFQALIMRGEPGAAGDEEGSGNDDAAPIEIAGKVTAGDLMANAAGLALERAAALAPWLERFSYASLALAGRDHPAVVLRIAHHQPIPPEWLAELDALLGLDDEHCLAYSDTRRGITKRARIDDGLLVGLRLTGETAAAGWLRDVLVERQPTADLRRWILAPLANPPEAAKTRGRIVCTCLNVSESDIAAAIAGGAGFDDLQAKLRCGTTCGSCVPQIRRLVAAGQRAA

SEQ ID NO: 4373 - protein, 276 aa, Oryza sativa
MEMVIVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 4374 - protein, 819 aa, Magnetospirillum magnetotacticum
MNAVPRQKLVVIGNGMAGMRTVEELLAIAPARYDITVFGAEPHPNYNRIMLSSVLAGEKQVDDIVINSRAWYAENGITLHTGDPVVAINRAAKTVSSATGLVVTYDRLLLATGSKPLMPPLPGLDLPGVVAFRDIADVEKMLDAAEKQQRAVVIGGGLLGLEAAWGLKRRGMPVALVHLMPTLMERQLDVEAGGLLQKDLTERGLHFFTSGQTEEIMGAEEGCAKGVKLTDGREIPADLVVVAIGIRPNVDLAKAAGLDINRGIEVGDDMATSDPAIFSVGECVEHRGQIFGLVAPIWEQAKVCASRLAGRDEAHYETPPLSTRLKITGIDVFSAGQLAAQDEADEELVYRDTARGIYKKLVIRSDRVVGAVMYGDVADGSWYFQLIREKADVSAIRDRMIFGQAYADTGCKGHGGGVNVAAMSDDAQVCGCNGVSKGAIVKAITEKGLTSLDEVKAHTKASASCGQCASVVQAILAHVTGEVVESKAAGMCGCTDLSHDEVRKEILRQELKNQDAVRSALGWRHADGCAKCRPALNYYLLCAWPAEYVDDYQSRFINERAHANIQKDGTYSVIPRMWGGLTNPTELRAIADVVDKFKIPTVKVTGGQRLDLLGVRKEDLPAVWADLGKAGLVSGHGYAKGLRTVKTCVGSEWCRFGTQDSTGLGVKLEKMMWGSWTPHKVKLAVSGCPRNCAEATIKDMGVVCVEAGYDISVGGNGGIELRGTDHLVRVATEAEVLEYCAAFMQIYREEAHYLERTAPWVERVGMDYVTKRVVEDEEGRKAAHARFLFSQKYAQTDPWAERASGAVDAHEFKTLAEVG

SEQ ID NO: 4375 - protein, 182 aa, Escherichia coli
MVRDMKHTVEVMIPEAEIKARIAELGRQITERYKDSGSDMVLVGLLRGSFMFMADLCREVQVSHEVDFMTASSYGSGMSTTRDLKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 4376 - protein, 216 aa, Xanthomonas campestris
MLGIGAFKQRMPRSGEALPGRTQALPLHNTHLINGHPLRGEFTGLAQVQFGLGCFWGAERKFWNVPGVYTTAVGYAGGKTPNATYSEVCSGQTGHTEAVLVVYDAQAVSFEQLLRTFWESHDPTQGMQQGSDVGTQYRSAIYCSTQAQYDAAIASRDAYQQQLTAAGYGDITTEILYPAPTFYYAEDDHQQYLAKHPNGYCGLGGTGVSCPIGLDA

SEQ ID NO: 4377 - protein, 536 aa, Arabidopsis thaliana
  misc_feature (386)..(386): Xaa can be any naturally occurring amino acid
MNPPVDLPYIPDDLLLNCLARVSRLYYPILSLVSKRFRSLVASLELYEIRKLLGHREKCLYLNLRFSSESEPRWFTLCRRPTRSPNPNFNSGWFASCFIPHTMKKEKKSSDNNLMVPVPTSNFITPPSELTRITNGSNIYIVRVFTNGAFSSRFLFMDCRSHTLHEVPRMDKTKKKPFMIRVLDGKIYVIEGCKNPDYSNLIERFDLKTQTWEHVPSPSAEIRGSYITGSLVYDGKLYLFGDKRVVYKPKENKWDVVGLEMPLRWTPSYISCVVDNVIYSYGRSRVLMWYNTEERLWRYLKGLKKLPKLPKDCTCVRLLGYSGKVVVLWEKNVGGGDPQKKMIWCAEIALERRSANKIYGKIEWCDVVLTLPSSASVGKLAPVAVXNLVYKPKEKTWDVVGFEINFHWIPHDSFCVIDKVIIYYYNRHSRLLEWYDPEGSSWGILNGLEELLPKLPRVLVSRHVRLVDYGGKVAIFWEKEVRPLIGYNKITIWCAEIALERRNAQEIYGKIEWCNVVLTLPSSCSIDELNAVSIIV

SEQ ID NO: 4378 - protein, 447 aa, Bacillus thuringiensis
MLHRYLPMTEEDKKEMLQTIGVQTIDELFSDIPESVRFKGDLKIKEAKSEPELLKELSQIASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 4379 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 4380 - protein, 313 aa, Chamaebatiaria millefolium
GGLGDVLGGLPPAMAANGHRVMTISPRYDQYKDAWDTEVSIEVKVGDKTETVRFFHCYKRGVDRVFVDHPLFLEKVWGKAASKIYGPITGEDYKDNQLRFSLLCQAALEAPRVLNLNSSKYFSGPYGEEVVFIANDWHTALLPCYLKAIYKPEGIYNTAKVAFCIHNIAYQGRFAFADFSLLNLPDEFKSSFDFIDGYDKPVKGRKINWMKAGILESDKVLTVSPYYAKELVSSVDKGVELDKFIRKVGIRGIVNGMDVQEWNPLTDKYTNVKYDATTVTDAKPLLKEALQAEVGLPVDRNIPVIGFIGRLEE

SEQ ID NO: 4381 - protein, 966 aa, Colwellia psychrerythraea
MITYYDPKTEPAANQSADLSKDLGTPPSKSTVQVSVEIDGVTIVVPEGTSVLRAAAIADINIPKLCASDNLEAFGSCRLCAVEIEGMRGMPASCTTPVREGMKVQTQNPKIATLRRNVMELYISDHPLDCLTCPANGDCELQDMAGAVGLREVRYGFEGKNHLDGATDSSNPYFSFDDSKCISCSRCVRACEEVQGTFALTVEGRGFDSRISTGQDTNFLESDCVSCGACVQACPTATLTEKSVIDNGQPDHSIITTCAYCGVGCSFRADMQGDKVLRMVPDKNGKANQGHSCVKGRFAFGYATHQDRITSPMIRDNIEQDWREVSWEEALAFAAKRLTDIQEEHGRNSIGAITSSRCTNEETYLVQKLVRAVFQNNNVDTCARVCHSPTGYGLKATLNESAGTQTFESVMKADVVLIIGANPTDAHPVFGSLLKRRLRQGAKLVVADPRSIDLIDSPHTKAQHHLKLRPGTNVALINALAHVIVDEGLEDADFIQSRCDDASFQQWYKHIQDQRHSPESTTEITGVDATELRAAARLYANAGNGAIYYGLGVTEHSQGSSSVMAIANLAMVSGNIGREGVGVNPLRGQNNVQGSCDMGSFPHELPGYRHVSDESTRNLFEQEWQVSLDCEPGLRIPNMFEAAIHGDFKGLYCQGEDIAQSDPNTQHVQKALSSMKCIIVQDIFLNETAKYAHVFLPGSSFMEKNGTFTNAERRISRVRKLMPALAGKEDWQVTIELAKVLGYEMNYEHPSEIMDEIARLTPTFSGVSYERLDQLGSIQWPCNEKSPLGTPIMHTEDFVGEKGKFAITEYVATPEKANKHFPLLLTTGRILSQYNVGAQTRRTANQVWHDEDVLEIHPNDAEDRGINDGDWVGIASRAGTTALRALISQRVQPGVVYTTFHHPLSGANVVTTDNSDWATNCPEYKVTAVQATKVDEPSQWQAEYAQFSQRQAKYLKNKNGGEVAKT

SEQ ID NO: 4382 - protein, 353 aa, Haemophilus influenzae
MKLSKTFLFITALCCAAPTLAIQNSTSSSGEQKMVMENTQNIREIYLAGGCFWGMEAYMERIHGVKDAISGYANGNTGKTSYHMIGLTDHAETVKVTYDANQISLDKLLKYYFKVIDPTSVNKQGNDRGRQYRTGIYYQDGADKAVIEQALAQLQTKYKKPVQIEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 4383 - protein, 548 aa, Yersinia pestis
MGKTIVIVGGVAGGASAAARLRRLNEYDNIIILERGEYISFANCGLPYYIGGVITERDKLLIQTPEKMKDRFNIDVRTENEVVDIDSASKTITVINHKVGKEEFIQYDTLILSPGARPFIPDIAGLSVNGPVFTLRNMSDTDNIKAYLISATPEAVTVIGGGFIGLEMAENLVSSGLKVTIIELSNQILSPLDYEMAAIVEKHLKDNGIDVIKNDAVVQFDESAHQIHLKSGKIITTDMVILAIGVEPENDLAKKAHLDLGIRGSILVNEKLQTSVADIYAIGDAIQVVDYINGQATYIPLAWPANRQGRLLADIINGRDVRYHGTLGTAIAKVLDLSAACTGNNERLLKRLAIPYQVVHIHGMSHASYYPGAHQISLKLLFSPENGRILGAQAVGQGGTDKRIDVLATAIKGRLTIYDLPDLELAYAPPYSSAKDPVNMLGYVAENISNGDVMTKQWHEVDAFMADGGIIIDVRDEAEFISGSIKTAVNIPLSELRQKLALIPQDKKILVTCQVGLRGYIAARILSQYGYTVANLDGGYLTFNYANA

SEQ ID NO: 4384 - protein, 250 aa, Medicago truncatula
MASSSYALRTIPSSFVKPTAFATTPRSFLTPSSAFTPFTSSKNLKMNAAFSKSCFSSVPMKSFTCKSQVNEYADTEKVQEMHVYELNERDRGSPAYLRLSNKSVNSLGDLVPFSNKLYTGDLQKRIGITTGICILIEHKAEKKGDRYEAIYSFHFGDYGHLAVQGPYLTYPEDTYLAVTGGSGIFEGVKGQVKLHQIVFPFKIFYTFYLRGIKDLPQELLGKHVEPSPAVEASPAAKALEPHAVIAGFTY

SEQ ID NO: 4385 - protein, 313 aa, Chamaemespilus alpina
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYENAKVVFCIHNIAYPGRFPIADFSVLNLPETLGGSFDFIDGYTKPVKGRKINWMKAGIIESDRVVTVSPFYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 4386 - protein, 893 aa, Saccharomyces cerevisiae
MAGHHHEHEQERDHEQEHEHDSLQRPTTGSERTRSISFSKLLTRSWKRNASSSNNMSVSSVNLYSDPENSRESDHNNSGSEGQSSRFSKLKSMFQSGNSSKNASAHNSSQSSLEGDSASSSSKLRYVKPMTSVANASPASPPLSPTIPETDVLQTPKMVHIDQHEHEREHSNCGSPIMLSSSSFSPTVARTGTGRRRSPSTPIMPSQNSNNSSSTSAIRPNNYRHHSGSQGFSSNNPFRERAGTVRSSNPYFAYQGLPTHAMSSHDLDEGFQPYANGSGIHFLSTPTSKTNSLTNTKNLSNLSLNEIKENEEVQEFNNEDFFFHDIPKDLSLKDTLNGSPSRGSSKSPTITQTFPSIIVGFDNEYEEDNNNDKHDEKEEQQTTTDNKTRNLSPTKQNGKATHPRIKIPLRRAASEPNGLQLASATSPTSSSARKTSGSSNINDKIPGQSVPPPNSFFPQEPSPKISDFPEPRRSRRLRTKSFSNKFQDIMVGPQSFEKIRLLGQGDVGKVFLVREKKTNRVYALKVLSKDEMIKRNKIKRVLTEQEILATSNHPFIVTLYHSFQSEDYLYLCMEYCMGGEFFRALQTRKTKCICEDDARFYASEVTAALEYLHLLGFIYRDLKPENILLHQSGHIMLSDFDLSIQAKDSKVPVVKGSAQSTLVDTKICSDGFRTNSFVGTEEYIAPEVIRGNGHTAAVDWWTLGILIYEMLFGFTPFKGDNTNETFTNILKNEVSFPNNNEISRTCKDLIKKLLTKNESKRLGCKMGAADVKKHPFFKKVQWSLLRNQEPPLIPVLSEDGYDFAKLSSNKKRQTSQDSHKHLDEQEKNMFEERVEYDDEVSEDDPFHDFNSMSLMEQDNNSMIYGNTNSYGKIAYTPNSNRSRSNSHRTFFKR

SEQ ID NO: 4387 - protein, 161 aa, Musa acuminata
SSMMVSSAATVSRASPAQSSMVAPFTGLKSTSAFPVTRKANADLSHLPSNGGRVQCMEVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 4388 - protein, 152 aa, Glycine max
IDLRGFKATAGIEPEDVAKRLMDYGFHGPTMSWPVPGTLMIEPTESESKAELDRFCDALISIREEIAEVENGKADAHNNVLKGAPHPPQLLMGDAWTKPYSREYAAFPAAWLRGAKFWPTTCRVDNVYGDRNLICTLQQASQVAEEAAAATA

SEQ ID NO: 4389 - protein, 416 aa, Leptospira interrogans [sequence omitted]

SEQ ID NO: 4390 - protein, 313 aa, Chamaemespilus alpina
GGLGDVLGGLPPAMAANGHRVMTISPRYDQYKDAWDTQVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYNKPVKGRKINWMKAGILESDKVLTASPYYAEELVSSVEKGVELDNIIRKTRIQGIVNGMDVQEWNPLTDKYTTVKYDASTVANAKPLLKEALQAEVGLPVDRDIPVIGFIGRLEE

SEQ ID NO: 4391 - protein, 218 aa, Arabidopsis thaliana
MGTPESSREPCPDRILDDVGGAFAMGAVGGSAYHLIRGIYNSPGGARLSGGVQALRMSGPRSGGSFSVWGGLYSTFDCALVYARQKEDPWNSILSGAATGGFLSLRQGLGASARSALVGGVLLAMIEGVGIMLNKVQSTAHNEQFMEDHAATSLPYGMGQISGQSVPVPETSSSSSGSVSWFGSLFKKKKETEDHHSESRTHILESFDAPPVPTYEFK

SEQ ID NO: 4392 - protein, 313 aa, Chamaemespilus alpina
GGLGDVLGGLPPAMAANGHRVMMISPRYDQYKDAWDTGVTVALKVGDKTETVRFFHCYKRGVDRVFVDHPLFLEKVWGKTASKVYGPVAGVDFKDNQLRFSLLCQAALEAPRVLNLNSGKYFSGPYGEEVVFIANDWHTALLPCYLKAVYKPRGIYSTAKVAFCIHNIAYQGRFAFADFALLNLPDEFKSSFDFIDGDEKPVKGRKINWMKAGILESDKLLTVSPYYAEELASAVEKGVELDNIIRKTGVFGIVNGMDVQEWNPLTDKHTTIKYDASNVADAKPLLKETLQAEVGLPVDRDIPVIGFIGRLEE

SEQ ID NO: 4393 - protein, 313 aa, Chamaemespilus alpina
GGLGDVLGGLPPAMAANGHRVMTVCPRYDQYKDAWDTSVLVEIEVGGRAETVRFFNCYKRGVDRVFVDHPLFLEKVWSKTGSKIYGPRTGVDYMDNQFRFSLLCQAALEAPRVLNLNSNEYFSGPYGDDVVFIANDWHTALLPCYLKTIYKPKGIYKNAKVVFCIHNIAYQGRFSFSDFSLLDLPDNLKGSFDFIDGHAKPVKGRKINWMKAGILESDRVVTVSPYYAQELVSGEDKGVELDNIIRKTGITGIVNGMDVQEWNPATDKYLDIKYDNTTVLDAKPLLKEALQAEVGLPVDRNIPVFGFIGRLEE

SEQ ID NO: 4394 - protein, 130 aa, Triticum aestivum
GLDRALGQTNEGRFLVVDAGGMIQGKHINDMGAYVSLLEYNNIEGMILLYELSRRRIRSIFSLMKVGRQEPSMVLRVDRDKGYINLSKRRVSEEEAATCEDRYNKYKLDHSIMRHADHTVGDHLEPLYQR

SEQ ID NO: 4395 - protein, 516 aa, Gentiana scabra
MPIKMSPIYATLTLHLAAALFLFFHVQKLVHYLHGKATGHRLPPGPTGWPILGALPLLGNMPHVTFANMAKKYGPVMYLKVGSHGLAIASTPDAAKAFLKTLDLNFANRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHERTSHERKQKPDFLDFVIANGDNSDGERLNTDNIKALLLNLFTAGTDTSSSIIEWALAELLKNRTLLTRAQDEMDWVIGRDRRLLESDIPNLPYLQAICKETFRKHPSTPLNLPRIASEPCEVNGYYIPKGTRLNVNIWAIGRDPSVWGDNPNEFDPERFLYGKNAKIDPRGNDFELIPFGAGRRICAGTRMGILLVEYILGTLVHSFDLKLGLPEEELNMDETFGLALQKAVPLAAMLIPRLPLHVYAP

SEQ ID NO: 4396 - protein, 616 aa, Unknown
  Nocardioides sp. JS614
MRAEGRGQTRARRRSLAAQLSVPVRRYLNTEAGSAGLLLGATALALLWANSRWSGSYESLWSAQAAVSVSRWDLSMDLGHWVNDGLMALFFFVIGLEVRREFSVGELTDPRRAAIPVLAALGGLAVPALLYVAIAPGSAAHGWGVVIGTDTAFLLGALAVVGPTFATQLRIFLLTVTVIDDIVAVSVIGLFYSDSLDPAAIGVMAVFLVLMAALSRLGVWRAAPYVLAVLGLWIATVQSGLHASIAGMLGGLLVAAHSPTREAVEGAARRFRAFRQSPDVQVGRSARLGLAQAVSVNERLQAALHPWTSYLVVPLFALANAGVDLRDGVLGDALASRLTWAVVVALVLGKLAGIGLASVAGVRAGLGRLPRGVRLGHVFGGGALSGIGFTVALLIAGLAFESDQRDRATVGILIAAVLATGLGWAVFHAAAVLRGQTDADLPRFLDPPVDARHDHVRGREDAPLTLVEYGDFECPFCARATGVTTELRERFGDDLRYVFRHLPLVDVHPHAELAARAAVAADHQGRFWELHDLLFEHQGELEVEDLAGYAADLGLDVEAFLRDLEEDDTADRVRRDVASAEASGARGTPTFFVGGVRHTGPHDAETLARALEESRT

SEQ ID NO: 4397 - protein, 502 aa, Unknown
  Rhodococcus sp. RHA1
MTESVSQGASSRAKTNRSLQGASGDDVGYRKSLKPRHIQMIAVGGAIGTGLFMGAGGRLSASGPSLVLVYALCGFVAFLVLRALGELVLYRPSSGSFISYAREFYGEKMAFVVGWLYFLMWAMASIVDVTAIALYLKFWAPAVPLIDAAPQWTLALVALFVVTLLNLVSVKLFGEMEFWFAIIKVTALVAFLVFGTLFLVLNGETDLGATGFSIVLDHGGVFPTGAITPILAAGGVIFAYASVELVGIAAGETENPSRIIPKAINTVIIRILLFYVGSVLLLSLLLPFGAYTAQTSPFVTFFSHIGSPETAAVASSVMNFVVLTAALSSLNAGLYATGRVLRSMALNGSAPSFTSKLSGNGVPFGGILLTVGCALLGVGLNAIVPTKAFEIVLEISALGIIAAWGTIMLCQLKLRKWANEGRVERPSFRLFGAPFTSYFVLAFLAFVLVTMGFSETGQWVLGSLVVIVPLLIVGWRRSRARLSTTTDHRDFVPVEIPPRTSH

SEQ ID NO: 4398 - protein, 276 aa, Unknown
  Shewanella sp. MR-4
MEILSLPGQRAKGKVWLVGAGPGDVELLTLKAWRILKSADAVLYDALVSQDILDLIPKDAEKIAVGKRAGKHSAAQDEINQLLVTKAYTRKSVVRLKGGDPFIFGRGGEELQTLVEAGVEFEVVPGITAASGTSAYAGIPLTHRDYAQGVTFITGHCQLESRPMDWQGYANPNNTLVVYMGILNAGIIRQGLIDAGRSPQTPVAIVSKATTQSQQRFIGQLDSLEQLAADPQLQMPALMIIGEVVALADSLNWFQPKGEGESALDTADAAKIVAKI

SEQ ID NO: 4399 - protein, 302 aa, Clostridium difficile
MVDIIVIGAGPAGLTSAIYAMRAGLSVTVFEKNIYGGQVASTSEVENYPAVQKISGVEFSNNIYNQAVAQGVDIQFDEVEEINLEGKVKVVKTSSGEHKAKAVILANGVERRKLGCAGEQEFTGRGVSYCATCDGAFFKDKEVAIVGGGNTALEDALFLANNCTKVYLIHRRDSFRGEEVLEKSVKARENIEILYSHGVEKIEGEKTVSKIEVKNLKTEEKRTIDVSGIFIAIGLKPNNKMFENVLDLDEGGYIISDESCTTSVEGVYVAGDSRTKFLRQIITAASDGAIAAVQAANYINVE

SEQ ID NO: 4400 - protein, 701 aa, Pseudomonas syringae
MNPVIKKFQFGQSTVTLETGRIARQASGAVLVTVDDDVSVLVTVVGAKQADAGKGFFPLSVHYQEKTYAAGKIPGGFFKREGRPSEKETLTSRLIDRPIRPLFPEGFMNEVQVVCTVVSTSKKIDPDIAAMIGTSAALAISGIPFDGPVGAARVAFHESTGYLLNPTYEQLQASSLDMVVAGTSEAVLMVESEAKELTEDQMLGAVLFAHDEFQVVINAIKELAAEAAKPTWDWQPKPEATALLGAIRAEFGDAISQAYTITVKADRYARLGELKDQVVAKLAVEEGSPSAGEVKAAFGEIEYRTVRENIVNGKPRIDGRDTRTVRPLNIEVGVLPKTHGSALFTRGETQALVVATLGTARDAQLLDTLEGEKKDPFMLHYNFPPFSVGECGRMGGAGRREIGHGRLARRSVQAMLPGADVFPYTIRVVSEITESNGSSSMASVCGASLALMDAGVPMKAPVAGIAMGLVKEGEKFAILTDILGDEDHLGDMDFKVAGTSKGVTALQMDIKIKGITEEIMEIALGQALEARLNILGQMNQIIGQSRNELSANAPTMIAMKIDTDKIRDVIGKGGATIRAICEETKASIDIEDDGSIKIFGESKEAAEAARQRVLGITAEAEIGKIYLGKVERIVDFGAFVNILPGKDGLVHISMLSDARVEKVTDILKEGEEVEVLVLDVDNRGRIKLSIKDVAAAKASGV

SEQ ID NO: 4401 - protein, 823 aa, Unknown
  Azoarcus sp. EbN1
MKKMKLVMIGNGMAGVRTLEELLKHAPDLYDITVFGAEPHGNYNRILLSPVLAGEMTLPEIMLNDLGWYRDNGITLHAGKRITKIDRVRRRVIAGDGTEAEYDRLLVATGSTPFIPPIPGKELPGVLAYRDIADTEAMIDAAARYRHAVVIGAGLLGLEAANGLMLRGMDVTVVHLADWIMERQLDRAAADMLQASLEAKGMKFLLAKQTDALVEGGGDKNNAGRVAGVRFKDGGEIPADLVVVAAGIRPNYALAESAGLHCGEGRVRGIVVSDTMQTITDPRIYAVGECVAHRGVAYGLVAPLFEQGKVCANHLANFGIGRYEGSVTSTKLKVTGIDVFSAGDFSGGADTEEIVLHDRQGGVYKRIVLRNNRIVGSVLYGDTADGAWYFQLMKDGQDIGAIRDHLMFGQNNLGDAGHKGENKAAAMPDSAEVCGCNGVCKGTIVKAIKEKGLFTIDDVKKHTKAASSCGSCTGLVEQILASTIGGAYQAVSVHDKAVCACTELSHGDVRKAIRDHKLLTIPAAMDMMAWKTPNGCATCRPALNYYLISTWPHEAKDDPQSRFINERAHANIQKDGTYSVVPRMLGGLTTPAELRRIADVAEKYQIPTVKVTGGQRIDLLGIRKDDLPKVWQDLGMPTGHAYGKSIRTVKTCVGSEHCRFGTQRSMAMGVDLERMLFGMWSPHKVKLAVSGCPRNCAESGIKDVGVIGVDSGWELYVAGNGGIKTEVAQFLCKVATREEVLEYSAAFLQLYREEGFYLERTVHYVHRVGLEHVKKRVVEDAVNRKALYERLLYAVQDYTDPWAERYAADAAQALRAQFETLEA

SEQ ID NO: 4402 - protein, 260 aa, Oryza sativa
  misc_feature (82)..(82): Xaa can be any naturally occurring amino acid
  misc_feature (101)..(101): Xaa can be any naturally occurring amino acid
  misc_feature (181)..(181): Xaa can be any naturally occurring amino acid
MLRPSTPTRRLLQSVGGGSNPNRIPGIPPADPPSGGVSSDVVVILAALLCALICVVGLAAVARCARNRRNSGGAGAGAGSAXPSHRPAHAGHFGGGGSGGXGGVTTTTTTTTAAKTAAKGLKKKAQKAQPKLAYADAVAAAAAARGTVVGEEEEGKLEVLAECAICLSEFGEREEVRVLPXCGHGFHVACVDTWLRSNSSCPSCRRPIVLDDPSPPKRCRKCEAIVLEAVVAASSSSSSSAATATGSGGGGGGGGGRFLP

SEQ ID NO: 4403 - protein, 510 aa, Burkholderia pseudomallei
MCGIGAIFSTQRASVDGIERSLSALMSKIAHRGDASRFNENLIRERFGLATNRLAIVERDHARQPVSDHERDLHVVLNGQIYNYKELRDELAARGHRFSHAGDAEVLLRAYLEYGPSFATKLDGMFSFVLFDNLNGKFLIGRDHVGIKPLYYAQRDGVWYVASELKALTHVNARIETLAPGTLFDGKETIRYVSYDASRPVSRDSFDEAKARVRTLLEESVRRRVDTDLPICVMFSGGIDSAIVLQLAHRYHPDVTAISFGLPGSNDIEIAHRYCAEHGIRHVIYTFTKQDLLENIDDAVYYGEFFEKIDAIDSAIAHFGYYIANKLGLKVALCGEGSDEIFGGYDLFKTHAQPGALSLYRLNNLHRTDLQRVDRASMRNTVEARVPFMDAELIDYVLSLDFSYKLHGGVEKHILREAFRDVLPGYIIDRPKIRMPDGSGVKNVIIDHIDSLGDAPPDDAARRLGEIGLSDRSALFFARKYLECNFPFPTQRFKQAGKDFSESGYFDFIS

SEQ ID NO: 4404 - protein, 605 aa, Setaria italica
MAALATSQLVTTRAGFGLGDASSSMFRPGVQGLRGSRASSPAATLSVRTSARAAPRQQHRRAQRGARFPSLVVCATAGMNVVFVGAEMAPWSKTGGLGDVLGGLPPAMAANGHRVMVISPRYDQYKDAWDTSVVSEIKVGDRYERVRFFHCYKRGVDRVFIDHPSFLERVWGKTGEKIYGPDAGVDYKDNQLRFSLLCQAALEAPRILSLNNNPYFSGPYGEDVVFVCNDWHTGPLSSYLKSNYQSNGIYRNAKTAFCIHNISYQGRFAFSDYPELNLPERFRSSFDFIDGYEKPVEGRKINWMKAGIIEADRVLTVSPYYAEELISGIARGCELDNIMRLTGITGIVNGMDVSEWDPSKDKYIATKYDVSTAIAAKALNKEALQAAAGLPVDRKIPLVAFVGRLEEQKGPDVMAAAIPQLMEEDVQIVLLGTGKKKFERMLMSAEEKYPDKVRAVVKFNAAVAHHIMAGADLLAVTSRFEPCGLIQLQGMRYGTPCVCASTGGLVDTVIEGKTGFHMGRLSVDCKVVEPADVQKVASTLKRAIKVVGTPAYEEMVRNCMIQDLSWKGPAKNWENVLLSLGVAGSQPGIEGEEIAPLAKENVAAP

SEQ ID NO: 4405 - protein, 391 aa, Pseudomonas syringae
MTQVPNRETPRGVAILTRFLASESAGGIVLMAAALAALIVANSPLSAGYFSTLHSVWLGLSVELWINDGLMAIFFLMVGLEIKREVLAGGLATWGQRALPGFAALGGMLVPALIYIAINWGNPQTLSGWAIPAATDIAFALGVLSLLGNRVPTSLKVFLAALAILDDLGAVTIIAFFYSSGLNLPMLAAAFVTLAVLVALNRLNIRRLLPYLLLGALLWFFVLQSGVHATLAGVALALCIPMGKPEEEARSPLLLLEEKMHYWVAFAVVPIFGFANAGVSLSGITLANLIDPVPLGVALGLFVGKQIGVFLAAVLAIRAGLAVLPEGSNWVQLYGVAILCGIGFTMSLFIGNLAFPGSQHLIDEVKVGVLIGSGLAAVAGIVLLRSRFSRH

SEQ ID NO: 4406 - protein, 470 aa, Acidithiobacillus caldus
MTRLLIIGGSDAGISAALRAHELDPQTEVSVLLADEYPNYSICGLPFYLSGETPDHRQLAHRTAFDGIEILTNHRAVSVHPAAKTVDVVRGANGSVKTLRYDHLVIATGAVPVRPQGLPGLDLPGVYLLHTMGDGFAVHSRLMGGETRSAIIIGAGYIGVEMADALRHRGIDVTLVSHTDPVFPSVDPSFGRLIGEELSRHGVRVVVGCTVERIEAADNRRGLTVSGSGGFTASADLVLVATGARPDTTLAAAAGIALGPSGAIRVTQRMETTLPGIWAAGDCAETWHRILQRPAYLPLGTTAHKQGRVAGENAVGGERLFAGSVGTQTVKVFELAIARTGLREAEARTADFDPVTIETETWDHKAYYPGAQKLRVRVTGDRRTGRLLGAQILGPWRSEVSKRIDVFATALFHGMGVEDLNDLDLSYTPPFGSPWDAVQMGAQAWTSVMKNEVASCSPPIDPQILGRSTP

SEQ ID NO: 4407 - protein, 397 aa, Streptomyces coelicolor
MLGIVLAGGEGKRLMPLTAARAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSLVITPGSDGQTVTGFLEKPPNPPGLGHDPGCVFPSMGNYVFTTKALVEALHRDAEDPDSVHDMGGSILPQLTDRGEAALYDFSANHVPGETTRDQGYWRDVGTLDAYYDAYMDLIAERPAFNLYNRDWPVYTHSTQLSPARFNAGGIASESIISAGCLIRGQVTRSVLSPGVVVDPGAVVQGSVLHNVHIGRGAVVRGAVLDKNVQVPPGATIGVNPQRDGELYTVSKGGVIALGKGQRVP

SEQ ID NO: 4408 - protein, 292 aa, Yersinia pestis
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAADNPDAVIVAIICDRGDRYLSTGVF

SEQ ID NO: 4409 - protein, 209 aa, Haemophilus influenzae
MGKKKRSASSSRWLNEHFSDQFVQKAHKQKLRSRAYFKIDEIQQTDKLFKQGMTVVDLGAAPGGWSQYVVSQIGGKGRVIACDILEMDPIVGVDFLQGDFRDENVLNALLARVGEDKVDVVMSDMAPNFSGMPSVDIPRAMYLVELALDMCKQVLATKGSFVVKVFQGEGFDEYLREIRSLFNVVKVRKPEASRGRSREVYIVATGYKG

SEQ ID NO: 4410 - protein, 650 aa, Unknown
  Synechococcus sp. WH 5701
MYEQISHSLLNSILDELRPEIKRQNLRYFYTRLGANFYAIHSLFSTLYGDREDFQPQMVRLVETMAEGYIYRSEESERIDMSREQDHNWFLSQKWVGMALYTNGFANDLGDLAGKISYFQELGVNMVHIMPILKCPAGQSDGGYAISNFREIDSRVGDLNDIQRISEQFRKCGILLVLDIVLNHTSDEHEWALKAKDGDPRYQNYYLTFEDRSVPDVFEQGMPMVFPVTDPGNFTWNEEMKRWVMTVFHDYQWDLNYSNPEVFIEILSIVLFWANQGVDVLRLDAVAFLWKKLGSTCQNERKAHLILQLLKDCCQVTAPGVLFIAEAIVAPSEVAKYFGEDAIVAKECEIAYNATLMALLWDGIATRNTKLLREGIKSLPTKLDRATWLTYVRCHDDIGFGFDDKDIAAAGYEPHSHRMFLIDYFTGKFSDTSRGLEFMRNDSTGDARICGSLASLAGLESALEKGDQGLIDMAISKILLLNGVILSFGGIPLIYNGDALGQLNDYSYIDDPSKSNDSRWVHRPKIDWEKAALRHQRGTVECRIFTAMKRMISIRKEISAFADFNNRELMHSDNQHLLCYLRYNHLRSSEKVFVIANFDDHPQQLELESYSRYGINPRANYTDLYSGIKPSQYDGCIALQGGQFYWLSES

SEQ ID NO: 4411 - protein, 313 aa, Cormus domestica
GGLGDVLGGLPPAMAANGHRVMTISPRYDQYKDAWDTEVTVELKVGDKTETVRFFHCYKRGVDRVFVDHPLFLEKVWGKTASKVYGPVAGVDFRDNQLRFSLLCQAALEAPRVLNLNSSNCFSGPYGEEVVFIANDWHTALLPCYLKAVYKPRGIYSTAKVAFCIHNIAYQGRFAFADFALLNLPDEFKSSFDFMDGYEKPVRGRKINWMKAGILESDKLLTVSPYYAEEIVSAAEKGVELDNIIRKTGIFGIVNGMDVQEWNPLTDKYTTIKYDASTVADAKPLLKETLQAEVGLPVDRDIPVIGFIGRLEE

SEQ ID NO: 4412 - protein, 553 aa, Colwellia psychrerythraea
MTENFAQLFEESLKEIETRPGSIIRGTIVAVNKDNVIVDAGLKSESVISIDQFKNAAGEVEVVVGDEIDVALDATDDGFGETILSREKAKRHEAWQVLEKAYEEKETVIGVINGKVKGGFTVEVSDIRAFLPGSLVDVRPVRDTAHLEGKPLEFKVIKLDQKRNNVVVSRRAVIEAEGSAERDELLESLAEGQEVKGIVKNLTDYGAFVDLGGIDGLLHITDMAWKRVKHPSEIVNVGDEIQVKVLKFDRERTRVSLGMKQLGEDPWVAIANRYPEGSKLSGRVTNLTDYGCFVEIQEGVEGLVHVSEMDWTNKNIHPSKVVNLGDTVEVLVLEIDEERRRISLGLKQCIANPWEEFAKNFNKGDKVSGKIKSITDFGIFIGLDGGIDGLVHLSDISWAGGEEAVRDYKKGDEIDAIVLQVDPERERISLGVKQAEDDPFNMYLADKKKGAIVTGKVTEVDAKGATILLAESVEGYLRVSDISVERIEDASTVLKVGDDVEARFMGVDRKNRTISLSIKAKDQADEREAMDNLNQVEETGLSAMAAAFKNAKN

SEQ ID NO: 4413 - protein, 313 aa, Cormus domestica
GGLGDVLGGLPPAMAANGHRVMTISPRYDQYKDAWDTEVTVELKVGDKTETVRFFHCYKRGVDRVFADHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYDKPVKGRKINWMKAGILESDKVLTVSPYYAEELVSSVEKGVELDNIIRKTRIQGIVNGMDVQEWNPLTDKYTTVKYDASTVADAKPLLKEALQAEVGLPVDRDIPVIGFIGRLEE

SEQ ID NO: 4414 - protein, 164 aa, Arabidopsis thaliana
MANSVMATEQLCYIPCNFCNIILAVNVPCSSLFDIVTVRCGHCTNLWSVNMAAALQSLSRPNFQATNYAVPEYGSSSRSHTKIPSRISTRTITEQRIVNRPPEKRQRVPSAYNQFIKEEIQRIKANNPDISHREAFSTAAKNWAHFPHIHFGLMLESNKQAKIA

SEQ ID NO: 4415 - protein, 434 aa, Unknown
  Synechococcus sp. WH 5701
MTAAIALLASAGSNERLLGWLEQHQVLLEGFPLLAPAELVLALAEDQRSSGLKVSPLATLAAGGDIQIAERVLAGAVGAVLFFVDPATTLATTPDLRLLLRTCALAGIPLALNEATATLALRGLGRSRLAYLIFNPVAGQGEPNQDLALIRSLLEPQLLLNVVVTRPDRDPADQTRELVDLIQARSEPHSGSVMILASGGDGTVSAVAGAVINTGIPLGVIPRGTANAFATALAIPTDLEGACETILAGHTRVVDAARCNDTPMILLAGIGFEAGMVDRATRELKTMLGPLAYVLAGAQQLATQEPFQARLTIDGQVTELQSGAITVANVAPATSVLAQGFGQVIPDDGLLEITIASPANRLQGLNAFASLVASAVVRSPTNRPDLLCLRAHAITISTDPPQNLVIDGEMLACNPISITCLSGALTVFTPLPVA

SEQ ID NO: 4416 - protein, 313 aa, Cormus domestica
GGLGDVLGGLPPAMAANGHRVMTVSPRYDQYKDAWDTGVPVEIKVGGRVETVRFFHCYKRGVDRVFVDHPSFLERVWGKTGSKIYGPSAGEDYMDNQFRFSLLCQAALEAPRVLNLNSNKYFSGPYGDEVVFIANDWHTALLPCYLKAIYKPKGIYENAKVVFCIHNIAYQGRFPTSDFSVLNLPENLKGSFDFIDGYNKPVKGRKINWMKAGILESDRVVTVSPFYAQELVSGEDKGVELDNIIRKTGITGIVNGMDVQEWNPATDKYLDTKYENTTVLDAKPLVKEALQAEVGLPVDRNIPVIGFIGRLEE

SEQ ID NO: 4417 - protein, 93 aa, Arabidopsis thaliana
GGPSRPKPRVSLYLSPVPMVAFPLKAVMFVLFTGLNSSVAFQATRRVNTTITSITGTGGGVNCFQVWPPMGKKKFETFFNFLDLTDSEWVKEV

SEQ ID NO: 4418 - protein, 205 aa, Unknown
  Populus x canadensis
TFDVNTKTGGPFGTIRHPDELAHGANNGLDIAVRLLEPLKEQFPNLSYADFYQLAGVVAVEITGGPEVPFHPGRPDKSDPPPEGRLPDATKGSDHLRDVFGHMGLSDKDIVALSGGHTLGRCHKERSGFEGPWTPNPLVFDNSYFKELLSGEKEGLIQLPTDKTLLEDPVFRPLVEKYAADEDAFFADYAEAHMKLSELGFAEAY

SEQ ID NO: 4419 - protein, 192 aa, Borrelia burgdorferi
MYRLDDEYSKKAKREGYLARSVYKLIEINEKFSLFSSGNVLDIGASPGSFSQYAYKKLKRGILVSVDINDIGLRYDDNFYFIKGDIFLDDTVFKINTFKPYSLVISDVAPKTTGNRLVDTSNSFNLSMRIIDLSLEVLLKKGNLLVKVFQGGDEMQIFKKFEKYFKFVKKIRPKAVRKNSFEIYFLGKSFGK

SEQ ID NO: 4420 - protein, 313 aa, Cormus domestica
GGLGDVLGGLPPAMAANGHRVMTVSPRYDQYKDAWDTSVLVELEVGGRVETVRFFHCYKRGVDRVFVDHPLFLEKVWGLTESKIYGPRTGVDYMDNQFRFSLLCQAALEAPRVLNLNSNKYFSGPYGDDVVFIANDWHAALLPCYLKTIYKPKGIYKNAKVVFCIHNIAYQGRFPNSDFSLLDLPDNLKGSFDFIDGHDKPVKGRKINWMKAGILESDRVVTVSPYYAQELISGEDKGVELDNTIRKTGITGIVNGMDVQEWNPATDKYLDIKYDNTTVLDAKPLLKEALQAEAGLPVDRNIPVFGFIGRLEE

SEQ ID NO: 4421 - protein, 72 aa, Xanthomonas campestris
MSKDDSIEFEGSVSETLPNTTFRVKLENGYEIIAHISGRMRKNYIRILTGDRVKVEMTPYDLTKGRITYRMK

SEQ ID NO: 4422 - protein, 313 aa, Cotoneaster apiculatus
GGLGDVLGGLPPAMAANGHRVMTVSPRYDQYQDVWDTSVLVEIEVGGRVETVRFFHCYKRGVDRVFVDHPVFLEKVWGKTESKIYGPRTGEDYMDNQSRFSLLCLAALEAPRVLNLNSNEYFSGPYGDDVVFIANDWHTALLPCYLKTIYKPKGIYKNAKVAFCIHNIAYQGRFPFSDFSHLYLPDNLNGSFDFIDGYDKPVEGKKINWMKAGILESHRVVTVSPYYAQELVSGEDKGVELDNIIRKTGITGIVNGMDVQEWNPATDKFLEIKYDNTTVLDAKPLLKEALQAEFGLPVDRNIPVFGFIGRLEE

SEQ ID NO: 4423 - protein, 333 aa, Unknown
  Mycobacterium sp. MCS
MPVRNGRKAHMTSSSTVHDVIIIGSGPAGYTAAVYAARAQLKPLVFEGSQFGGALMTTTEVENYPGFRNGITGPELMDEMREQALRFGADLRMEDVDEVSLDGPVKTVTVGDETHRARAVILAMGAAARHLGVPGEDALLGMGVSTCATCDGFFFRDQDIAVIGGGDSAMEEATFLTRFARSVTVIHRREEFRASRIMLDRARANEKITFMTNTAVTEIEGDPKVTGIRLRDTVTGEESKLAVTGVFVAIGHVPRSDIVRGQVDVDEDGYVLVEGRTTNTSVEGVFAAGDLVDRTYRQAITAAGSGCSAAIDAERWLAEIGVAPSDQEISAPI

SEQ ID NO: 4424 - protein, 109 aa, Unknown
  Mycobacterium sp. MCS
MADSATVTVTDDSFSEDVLTSSTPVLVDFWATWCGPCKMVAPVLEEIASEKAGALTVAKLDVDANPTTARDFQVVSIPTMILFKDGEPVKRIVGAKGKAALLRELTDLL

SEQ ID NO: 4425 - protein, 322 aa, Xanthomonas campestris
MSASSASPAKHSRLLILGSGPAGWTAAVYAARANLKPVVITGLQQGGQLMTTTEVDNWPGDPHGLMGPDLMSRMQAHAERFDTEVIFDHIHTADLSQRPFRLIGDSAEYTCDALIIATGATAKYLGIPTEEAFKGRGVSACATCDGFFYKDQDVVVVGGGNTAVEEALYLSNIARKVYLVHRRDTLRAEKIMQDKLFAKVAAGKIETVWHHAIEEVLGNDAGVTGVRVKSTLDGSTRDIDAHGFFVAIGHHPNTQLFDGQLAMNNGYLEIRSGLNGAATETSVAGVFAAGDVADQHYRQAITSAGFGCMAALDAERYLDKSA

SEQ ID NO: 4426 - protein, 177 aa, Plantago major
MASSMLSTSSTAVAGRAQATMVAPYAGLKSTSVFPATRKTGNAKLARNAGKVRCMQVWPPLGKKKYETLSYLPDLTVEQLAKEIDYLLRSKWIPCLEFELEHGFVYRENNRSPGYYDGRYWTMWKLPMFGCTDASQVIAELEECKKEYPNAWVRIIGFDNVRQVQCISFIAAKPPGL

SEQ ID NO: 4427 - protein, 112 aa, Dechloromonas aromatica
MKFVTAIIKPFKLDEVREALSAIGVQGITVTEVKGFGRQKGHTELYRGAEYVVDFLPKVKIEAAVRDDQLDQVIEAIEKSASTGKIGDGKIFVFDVEQVIRIRTGETGTDAL

SEQ ID NO: 4428 - protein, 381 aa, Zea mays
MAQPRAGQLAVSPAGGFLCQPHAKMQHSTVVALWNRTGDNRSSRLTISAVLCVMSISILDVHSRKLRPSPREELPYNSSERCANLGAALLDRSSAWNEEHSDGSWNAIYRRGAYSYYKNSGNESIINKKSTAGLRGAMFLRAPSRKLELPMAGGNDLKVLGVWTSPFVIRVRIVLNLKGLAYEYVEEDLGNKSALLLGSNPVHKSVPVLLHAGRAINESQVILQYIDEVWAGTGPAVLPADPYERAVARFWGAYIDDKVESAWLGMLFRCANEEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 4429 - protein, 336 aa, Spiroplasma citri
MMKKTQKNITIIGTGAYGTVLANVLTDNDHNVIMYGINNKEVDDINNAHLNRHFFGNLKINKEIKATTNFAEAVEDAEYIILGIPVVAIKLIIEKINKTVTKPVVIINVAKGLDPDTHEVLSKSIIKLMNPKILKEYAGIYGPSIAKEVLQRKPTCIMAVSQDFAIAQEVRELFNNEYFVTFANTDVIGTEYAVALKNALAIASGIFNGLYESDNAKASLITMGLNEIQLFAKTKGAQIETFFNFAGLADLILTATSSKSRNYSLGFEIAQVDNAQKVLSEQVKTVEGVLTCKTIVLDARANNITLPLFEALYDILYHNKRPSVIINNVFTKAILS

SEQ ID NO: 4430 - protein, 447 aa, Bacillus subtilis
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 4431 - protein, 329 aa, Triticum aestivum
  misc_feature (105)..(105): Xaa can be any naturally occurring amino acid
  misc_feature (130)..(130): Xaa can be any naturally occurring amino acid
  misc_feature (236)..(236): Xaa can be any naturally occurring amino acid
MGEASSPAIAKDVTELIGNTPLVYLNKVTDGCVGRVAAKLESMEPCSSVKDRIGYSMITDAEEKGFIVPGKSVLIEPTSGNTRHWGWAFMGCCQRVTRLVLTMPXASMSMERRIILKAFGAELILTDPLXGMKGAVQKAEELAAKTPNSYILQQFENPANPKIHYETTGPEIWKGTGGKIDGLVSGIGTGGTITGTGKYLKEQNSNIKLYGVEPTESAVLNGGKPGPHKIQGIGAXGFIPGVLDVDIIDETIQVSSDESIEMAKSLALKEGLLVGISSGAAAAAAIKVAQRPENAGKLFVVVFPSFGERYLSSVLFHSIKKEAESMVVE

SEQ ID NO: 4432 - protein, 123 aa, Glycine max
  misc_feature (23)..(23): Xaa can be any naturally occurring amino acid
  misc_feature (85)..(85): Xaa can be any naturally occurring amino acid
MGRRPARCFSLIKNTPYPRPRLXRGVPDPKITIYEVGMNKNAVDELPFCDHLDSWETEIVVREALEADHIARYEYMGKFDGEAAXYLKVTAHTFYDLRINTMLWGAGADGLPTGITGSFGKPA

SEQ ID NO: 4433 - protein, 181 aa, Unknown
  Acidovorax sp. JS42
MSDLQSITLGGGCFWCTEAVFDRVRGVTDVQSGYANGDVAEPTYEQVCSGTTGHAEVVRVTFDPAQIGVREILEIFFATHDPTTLNRQGNDVGTQYRSAIYFTDPAHQDVAEELLRQMGQDKLFGAPVVTEVAPLVNYWPAEDYHQDYYRNHPNQGYCAFVVGPKVEKFRKTFARHLKPGA

SEQ ID NO: 4434 - protein, 216 aa, Pseudomonas syringae
MARSKTSHNWLKEHFDDKYVKMAQKDGYRSRASYKLLEIQEKDKIIRPGMTVIDLGAAPGGWSQVTSRLIGGQGRLIASDILEMDSIPDVTFIQGDFTEDAILEQILEAVGNTQVDLVISDMAPNMSGLSAVDMPRAMFLCELALDLAGRVLRPGGDFLIKVFQGEGFDIYHKDIRKLFDKVQMRKPSSSRDRSREQYLLARGFRGIDGAASIERF

SEQ ID NO: 4435 - protein, 432 aa, Comamonas testosteroni
MALTKDNEDLVRVGRGTPMGGLMREYWIPALKSTELEAGGSPVRLLLLGEKLVAFREPSGAVGVMDSRCPHRGVSLFMGRVEEGGLRCVYHGWKFSAEGKCVDMPSVRPEDEFKNSVRVARYPVKEMAGVVWVYMGTRKVLPELPRLEVLNLPENEVDVICLQRKSNWLQNLEGEIDTSHFNFLHVGGLHADEVPDDHPLKYTAQVAPQYLVKETALGTCYAAQVPAEEDHTYTRFAHFLFPFWALIPQADIAQNILARAWVPMDDEHTMMFFFRWTGSKAKRLDTPLKSGSPMPGVTLTDMKYKENTTDWYGRWQPLGDESNDWLIDRDLQKVGRVFSGIYGIHAQDQAMTDSMGPIIDHGLEQLAPTDLMIVRTRRRILKALRAHEANGTLPPGVDEADQYFTPRSGYYLTPKSVDWETAYEQRIEGLVR

SEQ ID NO: 4436 - protein, 621 aa, Zea mays
MGAALLASWPWDNLGFYKYVLYGPLVGKAVASRAWEAASPDRWILLLLLLFGLRALTYQLWSSFSNMLFATRRRRVVRDGVDFDQIDKEWDWDNFLILHALMAAAALCAFPSLRHLPAWDGRGFAVALDAHAAATEPLSYLAHRALHGSSGRLYARYHSLHHSSRVPQPFTAGLATALEHVALGALMSLPLAAARAAGCASVALAFAYVLAFDSLRAMGHCNVEVVPASLFRAIPALRYVLYTPTYHAIHHTKKEANFCLFMPLFDLLGGTIDRRSWDMQRKMSAGVDEVPDFVFLAHVVDVMQSLHVPFVMRTFASTPFSVQLFLLPMWPFAFLVMLAMWVWSKTFVISCYNLRGRLHQIWAVPRYGFQYFLPFAKDGINRQIELAILRADKMGVKVLSLAALNKNEALNGGGTLFVNKHPDLRVRVVHGNTLTAAVILNEIPKGTAEVFLTGATSKLGRAIALYLCKKRVRVMMMTLSTERFQKIQKEAPAEFQQYLVQVTKYRSAQHCRTWIVGKWLSPREQRWAPPGTHFHQFVVPPIIGFRRDCTYGKLAAMRLPKDVRGLGACEYSLERGVVHACHAGGVVHFLEGYTHHEVGAIDVDRIDVVWEAALKHGLRPA

SEQ ID NO: 4437 - protein, 332 aa, Pseudomonas syringae
MIKNQLARFNRLDLISAPTALEKLERLSLWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADDQLHALAARLRSSGKKPYLVPIGGSSPVGALGYVRAGLELAEQIKQTGIDFAAVVLASGSAGTHSGLALALAHELPQLPVVGVTVSRSEEAQLPKVQGLAERTAQLLDIALPEHFKVELWDEYFAPRYGEPNAGTLAAIKLVASQEGLLLDPVYTGKAMSGLLDGIGRQRFNDGPLIFLHTGGAPALFAYPDAFDQ

SEQ ID NO: 4438 - protein, 380 aa, Pseudomonas syringae
MAKRDYYEVLGVERGSSEADLKKAYRRLAMKHHPDRNPDDKASEEMFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTTVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGAQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 4439 - protein, 288 aa, Musa acuminata
APAFMALLVSVLAAVPTRVQSMGVCYGMMGNNLPPPSEVIQLYKSNRIGRLRLYDPNHGALNSLRGSNIEVILGLQNGWKKHIASGMEHARWWVQKEVKDFWPDVKIDYIQGGNEIPPVTGTSSLTSFQVPALVGEAGLGNDIKVSTSVDMTLIGNSYPPSQGSFRNDVRWFTDPIVGFQASNGAPLLVNVYPYFSYSGNPGQISLPYALFTAPNAVVQDGRQYRNLFDAMLDSVYAAMTAGGGQWVGIVVSESGWPSAGYHGTAYNLIQHAKEGSPRKPYLNIIKVA

SEQ ID NO: 4440 - protein, 474 aa, Streptococcus pneumoniae
MTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 4441 - protein, 312 aa, Unknown
  Pseudomonas sp. KNK003A
MTRIVNAAAAQMGPISRSETRKDTVRRLIALMREAKARGSDLVVFTELALTTFFPRWVIEDEAELDSFYEKEMPGPETQPLFDEAKRLEIGFYLGYAELAEEGGRKRRFNTSILVDRSGRIVGKYRKVHLPGHKEPQPGRKHQHLEKRYFEPGDLGFGVWRAFDGVMGMCICNDRRWPETYRVMGLQGVEMVMLGYNTPYDHTGHDDIDSLTQFHNHLSMQAGAYQNSTWVIGTAKCGTEEGSKMVGQSVIVAPSGEIVAMACTIEDEIITARCDLDMGKRYRETIFDFARHREPDAYRLIVERKGAVPPPQ

SEQ ID NO: 4442 - protein, 270 aa, Methanococcoides burtonii
MKRGYKVETIKIAAIQMDICHCNKQKNIKKALHFSEEAISKGADIIVLPEVFSTGFCYEELENIAESGSYPTIKELEVFSKKNKCIIVGSIIEKHSSKNRETYTNLGFCLEDGELVGTYTKTHPFGKEKEYFTSGDVIEPIHLKERDLTVGLQICYEMRFPEIARKLCLSGADILMTIAEFPNPREHQWRTLATARAIENQVFHIACNRSGSDPTSTFFGGSMIIDPLGNVIADAKDGECVIIEEIDTSIMKKTRKEIPVFDDRRPDIYK

SEQ ID NO: 4443 - protein, 256 aa, Solanum tuberosum
MDHHGNGQPPGIGVVTSSAPIYGAPYQANQMAGPPAVSAGAIQSPQAAGLSASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 4444 - protein, 430 aa, Mesembryanthemum crystallinum
MSDCLSMASLTTTAAAAAAAAATTSRLLPSSSLSRLSLSSSSSSSSSSSSLKCLRSSPLVSHLFLRDLPRGSSAYVSKSRFSTKCAASDPAQLKSAREDIKELLKTKFCHPIMVRLGWHDAGTYNKNIEEWPQRGGANGSLRFDVELKHGANAGLVNALNLLKPIKDKYSGVTYADLFQLASATAIEEAGGPKIPMKYGRVDVTEPEQCPEEGRLPDAGPPSPAQHLRDVFYRMGLNDKEIVALSGAHTLGRSRPDRSGWGKPETKYTKDGPGAPGGQSWTAQWLKFDNSYFKDIKERRDEDLLVLPTDAALFEDPSFKVYAEKYAADPEAFFKDYAEAHAKLSNLGAKFDPAEGFSLDGSPAGAAPEKFVAAKYSSGKKELSDSMRQKIRAEYEGFGGSPNNPLPTNYFLNIMIVVAVLAVLTYLTGNY

SEQ ID NO: 4445 - protein, 380 aa, Mesembryanthemum crystallinum
MSDCLSMASLTTTAAAAAAAAATTSRLLPSSSLSRLSLSSSSSSSSSSSSLKCLRSSPLVSHLFLRDLPRGSSAYVSKSRFSTKCAASDPAQLKSAREDIKELLKTKFCHPIMVRLGWHDAGTYNKNIEEWPQRGGANGSLRFDVELKHGANAGLVNALNLLKPIKDKYSGVTYADLFQLASATAIEEAGGPKIPMKYGRVDVTEPEQCPEEGRLPDAGPPSPAQHLRDVFYRMGLNDKEIVALSGAHTLGRSRPDRSGWGKPETKYTKDGPGAPGGQSWTAQWLKFDNSYFKDIKERRDEDLLVLPTDAALFEDPSFKVYAEKYAADPEAFFKDYAEAHAKLSNLGAKFDPAEGFSLDGSPAGAAPEKFVAAKYSSGKD

SEQ ID NO: 4446 - protein, 313 aa, Cotoneaster apiculatus
GGLGDVLGGLPPAMAANGHRVMTITPRYDQYKDAWDTEVTVELKVGDKTETVRFFHCYKRGVDRVFVDHPLFLEKVWGKTASKIYGPVAGVDFKDNQLRFSLLCQAALVAPRVLNLNSSKYFSGPYGEEVVFIANDWHTALLPCYLKAIYKPKGIYKTAKIAFCIYNIAYQGRFTFADFALLNLPNEFKSSFDFIDGYDKPVKGRKINWMKAGILESDEVLTVSPYYAEELVSSVEKGVELDNILRKTGIQGIVNGMDVQEWNPSTDKYTTVKYDASTVADAKPLLKEALQAEVGLPVDRDIPVIGFIGRLEE

SEQ ID NO: 4447 - protein, 482 aa, Neisseria meningitidis
MKGDIGVIGLAVMGQNLILNMNDCGFKVVAYNRTIGKVDEFLNGAAKGTGIIGAYSLQDLVDKLEKPRKIMMMVRAGSVVDDFIEQLLPLLEKGDIIIDGGNANYPDTTRRTHYLAEKGILFVGMGVSGGEEGARHGPSIMPGGDERAWEAVKPIFQAIAAKTPQGEPCCDWVGRDGAGHFVKMVHNGIEYGDMQLICEAYQFMKDGLGLSYDEMHRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 4448 - protein, 415 aa, Spinacia oleracea
MASFTTTTAAAASRLLPSSSSSISRLSLSSSSSSSSSLKCLRSSPLVSHLFLRQRGGSAYVTKTRFSTKCYASDPAQLKNAREDIKELLQSKFCHPIMVRLGWHDAGTYNKDIKEWPQRGGANGSLSFDVELRHGANAGLVNALKLLQPIKDKYSGVTYADLFQLASATAIEEAGGPTIPMKYGRVDATGPEQCPEEGRLPDAGPPSPAQHLRDVFYRMGLDDKDIVALSGAHTLGRSRPERSGWGKPETKYTKDGPGAPGGQSWTAEWLKFDNSYFKDIKEKRDADLLVLPTDAALFEDPSFKVYAEKYAADQEAFFKDYAEAHAKLSNQGAKFDPAEGITLNGTPAGAAPEKFVAAKYSSNKRSELSDSMKEKIRAEYEGFGGSPNKPLPTNYFLNIMIVIGVLAVLSYLAGN

SEQ ID NO: 4449 - protein, 313 aa, Cotoneaster apiculatus
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYNDNQFRFSLLCQAALEAPRVLNLNSNKYFSGPYGDEVVFIANDWHTALLPCYLKSIYKPKGIYENAKVVFCIHNIAYQGRFPISDFSVLNLPENLKGSFDFIDGYNKPVKGRKINGMKAGILESDRVVTVSPFYAQELVSGEDKGVELDNIIRKTGITGIVNGMDVQEWNPATDKYLDTKYDNTTVLDAKPLVKEALQAEVGLPVDRSIPVIGFIGRLEE

SEQ ID NO: 4450 - protein, 168 aa, Ralstonia eutropha
MTTQSETAILAGGCFWGMQDLLRRYPGVLATRVGYSGGDVPNATYRNHGTHAEAIEIVFDPQQISYRQILEFFFQIHDPTTRNRQGNDIGTSYRSAIFYRDDAQKQVAEDTIADVNASGLWPGKVVTKLAPAGPFWEAEPEHQDYLERYPNGYTCHFIRPGWKLPQRG

SEQ ID NO: 4451 - protein, 286 aa, Ehrlichia ruminantium
MVDLPKFTMRDLVECGVHFGHKTSRWNPKMAPYIYGVHNDIHIINLQSTVFLLKNALSALYDIVLKRGRVLFIGTKVQASAIIADEATRCGQYYINNRWLGGMLTNWETISLSIKKLREYEKLLQNVDNQFTKKELLLFEKKRAKLDRSIGGICNMGGLPHVIFVIDTNKERIAIREANKLNIPVIAVLDTNSDPTGIDYPIPGNDDAVRSIDFFCKIISDTILEAIRSDLAKSGINVDGIKDFSVERREDFLKMNKDNKSNKSNTINADENIKESDLIGGSNNEG

SEQ ID NO: 4452 - protein, 313 aa, Cotoneaster apiculatus
GGLGDVLGGLPPAMAANGHRVMTISPRYDQYKDAWDTEVTVELEVGDKTETVRFFHCYKRGVDRVFVDHPLFLEKVWGETASKVYGPVAGVDFKDNQLRFSLLCQAALEAPRVLNLNSSKYFSGPYGEEVVFIANDWHTALLPCYLKAVYKPRGLYSTAKVAFCIHNIAYQGRFASADFALLNLPDEFKSSFDFIDGYEKPVKGRKINWMKAGILESDKVLTVSPYYAQELVSAVEKGVELDDIIRKTGIFGIVNGMDVQEWNPLTDKYTTIKFDASTVADAKPLLKETLQAEVGLPVDRDTPVIGFIGRVEE

SEQ ID NO: 4453 - protein, 274 aa, Solanum tuberosum
MSNFSLSPSPTSGFSLNLQNPTKTSYLSFSSSINTIFAPLSSNTTKSFSGLTHKAALPRNLSLTCRHSDYFEPQQQQQQQQQQPQGASTPKVFVGYSIYKGKAALTVEPRSPEFSPLDSGAFKLSREGMVMLQFAPAAGVRQYDWSRKQVFSLSVTEIGSIISLGAKDSCEFFHDPNKGRSDEGRVRKVLKVEPLPDGSGHFFNLSVQNKLINLDENIYIPVTKAEFAVLVSAFNFVMPYLLGWHTAVNSFKPEDASRSNNANPRSGAELEWNR

SEQ ID NO: 4454 - protein, 313 aa, Crataegus rivularis
GGLGDVLGGLPPAMAANGHRVMTVSPRYDQYKDAWDTSVLVEIEVGGRVETVRIFHCYKRGVDRVFVDHPLFLEKVWGKTGSKIYGPRTGEDYMDNQFRFSLLCQAALEAPRVLNLNSNEYFSGPYGDDVVFIANDWHTALLPCYLKTIYKPKGIYKNAKVVFCIHNIAYQGRFPFSDFSLLDLPDNLKGSFDFIDGHDKPVKGRKINWMKAGIIESDRVVTVSPYYAQELVSGEDKGVELDNIIRKTGITGILNGMDVQEWNPATDEYLDIKYDNTTVLDAKPLLKEALQAEVGLPVDRNIPVFGFIGRLEE

SEQ ID NO: 4455 - protein, 134 aa, Brassica napus
MGKNDFLTPKAIANRMKAKGLQKLRWYCQMCQKQCRDENGFKCHCMSESHQRQMQVFGQNQRRVLQGYSEEFEKTFLDLMRRSHRFSRIAATVVYNEYINDRHHVHMNSTEWATLTEFIKYLGKTGKKERMNRK

SEQ ID NO: 4456 - protein, 174 aa, Plantago major
MASAMMSSAATVTAQTSMVGQFSGLKFGSTFPIAKKTGRVSSPSSGLKVRCMQVWPPTGKKKYETLSYLPDLTVEQLAKEIDYLLRSKWIPCLEFELEHGFVYRENARSPGYYDGRYWTMWKLPMFGCTDASQVIAELEECKKEYPNAWVRIIGFDNVRQVQCISFIASKPPGL

SEQ ID NO: 4457 - protein, 313 aa, Crataegus rivularis
GGLGDVLGGLPPAMAANGHRVMTISPRYDQYKDAWDTRVTVELKVGDKTETVRFFHCYKRGVDRVFVDHPLFLEKVWGKTASKIYGPTAGVDFKDNQLRFSLLCQAALVAPRVLNLNSSEYFSGPYGEEVVFAANDWHTALLPCYLKAIYKPKGIYKTAKVAFCIHNIAYQGRFAFADFALLNLPNEFKSSFDFIDGYDKPAKGRKINWMKAGILESDKVLTVSPYYAKELVSSVEKGVELDNIIRKTGIQGIVNGMDVQEWNPLTDKYTTVKYDASTVVDAKPLLKEALQAEVGLPVDRDIPVIGFIGRLEE

SEQ ID NO: 4458 - protein, 319 aa, Thiomicrospira crunogena
MSTKHCKLLILGSGPAGYTAAVYAARANLEPVMVTGMQQGGQLTTTTEVDNWPGDVEGLTGPDLMVRMQKHAERFGTEILFDHIHTAELNQRPFKLIGDSAEYTCDALIIATGASAKYLGLESEEAFKGKGVSACATCDGFFYRNQKVAVVGGGNTAVEEALYLSNIASEVTVIHRRDSFSSEKILSKQLLEKAENGNINIEFNSALEEVLGDKMGVNGLRIKNNQTNESKEIDVAGVFIAIGHTPNTGIFDGQLDMDHGYLKVQSGLQGNATQTSIPGIFAAGDVMDQVYKQAITSAGAGCMAALDAEKFLDQLEAQG

SEQ ID NO: 4459 - protein, 379 aa, Vibrio fischeri
MSKRDFYEVLGVSRDASERDIKKAYKRLAMKFHPDRNQGDDTAAEKFKEVKVAYEILTDAQKRSAYDQYGHAAFEQGGMGGGGFGGGGADFGDIFGDVFGDIFGGGRRGGQQRAQRGSDLRYNMELTLEEAGRGCDKEIEVPTLVSCDPCEGTGAKKGTSSTTCSTCHGQGQVQMRQGFFAVQQACPTCHGKGKIIKDPCNSCHGEGRVHKTKTLNVKIPSGVDTGDRIRLSGEGEAGEHGAPAGDLYVQVHVKEHNIFERDGNNLYCEVPVSFTMAALGGEVEVPTLDGRVSLKVPLETQTGRMFRMRGKGVKGVRTHSAGDLIVKLIVETPVKLTKRQKELLQEFQESFDGKDAKKHNPKSEGFLSGVKNFFDDLTK

SEQ ID NO: 4460 - protein, 138 aa, Oryza sativa
MWRSAVEAAGGQSGDGGARARARAVTAACRPFGMGTVRGSLFHFLKGTYNSPNGERLVGGAQAVLMNAAGGRQLRGVFMHQKEDLWNSIIAGAATSGFLSMRQGLNTAGRSALMGGMLLALIEGAGLMLNRVLASPRR

SEQ ID NO: 4461 - protein, 157 aa, Clostridium perfringens
MKKIVLAGGCFWGVEEFLSRINGVVSTEVGYANGRTENPTYEDICTKNTYFAEVCLVNYDENIISLKELLAKFWTIIDPTSLNKQGNDVGSQYRTGIYYVEPSDLEEILNSKEELQKSYSKKIVTEVKPLENYYKAEEYHQKYLKKNPNGYCHIKLD

SEQ ID NO: 4462 - protein, 229 aa, Plantago major
VGKPKPVSSSSPWYGPDRVKYLGPFSGESPSYLTGEFPGDYGWDTAGLSADPETFAKNRELEVIHSRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKELKNGRLAMFSMFGFFVQAIVTGKGPLENLADHLADPVNNNAWAFCHKLRSRK

SEQ ID NO: 4463 - protein, 419 aa, Mannheimia succiniciproducens
MTDLIQMGKQAKQAAFALSQLSQQEKNHALALIAERLEAQQERILAENAKDIQAARENGLSESIIDRLLLTKERLTGIADDVRHVISLADPVGKIIDGGVLDSGLKLERIRTPLGVIGTIYEARPNVTIDVASLCLKTGNAVILRGGKETQHSNKILVEVIQNALQQAGLPEMAVQAITDPDRALVMELLHLDKYVDMIIPRGGAGLQALCRDNSSIPVIVGGIGVCHIFVEQSADQDRSLAVIENAKTQRPSTCNTVETLLVQESIAEEFLPKLARRLKTKEVKFHADSTALSILQGVSADVKPVTEQQLRNEWLTYDLNVVIVKGIEEAVEHIREYGSEHSESILTESQKLANQFVAQVDAAAVYVNASTRFTDGGQFGLGAEVAVSTQKLHARGPMGLEALTTYKWVCVGDYTSRA

SEQ ID NO: 4464 - protein, 319 aa, Oceanobacillus iheyensis
MKRIGVLTSGGDSPGMNAAIRAVVRKAIYHDLEVYGIKNGYQGLMDGNIEKMTLGSVGDIIHRGGTILFSARSEEFKTDEGQFRAIEQLNKHNIDGLVVIGGDGSFQGAKKLTEKGFPCIGVPGTIDNDIAGTDYTIGFDTSLNTIIDAVDKVRDTATSHERTYIIEVMGRDAGDLALWAGLAVGAESILIPEEKEDFSSIVQRLKNGHDRGKKHSIILLAEGVGSGFEFGKRIEEVAELETRVTVLGHIQRGGSPTGQDRVLASRLGARAIELLIDNQGGRMVGIQKNVLVDYTFDEVFNVEHTIDKGMYKLSKELSI

SEQ ID NO: 4465 - protein, 356 aa, Polyangium cellulosum
MAELDHWHPVLLSHELRRKPRSVRLAGREIVVFRTSSGGLGAFTDRCPHRSMRLSEGWVEGDRLVCAYHGWRWAADGRGDIPATPAARPCARRDDVFDAVERYGAIWVKRAGAQATFPRFDAEGYVPAGVLRHRAAVPFELALDNFIEVEHTPFVHFMLGYSLDQMPQVEAQVTLSDDAVQVVNTGPKRPIPRIVEKMFRIPHDAKFVVEWTARFSPVHAIYDHSFINPRTREVVTYPLRSAVFFNPVGPESSEIYTFLFASLGRWSEFGLGSLIWPPLRVAMDLELRLDMRLLSRLADKRGILKGNVLGRFDKALVASRDRIDRIYRGQAAEATPEAGDGHEATRAARRLPLAAS

SEQ ID NO: 4466 - protein, 375 aa, Polyangium cellulosum
MIEESHVIIIGAGPSGLAVGACLRERGIPFVLLEQSDAVGASWRRHYQRLHLHTVKQFSSLPGLAWPRYAPPYPSRAQMVDYLQRYAERFRLEPRFGAEVVRAYRDGSRWVTQTRAGEFTSRALVVATGYSRLPNVPTWPGQERFRGPILHSSTYGSGAAFRGQRVLVVGSGNSGGEIAMDLWEHAAETTVSARSGIHVIPRDPLRLPAQFSALALYGALPPAVGDRLATAFLSRTVGDLSRWGIHRPEIGPGTRAVKEGRIPLIDMGTLALIQQGKIAVVPGPRAFTETGVIFTDGRELPFDAVVLATGYRAGLGDFLEDAARFTDERGYPRWHGAPTPTPGLFFIGFRNPITGQLRDIAAEAPRVARHLRGVN

SEQ ID NO: 4467 - protein, 447 aa, Lactobacillus johnsonii
MSKVVHFDASKLTPFVHENELKEMQAMVTAADQELREGTGAGSDFRGWIDLPINYDKDEFDRIKKAAKKIQNDSEVLVGIGIGGSYLGAQASIEFLNSSFYGREKEKYPTVVFCGNSLSGSYLYDLLEWLGDKDFSINIISKSGTTTEPSIAFRVLKDKLIKKYGKEEAAKRIYATTDRAKGALKTEADAEGYEEFVVPDDIGGRFSVLSAVGLLPIAVAGGDIDAMMKGAADARAAYTDPDVLKDSPYQYAAMRNILYRKGYTTELLENYEPSLRMFGEWWKQLMGESEGKDQKGIYPSSANFTTDLHSLGQYIQEGRRNLMETVIRVEHPTHDVTIPDDKENLDQLNFLSGKTMNYVNDRAYEGVVLAHTDGGVPVMTVDIENQTAHTLGYLIYWFELAVGISGYLNGINPFNQPGVESYKRNMFGLLNKPGYEDLHDDLTKRLK

SEQ ID NO: 4468 - protein, 406 aa, Oryza sativa
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 4469 - protein, 220 aa, Solanum tuberosum
MGRRPARCYRQIKNKPYPKSRFCRGVPDPKIRIYDVGMKRKGVDEFPFCVHLVSWEKENVSSEALEAARIACNKYMTKSAGKDAFHLRVRVHPFHVLRINKMLSCAGADRLQTGMRGAFGKPQGVCARVAIGQVLLSVRCKDGNANHAQEALRRAKFKFPGRQKIIVSRKWGFTKFSRTDYLKYKSENRIVPDGVNAKLLGCHGRLAARQPGRAFLEAAN

SEQ ID NO: 4470 - protein, 450 aa, Robiginitalea biformata
MAVSPVITGGSAERKKPAQSLTKTAEMQRDQEIFDLIQAEKQRQINGLELIASENFASSQVMEAAGSVLTNKYAEGYPGKRYYGGCEVVDQVEQLAIDRAKELFGAVYANVQPHSGSQANAAVYQACLKPGDTILGFDLSHGGHLTHGSPVNFSGKLYRPVFYGVDRETGRLDYDKILEVAEKEKPRMIIAGASAYSRDMDFAKFREIADQVGAFLLADIAHPAGLIAKGLLSDPIPHCHFVTTTTHKTLRGPRGGMILMGEDFENPFDIRFKSGKLRSMSSLIDLAVFPGNQGGPLEHIIAAKAVAYGEALSDGFLHYAIQVQKNADAMAKAFVSRDYHLISGGTDNHMMLIDLRNKGITGKDAENLLVTADITANKNMVPFDDQSPFVTSGIRFGTAAITTRGLVESDMEAVVSFIDRVLSDPESTETAQAVKKEVNEMMGSRPLFAG

SEQ ID NO: 4471 - protein, 336 aa, Bacteroides fragilis
MKIGILTSGGDCPGINATIRGVCKTAINHYGMEVVGIHSGFQGLLTKEVESFTEKSLSGLLNLGGTMLGTSREKPFRKQGIISDVDKPALIQRNIAELGLDCVVCIGGNGTQKTAAKFAAMGINIVSVPKTIDNDIWGTDISFGFDSAVSIATDAIDRLHSTASSHKRVMVIEVMGHKAGWIALYSGMAGGGDVILVPEIPYNIKNIGDTILNRLKKGKPYSIVVVAEGIQTDGRKRAAEYIAQEIEYETGIETRETVLGYIQRGGSPTPFDRNLSTRMGGHATELIANGQFGRMIALKGDEISSVALEEVAGKLKLVTEEHDLVVQGRRMGICFG

SEQ ID NO: 4472 - protein, 555 aa, Bacillus subtilis
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWLRGDLFNRQPYRDFYIWKKPQENGSVPTNWESKFGGSAWELDEASGQYYLHLFDVTQADLNWENEEVRKHVYDMMHFWFEKEIDGFRLDVINLISKDQRFPNAEEGDGRSFYTDGPRVHEFLHEMNEKVFSHYDSMTVGEMSSTTVDHCIRYTNPDNKELDMTFSFHHLKVDYLTAEKWALAPFDFLKLKEILSDWQTGMHAGGGWNALFWCNHDQPRVVSRYGDDGAYRVKSAKMLATAIHMMQGTPYIYQGEELGMTNPKFTDISSYRDAESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTVAHMSPLFIV

SEQ ID NO: 4473 - protein, 178 aa, Glycine max
  misc_feature (91)..(91): Xaa can be any naturally occurring amino acid
  misc_feature (100)..(100): Xaa can be any naturally occurring amino acid
  misc_feature (122)..(122): Xaa can be any naturally occurring amino acid
  misc_feature (149)..(149): Xaa can be any naturally occurring amino acid
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 4474 - protein, 466 aa, Salmonella enterica
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 4475 - protein, 248 aa, Anthurium andraeanum
MTAKAKRGAAVAAEARVAKKRVVKLNKGPWTAEEDQKLVEYVDAHGDRKWTSLPTKAGLNRCGKSCRLRWLNYLRPGIKRGNISEAEEDMIIRLHNLIGNRWSLIAGRLPGRTDNEIKNYWNTHLSKKPLTISDLNDKLNDDGGSRSDVDEPPSSGQSQGPLDSRRPAEPRISEASNEVAFNVDELVNLPAILDFDDLLDSGSCSDGIITSSQIFWTPNFSAHDQQDISDFDDLGMLMDIMDYVICPP

SEQ ID NO: 4476 - protein, 346 aa, Bordetella bronchiseptica
MQALGARRPARPFRVPIIAGVEHTAGGWFVNPPKHAKVLILGSGPAGYTAAIYAARANLAPLVVTGLAQGGQLMTTTDVDNWPADPDGVQGPDLMQRFLRHAQRFDAGVVSDAIHTVRLDRRPFALTGDQGAYTCDALVIATGASAKYLGLPSERAFMGKGVSGCATCDGFFYRNRDVLVVGGGNTAVEEALYLSNICRTVTVVHRRDRFRAEPILVDRLQARAALGKVKFEYFHELDEVLGDASGVTGARLRDNRDGTARDVAAKGVFIAIGHAPDTGLFEGQLALRNGYIVTRGGLSGLATMTSIPGVFAAGDVQDQIYRQAVTSAGTGCMAALDAQRWLEGAA

SEQ ID NO: 4477 - protein, 490 aa, Oryza sativa
MALKSPVDFAGSITSGQKDPCCFGVPGCNPRCVRYNKKSRTCRLVTRAISVDRPQLDFSNSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 4478 - protein, 70 aa, Oryza sativa
  misc_feature (62)..(62): Xaa can be any naturally occurring amino acid
LCPGGGYTIEVEIHDGPYNVIKNWNYTGVVEAFQNGEGKCYTAKVRTEEELKEAIEEAQGPXKKDCLVLA

SEQ ID NO: 4479 - protein, 697 aa, Oryza sativa
MQFLGNRAIYAVLRKTLEQIIGRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 4480 - protein, 201 aa, Zea mays
  misc_feature (47)..(47): Xaa can be any naturally occurring amino acid
  misc_feature (56)..(56): Xaa can be any naturally occurring amino acid
  misc_feature (73)..(73): Xaa can be any naturally occurring amino acid
  misc_feature (137)..(137): Xaa can be any naturally occurring amino acid
  misc_feature (141)..(141): Xaa can be any naturally occurring amino acid
  misc_feature (178)..(178): Xaa can be any naturally occurring amino acid
RRIPSFVHPTPPALCCRSPCSRRPARCYRQIKNKPYPKSRYCRGVPXPKIRIYDVXACKRKGGDEFPYCVHLXSCQNENVSSEALDAARIACNKNMTKSAGKDAFHLRVRSHPFHDLPIHKMLSSAATDTVQTGMMXAFGXPQDTCATVDIAQVLLSDLCKDNNAAHASEALRRAKFXFPGRQDIIDSREWGLTKLQRADY

SEQ ID NO: 4481 - protein, 72 aa, Unknown
  Populus x canadensis
MSLLNDLININLSDTTEKIIAEYIWIGGSGMDLRSKARTLPGPVTDPAKLPKWNYDGSSTGQAPGEDSEVIL

SEQ ID NO: 4482 - protein, 376 aa, Unknown
  marine gamma proteobacterium HTCC2080
MSKRDYYEVLGVDRSTADPDIKKAYRRIAMKFHPDRNPDDKDADAKFKEATEAYDVLMNADKRAAYDQFGHAGLEQGAGGGGFQGGSNFSDIFGDVFGDIFGGGGGGGRQGPQRGSDLRYTMEVSLEEAVRGATREIKVPTLQHCNTCDGSGAKPGTKPVTCGSCGGAGQVRMQQGFFQVQQTCPKCRGQGKTISDPCRDCRGQGLLEKTKTLSVKVPPGVDTGDRIRLSGEGEAGPSGGPSGDLFVQIAVRQHNLFERDGRNLYCEVPINFVDAALGGELEVPTLDGKVKLKIPSETQTGKMFRLRGKGVLPVRGGPIGDLMCRAVVETPINLSAQQKQLLQEFRSTLDEGGNRQSPRQSSWFEGVRSFFDGMTK

SEQ ID NO: 4483 - protein, 493 aa, Psychrobacter arcticus
MQAKELLELERREIKALHYTWIAFFLTFYVWFNMAPLATSMLQTESYLTPDHIKLFLIANVALTIPGRVVVGMALDRFGPRRVFSILMVVMAIPTWFFAFGTSAMQLFVARLFMSIVGAGFVVGIHMTALWFKPKDIGFAEGFYAGWGNFGSAAAAITIPTVALQFFGGDDGWRWAIALSGLIMAAYGVVYWFLITDGPTADTHKKARSAGALEVSTWKDLLLYCLFIVPLYGVLSLLVYRTQGMGFLSATGAWVCYGVIGLMVLYQIYKAISVNVPIIKAGIPEDDKYPFTSVAALNVTYFANFGAELAVVSMLPMFFAATWTLDPTVAGLVASTFAFVNLWARPLGGYISDRVGNRRLVMLVYMFGIGIGFGLMGLLNAEWPLFIAVVFTILCSVFVQGAEGATFGVIPSIKRRLTGQISGLAGAYGNVGAVFYLFVFTLVEPNQFFFIIAIGAFIAWVLCFFWLKEPEDAFGDDYKMSSVDIQIAKEHNG

SEQ ID NO: 4484 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETGKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 4485 - protein, 313 aa, Cydonia oblonga
GGLGDVLGGLPPAMAANGHRVMTVSPRYDQYKDAWDTSVLVEIEVGGRVETVRFFHCYKRGVDRVFVDHPLFLEKVWGKTESKIYGPRTGVDYMDSQFRFSLLCQAALEAPRVLSLNSNKYFSGPYGDDVVFIANDWHTALLPCYLKTIYKPKGIYKNAKVVFCIHNIAYQGRFPFSDFSLLDLPDNLKGSFDFIDGHDKPVKGRKINWMKAGILESDRVVTVSPYYAQELVSGEDKGVELDNTIRKTGITGIVNGMDVQEWNPAADKYLDIKYDNTTVQDAKPLLKEALQAEVGLPVDRNIPVFGFIGRLEE

SEQ ID NO: 4486 - protein, 654 aa, Debaryomyces hansenii
MDGNFRRMSGEKEPHRPQPTALGRFELIIKFVFRCAILPWLLWELGFRSYYKTVLGVFDMIFKVLLLLIAPENGGLFNGISGDNGRYGVNSAGGVDIDGLFDDVLREGKVNVEKKSDTFILRINSRYRWVIDGIESQQIWQSTRENVEELYFIFEKADYVFDRYVKHSPFCVLNKLNPNGKKSHYEYDGIPLSKFEGFGSYLLYKRLGTKTLTTTKPHLHPILSSTMTAIQKPVVAKREAPKAEVNPTVSRLTQTETIKPTKERTVSVFSPPVFNFAANSFAQSVSNEYKHASPKRIKLDNSRVQVPSIVKPKQDKPRPPAIVTKPRVINIEFPNKQKSGFKLLIRPKHEPSIKKQKQGIEVLSTSNTKRITKSISVDDVEYVEKVKHAIKQVLPKPDYDDGSLGPVILRLAWHCCATYNKFTGNGGSNGSTMRFVPEITDDGNSGLDIARSALEPIKQKFPDITYSDLWTLAGKISIQEMGGPKIPWRCGRVDCIDDRYVPPNGRLPFAYKNANHIRETFGRMGFNDRETVLLLGAHGLGRCHKRFSGWEGKWTENPTSFSNDFYKVLLDEEWSLGTVPETGKEQYYNKDKSLIMLNTDIELIRDPHFLHFVKLYSQHQATFFQDFANAFGKLLELGIERDSNGNVLPKNEFY

SEQ ID NO: 4487 - protein, 60 aa, Unknown
  Populus x canadensis
FINDIFEKLAQESSRLARYNKKPTITSREIQTAVRLVLPGELAKHAVSEGTKAVTKFTGS

SEQ ID NO: 4488 - protein, 286 aa, Unknown
  marine gamma proteobacterium HTCC2080
MNSVAHVVNIDESNAQEQLIEESHNRPVVVDFWADWCEPCKQLMPILEKLAAEYAGAFLLAKVNADEQQTLASQLGVRSLPTVMVIKDGQPIDGFAGAQPESAVREMLEKHLPSPWNAKIAEATELLDAGDTAAALALLRGAWEDSNKLKELTHAYAGALVEANRLDEATAVLGEVRLVDQDALHEQLMAQIELKRVAGKSPEIEALEAKLATDSSDHGVRVQLAVQLSAADHHKEALEHLLTVLRSDRDWNNGEAKRLYLDTLTTIGKGDPLAAEYQRKLFSILY

SEQ ID NO: 4489 - protein, 313 aa, Cydonia oblonga
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYDKPVKGRKINWMKAGILESDKVLTVSPYYAEELVSSVEKGVELDNILRKTGIQGIVNGMDVQEWNPLTDKYTTVKYDASTVADAKPLLKEALQAEVGLPVDRDIPVIGFIGRLEE

SEQ ID NO: 4490 - protein, 258 aa, Vigna radiata
MAAATSGAVLNGLGSSFLSGGSRSQTLLATSIGGKVGVAVSPRRLIVVAAAAPKKSWIPGVRGGGNLVDPEWLDGSLPGDFGFDPLGLGKDPAFLKWYREAELIHGRWAMAAVLGIFVGQAWSGVPWFEAGADPNAIAPFSFGSLLGTQLILMGWVESKRWVDFFNPDSQSVEWATPWSKTAENFANATGEQGYPGGKFFDPLGFAGTLKDGVYIPDTEKLERLKLAEIKHARIAMLAMLIFYFEAGQGKTPLGALGL

SEQ ID NO: 4491 - protein, 313 aa, Dichotomanthes tristaniicarpa
GGLGDVLGGLPPAMAANGHRVMTISPRYDQYKDAWDTEVKVELKVGDKTEAVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYRPKGIYKTAKVAFCIHNIAYQGRFAFADFALLNLPNIFKSSFDFIDGYDKPVKGRKINWMKAGILESDKVLTVSPYYAEELVSSVEKGVELDNILRKTGIQGIVNGMDVQEWNPLTDKYTTVKYDASTVADAKPLLKEALQAEVGLPVDRGIPVIGFIGRLEE

SEQ ID NO: 4492 - protein, 313 aa, Dichotomanthes tristaniicarpa
GGLGDVLGGLPPAMAANGHRVMTLSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDDVLFIANDWHTALLPCYLKAIYKPKGIYENAKVVFCIHNIAYQGRFPISDFSVLDLPENLKGSFDFIDGYNKPVKGRKINWMKAGILESDRVVTVSPYYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 4493 - protein, 2455 aa, Ehrlichia ruminantium
MYNFIKNHFIKLLLLLLMTACESNQHPVPRCVPADVFTEGRTTSVSAYFDPTSENFMSDNKALGNSVEDNQVVRWKYTGYVTNGHPIVLRAEGMWTSWAKKSNNVTEVQKNTTDYGDDDVDRYNAILAVDRVCGPYKKIEKTFSNGTNQCKVSCEMISGVQDNLETGTYGPPCWFRNGYGAYLLFKRPEDPEPNETITNMRYPTSPVMHIGYKPLELAGTHGISTSSKKIKDSSCKDVELKPGWKIYIKILDRNYYDNVGGYTVTFIDGIKAEQEFSAFEWVRKEVRGRLDKAGEDLFKNIVKNPVFKNFVFSLLTLFLIFGSLAYILGIVRTPFADIIVRLLKISLMLLLISPNSWDFFYNHLLRLFIHGTDQIIAMINSYTGDYNPQAPFSFMDIMIRDKIFSPVIWKIKIRALIVANFSSIFAVLVIVIAVLIYIALCIYGFVIYLTAFVGITFLVGLMPLLLLGILFSQFKSLFDGWLTQCISFSLQAILIFTLISLFGTLIMNYYYRIFGFTVCYNEWMKVKICLFGRVGCLVDKSLFGWTPGQMYDPKVIGITSDFNVSDKKASSDDPDDIKMSGNARYKFTGGGGYISVPPDHKYKDFRYIDYPFLDPDTESDSNPHGVNVAKDSPFKELSHLVNALLTTDKKYIVARLVADIKTELEKLVKNKTITSDSQNKVLKIIDDRIKKDKDAGKSELDKYGDQSFKSQIIRSVIDNVIDGAAITPTSQEKLNEQYDYALIQGIRAGDLILWSEVGSLFLAALLIWQMRAFVQSVAVSLAGGSMMSQTIASMYEEGFLKTFSSIPVVGKVFKTIDGGLDSYKLLVGNYITETARRPLNMLQKVPVLGHAVKFTGKVAGGLTSSYGEYDRRHSSNFKQLNYARAFIGAHLGFSPLSAMKYLGGYAAGKMLGSRSGGLIHNMVQDRKAALDSLKAHILGPEQHKPSPYIPKQKEDDSNPFVKNDAKNLVGDSSSPGSKNYEGNVRGEPHSIARTDTGNVRGDSYDTNYAGNVIGDAAVAKGYAGGVVGSSGPITRLELQNQHSLLDDAGNVRVGKDNLADALEAREQLKTMRENTKDETALININYDIDRLDSALHKHLGHDFEQVTQDYANSHMAVQHSSDLSATDYSRLNIDDISRLDGTAQISSASVPDTGQDILHSNAAAQSSMLDVGRDEISDFISASALKEETIPHEVIELNVLGTSSGQSLSSETGVHVQDEVQVDRSEAVTSPSDTTQPSALDVELSGDRVSEISSTGVSQGETSPEQQLSSEVGVYVQDGVQVERSEAVTSPSDTTQPSALDVELPGDGLSNISSTGVSQGETSPQSEEIELNVLGATPEQQLSSETGVHVQDEVQVDRSEAVTSPSDTTQSSALDVELPGDGLSNISSTGVSQGETSPQSEEIELNVLGATSEQQLSDEVGVYVQDGVQVERSEAVTSPSDTTQPSTLDVELSGDGLSDISSTGVSQGETSPQSEEIELNVLGATSEQQLSSETGVHVQDEVQVDRSEAVTSPSDTTQPSALDVELSGDGLSDISSTGVSQGETSSQSEDLEAIFDQTLISENESYASTSDHDRESVASDENVLLGHENFDSLLDTDPLSHDTQESTDFIDEKSSNEFEESKELVDHKDTIESIPDVDHTSDAFGKELDVPQTSDQELIDMNAEGNSSVNVLSDQYQDTASELSSSESSDGTESRGSESDDQVLEPELQANTYYATDNEVLDVASLELGLPGVAVGNVEPVQEGSETKPEAVEVEGNESEGVVNVTEEHSDSAASSESIDKESSEDSQLDQTSMEEQDKVGEFERDSNAEDTSVDKEVSEKPDIVEPAPEDSGTKPEAVEVEGNESEGVVNVTEEHSDSAASSESIDKESSEDSQLDQTSMEEQDKVEEFERDSNAEDTSVDKEVSEKPDIVEPAPEDSGTKPEAVEVEGNESEGVVNVTEEHSDSAASSESIDKESSEDSQLDQTSMEEQDKVGESERDSNAEDASIDGKEVSGKPDIVEPAQEGSETKPEAVEVESNESEGVVSVTEEHSDSAASSGNIDKESSEDSQLDQTSMEEQDKVGESERDSNAEDASVDKEVSGKPDIVEPAQEGSETKPEAVEVESNESEGVVDVTEEHSDSAASSESIDKESSEDSQLDQTSMEEQDKVGESERDSNAEDTSVDKEVSEKPDIVEPAQEGSTEEESTSVLDEDSKRDVEESEEEGHDTSSDEGTEVDEVDSDGDSADVEKGSNDTLENDLEAEESKVELTEELAVKDMPEESVTEGHGMKKASVVTDDMSEGLAAVHQVDSGKEFKLQEKMGLEGAQSIHIPKSLKSEEKDAVSKKSSTAKKTESTDSKDNAKEKKGTSTSNKTKKTSLPKIMSGVKILVNQYAKQISTGLSESFDKFFEDTESKKRGKRKLSKEDIESMVRDLEQLLVSLKDKKSKLTDPSEIANIEDDIRKLESTIKSILDNQ

SEQ ID NO: 4494 - protein, 546 aa, Staphylococcus aureus
MKQRIGAYLIDAFHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTATKDTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNSATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 4495 - protein, 313 aa, Dichotomanthes tristaniicarpa
GGLGDVLGGLPPALAANGHRVMTVSPRYDQYNDAWDTNVLVEIEIGGRVETVRFFHSYKRGVDRVFVDHPLFLEKVWGKTGSKIYGPRTGVDYMDNQFRFSLLCQAALEAPRVLNLNSNKYFSGPYGDDVVFIANDWHTALLPCYLKTIYKPKGIYKNAKVVFCIHNIAYQGRFPFSDFSLLDLPDNLKGSFDFIDGYDKPVKGRKINWMKAGILESDRLVTVSPYYAHELVSGEDKGVELDNIIRKTGITGIVNGMDVQEWNPATDKYLDIKYDNTTVLDAKPLLKEALQAEVGLPVDRNIPVFGFIGRLEE

SEQ ID NO: 4496 - protein, 990 aa, Xanthomonas campestris
MQHGSHCTVVYDGKTLHGQADIPLIEFLSGHGIDLSHICYHPALGAPQTCDVCWVEVGGELVRGCTLRSHDGLEVSSTVERAHAARHEGMDRVLAKHELYCTLCEHNTGDCTLHNTFADMKMPIQRYAFQRKPYEKDHSNPFYTYDPDQCILCGRCVEACQKVEVNETLSIDFSMEHPRVLWDGGKPINASSCVSCGHCVTVCPCNALLEKTMQPDAGPLTALPQELKRPMIDMVKTLENTIGAPPITGVSVLDMHWRQPEIKRTKTVCTYCGVGCSFEMWTRDRHLLKVQPVVDAPANGISTCVKGKFAWDFVNDPKRLTTPLIREHGRFREASWDEALALVARRLLEIRDLHGAQSIGFIGSSKASNEEAYLTQKIARLIIGTNSVDNSSRYCQNPATEGLFRTVGYGGDAGTIADLQQAELVVIVGSNLAENHPVIASKLKAARKLHGQKLIVVDPRKHEMAERADLFLRPVPSTDIVWASALSRYMFDNGYADTQFLAQRVNQVDEYRQSLEPFTLDYAAQITGLSREQLVEAGEMIGRARSVCIVWAMGITQHTHGADTSTALSNLLLVTGNYGRPGTGGYPMRGHNNVQGASDFGCLKNMYPGYESVSDPAVRNKWAQAWHVPAEQLSLEVGSDNFMMVQQADKGEIRAMYVIGEETAFSDADARNVHRGFSKLDFMVVQDLFFSRTAEFADVVLPACPSVEKDGTFVNTERRIQRFHQVFPPLGQSRPDWQILTELAARMGHDWGYTHPSQIMDEVARIATLFKGVSYQRLEGWRSLLWPMQDDGRDTPLLYTERFHTDDGKARLHPLQWKRPGEEADAQFDLMLDNGRMLEQFQGMNQTGRGPRLWSLAPNWFVEVSPQLAAERGLQEGDWVKLSSRRGSLEVPVVITDRVAGNTLFLPIHQGKPGINLLTGEHHDPDVNTPAYKELAVRMEPLGRTGKPPLPAHNFRHGHRTPNDGVPVQQKWAREDYVAPPARAPHPERF

SEQ ID NO: 4497 - protein, 378 aa, Streptococcus suis
MNNTEFYDRLGVSKNASPDEIKKAYRKLSKKYHPDINKDPGAEDKYKEVQEAYETLSDPQKRSAYDQYGPAGANGGFGGGAGGFGGFDGAGFGGFEDIFSSFFGGGGATRNPNAPRQGDDLQYAVNLKFEEAIFGVEREVSYNREATCRTCTGSGAKPGTSPVTCGRCHGSGVINVDTQTPLGTMRRQMTCDVCHGRGKQIKDPCATCHGTGHEKQAHTVTVKVPAGVETGQRIRLAGQGEAGFNGGPYGDLYVVIQVQPSDKFEREGTTIHYKLNLNFVQAALGDTVHVPTVHGDVDMVIPEGTQTGKTFRLKGKGAPSVRGGAIGDQYVTVNIVTPTGLNDRQKAALKEFAAAGNIDVKPHKKGFFDKVKDAFEDL

SEQ ID NO: 4498 - protein, 415 aa, Halobacterium salinarum
MAYDEVREVDPEVADALTGERHRQNDTLAMIASENHVSEAVMEAQSSELTNKYAEGYPGSRYYGGCEYADDVEELAVARAKELFGADHVNVQPHSGSSANMGVYFATLAPGDKILSLDLTHGGHLSHGHPANFAGQLYEVEQYEVDAETGRLDYEALREHADAFEPDMIVSGFSAYPREVEWERIQAAADAVGALHMADIAHITGLVAAGEHASPVGVADFVTGSTHKTIRAGRGGIVMCDEAFADDIDSAVFPGAQGGPLMHNIAGKAVGFNEALDPAFEEYAAQVVENAAVLGERLQEHGFSLVSGGTDTHLVLVDLRESHPDISGGDVEGELEDVGIVLNANTVPDETRSAFDPSGIRIGTPALTTRGFDADAMETVADCIARVIDNLGDESVYADVADTVADLCEQYPQYE

SEQ ID NO: 4499 - protein, 306 aa, Zea mays
  misc_feature (104)..(104): Xaa can be any naturally occurring amino acid
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNXLADHMIGNVYVQFREEEQAAAAYNALQGRFYSGRPIIVEYSPVTDFREATCRQFEENSCNRGGYCNFMHVKQIGRDLRRKLYGRSASRRYHARSRSPPPQRRGYREDYHHRDRDEYRGGGGGGGGRGRGSRHDRYDDGAGRGGRHDRYDDGAGRGGRYERYDDGGRRRHGSPPRRGRSPVRESSEERRAKIEQWNRERESKQ

SEQ ID NO: 4500 - protein, 309 aa, Xanthomonas oryzae
MAPSHWRLILNGKSTDNADLREAVGTLRKRGIQLDVRVTWEDGDAERYVSEAVADGVHTVVAAGGDGTLSEVAAALAHHERDAATLPSLGLVPLGTANDFATAANVPITPLDALTLIAERVAQPVDLLRIDAEHGPRWCANVASGGFGTQVTVETDEGLKKMLGGLAYLITGMSRLGRIDPIGARFNGPDFSWEGEFIALGLGNGRQAGGGQALCPEAVIDDGLLDVTIVPALDGEVAATLGTLVTGGKQAALERVAVRARVPWLEIVSNQPLTLNLDGEPETSRHFRIACVPARLRMHLPNDCPLLGR

SEQ ID NO: 4501 - protein, 357 aa, Unknown
  Pseudomonas sp. Y2
MSKFHSLTIKEVRPETRDAVSIAFDVPAELADSFRFTQGQHLVMRTQLDGEEVRRSYSICTGVNDGELRVAIKRVAGGRFSAYANESLKAGQRLEVMPPSGHFHVELDAARHGNYLAVAAGSGITPILSIIKTTLETEPHSRVTLLYGNRSSASTLFREQLEDLKNRYLQRLNLIFLFSREQQDVDLYNGRIDADKCGQLFSRWIDVKALDAAFICGPQAMTETVRDQLKANGMAAERIHFELFAAAGSAQKREARESAAQDSSVSQITVISDGRELSFELPRNSQSILDAGNAQGAELPYSCKAGVCSTCKCKVVEGEVEMDSNFALEDYEVAAGYVLSCQTFPISDKVVLDFDQI

SEQ ID NO: 4502 - protein, 321 aa, Haemophilus influenzae
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTAVDAIDRLRDTSSSHQRISIVEIMGRHCSDLTISAGIAGGCEYIVASEIEFNREELIQQIERSIIRSKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 4503 - protein, 112 aa, Desulfitobacterium hafniense
MKKIEAIVRPGKLDDVQSALDDFGVSGLTVTQVLGCGNQKGHTQVYRGVEYKVYLLPKVKIEVVVTDQDVDQVISIITQAARTGEVGDGKIFVYPVEEAIRIRTGEKGDDVL

SEQ ID NO: 4504 - protein, 269 aa, Oryza sativa
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKGVLSRS

SEQ ID NO: 4505 - protein, 73 aa, Achimenes admirabilis
ISGTNGEVMPGQWEFQVGPSVGIEAGDHIWCARYLLERITEQAGVVLSLDPKPIEGDWNGAGCHTNYSTKSMR

SEQ ID NO: 4506 - protein, 669 aa, Thermotoga maritima
MRRFMFILLIVELSFVLFASDEFVKVENGKFALNGKEFRFIGSNNYYMHYKSNRMIDSVLESARDMGIKVLRIWGFLDGESYCRDKNTYMHPEPGVFGVPEGISNAQSGFERLDYTVAKAKELGIKLVIVLVNNWDDFGGMNQYVRWFGGTHHDDFYRDEKIKEEYKKYVSFLVNHVNTYTGVPYREEPTIMAWELANEPRCETDKSGNTLVEWVKEMSSYIKSLDPNHLVAVGDEGFFSNYEGFKPYGGEAEWAYNGWSGVDWKKLLSIETVDFGTFHLYPSHWGVSPENYAQWGAKWIEDHIKIAKEIGKPVVLEEYGIPKSAPVNRTAIYRLWNDLVYDLGGDGAMFWMLAGIGEGSDRDERGYYPDYDGFRIVNDDSPEAELIREYAKLFNTGEDIREDTCSFILPKDGMEIKKTVEVRAGVFDYSNTFEKLSVKVEDLVFENEIEHLGYGIYGFDLDTTRIPDGEHEMFLEGHFQGKTVKDSIKAKVVNEARYVLAEEVDFSSPEEVKNWWNSGTWQAEFGSPDIEWNGEVGNGALQLNVKLPGKSDWEEVRVARKFERLSECEILEYDIYIPNVEGLKGRLRPYAVLNPGWVKIGLDMNNANVESAEIITFGGKEYRRFHVRIEFDRTAGVKELHIGVVGDHLRYDGPIFIDNVRLYKRTGGM

SEQ ID NO: 4507 - protein, 112 aa, Desulfitobacterium hafniense
MKKIEAIIRPSKLDEVQSALDRFGVSGLTVTHVIGCGKQKGHTQVYRGVEYKVFLLPKVKIEVVVNDQAVDEVVRIISDEARSGEVGDGKIFIYPVEGAIRIRTGEIGETVL

SEQ ID NO: 4508 - protein, 133 aa, Salmonella enterica
MNLMLQNLNNIRTLRAMAREFSIDVLEEMLEKFRVVTKERREEEELQQRQLAEKQEKINAFLELMKADGINPEELFAMDSAMPRSAKKRQPRPAKYRFTDFNGEEKTWTGQGRTPKPIAQALAAGKSLDDFLI

SEQ ID NO: 4509 - protein, 718 aa, Cryptococcus neoformans
MLTPCRADEHWVVVELCDEIRIEAVEIAVWEFFSGVVREVRVSVGGEDEEDDAEEPGQDDVAGRGHRWKQVGSFIGKNVRGSQTFSLSQPTSFHRFIRLDFPSYFGSEYYCPVSSLKVYGMNQMEAFKWEQKQLSAVAKDRDRTGNREHEEEERRAKERREREKKERDERDKQEQRERELDELEKLLHEQAGRLVPELLTESGLFSSIDETAPTNVPTVVSKRDGDSDSPPTNESMATSLIESTSIESTSIESPTSIESPSTSYTRAVPPRSDSSESIYAFIIRRLNALEGNSSLVARYIEEQAKVMRSMLKQVQVGWDEWKGEWEDEDRGRWQQERMRQEDRLGRVLSQLEQQRIAFDAERKAIETQLRVLADQLGYERRRGIAQLIIMVVIILLGAASRSSTMDAILTPLLKEARRRRSDYYHRKSLSGPLAGLHIDMGAGRPPAIIGQARPTSTTPSAHPHRHSSSTPTPRLKTSLSRAGSGHRSNTSLKRRGIVPQVPPSYRSVSSSEFTFSPLSHLPPTSSPSPANIPNPNPNPRNVRVSFPPPRQTPPPPSVSSRKLAQSAHLHHLHTTAAAAAAREDTERGITASMRRRRMRSSLVNDDNEQQTTVSGLGSGKADAGGGGGGGGGEEAERVVGAEDNSQGEWGTDDFDTEADDFDTEAEAEAEVSKVEDQVRDKKDSETDRKEQDQLGETEQQPVREKRGVQGEHVGLARA

SEQ ID NO: 4510 - protein, 268 aa, Triticum aestivum
  misc_feature (76)..(76): Xaa can be any naturally occurring amino acid
  misc_feature (219)..(219): Xaa can be any naturally occurring amino acid
  misc_feature (228)..(228): Xaa can be any naturally occurring amino acid
NKFVQKSRLVPVRNSRDIVDPRVREQSVSPGGGAWLGGQLFSAMVVRKPAHLFLDELNIEYDEQEDYVVIKHAALXFTSTVMSRLLARPNVKLFNAVAVEDLIVKEDRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISXQKAAHLALXALGRPNGIDGTLKNVTRALHPEMILAATTTTSWTPKQAWS

SEQ ID NO: 4511 - protein, 359 aa, Zea mays
  misc_feature (200)..(200): Xaa can be any naturally occurring amino acid
MACLTDLVNLNLSDNTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQVRXWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 4512 - protein, 432 aa, Corynebacterium glutamicum
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFGLALKSGNVALLRGSSTAVHSNTKLVEILQDVLERFELPRETVQLLPCQTRGSVQDLITARGLVDVVIPRGGAGLINAVVTGATVPTIETGTGNCHFYIDAEAKLDQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 4513 - protein, 230 aa, Aegilops tauschii
MAGGDDLKLLGAWPSPFVTRVKLALALKGLSYEDVEEDLYKKSELLLKSNPVHKKIPVLIHNGAPVCESMIILQYIDEVFASTGPSLLPADPYERAIARFWVAYVDDKLVAPWRQWLRGKTEEEKSEGKKQAFAAVGVLEGALRECSKGGGFFGGDGVGLVDVALGGVLSWMKVTEALSGDKIFDAAKTPLLAAWVERFIELDAAKAALPDVGRLLEFAKAREAAAAASK

SEQ ID NO: 4514 - protein, 241 aa, Escherichia coli
MATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 4515 - protein, 467 aa, Haemophilus influenzae
MSKVASIVDVLQGKVAIGETVTVRGWVRTRRDSKAGLSFLAVYDGSCFDPIQAIINNDIKNYESEILRLTTGCSVIVTGKVVESPSEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRGENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDGKTVAAMDVLAPGIGEIIGGSQREERLDVLDKRMEEMGLNPEDYWWYRDLRKYGTVPHSGFGLGFERLIVYVTGVQNIRDVIPFPRAPRNANF

SEQ ID NO: 4516 - protein, 304 aa, Anabaena variabilis
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 4517 - protein, 313 aa, Docyniopsis tschonoskii
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSVDFIDGYDKPAKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 4518 - protein, 313 aa, Docyniopsis tschonoskii
GGLGDVLGGLPPAMAANGHRVMTISPRYDQYKDAWDTEVTVELKVGDKTETVRFFHCYKRGVDRVFVDHPLFLEKVRGKTASKVYGPVAGVDFKDNQLRFSLLCQAALEAPRVLNLNSSKYFSGPYGEEVVFIANDWHTALLPCYLKAVYKPRGIYSTAKVAFRIHNIAYQGRFAFADFGLLNLPDEFKSSFNFIDGYEKPVKGRKINWMKAGILESDKVLTVSPYYAEELVSAVEKGVELDNIIRKTGIFGIVNGMDVQEWNPLTDKYTTIKYDASTVADAKPLLKETLQAEVGLPVDRDIPVIGFIGRLEE

SEQ ID NO: 4519 - protein, 313 aa, Eriobotrya japonica
GGLGDVLGGLPPAMAANGHRVMTVSPRYDQYKDAWDTSVLVEIEIGGRVETVRFFHCYKRGVDRVFVDHPLFLEKVWGKTGSKIYGPRTGVDYMDNQFRFRLLCQAALEAPRVLNLNSNKYFSGPYGDDVLFIANDWHTALLPCYLKTIYKPKGIYKNAKVAFCIHNIAYQGRFPFSDFSLLDLPDNFKGSFDFIDGYDKPIKGRKINWMKAGILESDRVVTVSPYYAKELVSGEDKGVELDNIIHRTGITGIVNGMDVQEWNPATDKYLDVKYDNTTVLDAKPLLKEALQAEVGLPVDRNIPVFGFIGRLEE

SEQ ID NO: 4520 - protein, 773 aa, Arabidopsis thaliana
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHMVGSLVKPRKRQEGSSLMFKVLKERGSLDRSDHRWAAWRSPASSADGDVYIRFEMNVENDDSSSQSFASVSSRDQEVGDVRFSGGYGLGQDLSFGVCKKVVQLIHGNISVVPGSDGSPETMSLLLRFRRRPSISVHGSSESPAPDHHAHPHSNSLLRGLQVLLVDTNDSNRAVTRKLLEKLGCDVTAVSSGFDCLTAIAPGSSSPSTSFQVVVLDLQMAEMDGYEVAMRIRSRSWPLIVATTVSLDEEMWDKCAQIGINGVVRKPVVLRAMESELRRVLLQADQLL

SEQ ID NO: 4521 - protein, 685 aa, Mastigocladus laminosus
  misc_feature (300)..(318): Xaa can be any naturally occurring amino acid
GQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQHVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCPAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPSTPSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 4522 - protein, 313 aa, Eriobotrya japonica
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFVANDWHTALLPCYLKAIYKPEGIYKTARAAFCIHNIAYQGRFAFEDFALLNLPNEFKSSFDFIDGYDKPVKGRKINWMKAGILESDKVLTVSPYYAEELVSSAEKGVELDNIIRKTGIQGIVNGMDVQEWNPLTDKYTTVKYDASTVADAKPLLKEALQAEVGLPVDSDIPVIGFIGRLEE

SEQ ID NO: 4523 - protein, 315 aa, Unknown
  Sulfitobacter sp. EE-36
MKDTTFGPKGWTPDRLGSLKGKTYLITGTTAGAGFQATRILLSKGAKVVMLNRNADKSIAAVKTLKDTFGPNAEVSFVRMDLSDLASVRAAAEEVQSTVPRIDALICNAAIAQVPTQQLTVDGFESQLGTNHYGHFLLCGMLFDRIQESAGRIVVVSSLGYNMGIKTIQFDDMNWDKNYSANAVYSQSKLAQMMFAYELQDRLKATDSRVEVYVCHPGASATSLISTSGGLFTRVTWWMMSKTPMVQSAEKGAYPEVMCATEDGLAQRALYGPTGWLQTGGPVGKGTLNPHAYDKPVMEKLWTVSEKATGFHWEI

SEQ ID NO: 4524 - protein, 444 aa, Thiomicrospira crunogena
MLSKLLTIFILSTSLILTACAKEPAMNPSPSSSDKTDYIVLGMGCFWGAEKRMGEVPGVITVESGYAGGDQKNAGYYDVLGLEKEIRYGKSDLRNHAEVVKVTFDPQKTDLKTVLIKFWESHDPTQGDRQGNDIGTNYRSAIYTHSEAQTAIAKKTETVYQKALDKAGFGKITTEIAPLRNYITAEEYHQDYLKKNPNGYCGLGGTGVKYPAASPDDASAMPEEAPVAKRLLGRDLSAERQLVVFEAEDCAFCKKFKAEVLSTWQSEVPIVTTLNPNVPEGWHLEKALFATPTIVLFEQGKEVSRYTGYNGDKERFWKWLGFRLLTPEQRRIAFEQGTEYAFTGSHLDEKRSGTFVDPITGAALFRSDTKFESGSGWPSFFNPVEGAITEHKDTSHGMTRIEVRSASSGIHLGHVFNDGPPPTHKRYCINGNVLKFVPDEKAEQ

SEQ ID NO: 4525 - protein, 960 aa, Mannheimia succiniciproducens
MKRMLINATQQEELRVALVDGQRLFDLDIESPGHEQKKANIYKGKITRVEPSLEAAFVDYGAERHGFLPLKEIAREYFPDDYVYQGRPNIKDIIKEGQEVIVQVNKEERGNKGAALTTFVSLAGSYLVIMPNNPRAGGISRRIEGDERLELKDALSSLDVPEGVGLIVRTAGVGKSSEELQWDLKVLLHHWEAIKQASQSRPAPFLIHQESDVIVRAIRDYLRRDIGEILIDSPKVYEKAKAHIKLVRPDFISRIKLYQGEVPLFSHYQIESQIESAFQREVRLPSGGSIVIDVTEALTAIDINSARSTRGGDIEETALNTNLEAADEIARQLRLRDLGGLIVIDFIDMTPVRHQREVENRMREAVRQDRARIQISRISRFGLLEMSRQRISPSLGESSHHICPRCQGTGKVRDNESLSLSILRLLEEEALKENTKQVHTVVPVNIASYLLNEKRKAIHDIEKRHNVEILVVPNKEMETPHFSVFRVRDGEEINTLSYNLVKVYEEQETTFIADEPFTTRVTETAAVTTENVLESAALSMTISEPAPTIEVKKEEQPSLFVRIVAAIKGLFASEPKVEEKVEEAPQPNTRNRRNNQEHRNSRRNRNERNNRGNNEEPADKVQSEKSAEKAERPARSERTRRNNRNRNAAADDSLNNESVIEAVTNETTDDEAKAPQQRRQRRDLRKRVRVTEEQVTVAAEPVDKPSLAESVPVEPVVEENVYQERDRQDNRRRLPRHLRVNNQRRRRNAEQVSAMPLFAAVASPELASGKVWIESPTAPAKPKESAFLSVDELLEQQSEVKQPGVTTPAPATQVIFDKADNDIAPLASFVTQPANESVQKKVQESLDRLEQTNGQQTEVKEDDNASNMTLSDVTATESAVEKTEVLNLSNYRFSGRLGTISAVKHTKAEMTLAKAADEVLPPFEIVQWQDSRYYFHGKGSAGHNSAVSHVFTAATQAKAE

SEQ ID NO: 4526 - protein, 242 aa, Plantago major
MVSSDVFSLLKNELPVQQDSLSLSSHLKTGLVLVDIVNGFCTVGSGNLAPQAPDKQIQGMVDESVRLAKEFCRRDWPVYALLDSHHPDIPEPPYPPHCIAGTEESELVPALHWLEKEPNATLRRKDCIDGFIGSLEKDGSNTFVDWVKANEIKAVLVVGICTDICVLDFVCSALSARNRRLLTPLEDVIVYSHGCATFDLPVHVAKNIEGALAHPQEIMHHVGLYMAKGRGAKVVSEVSFGT

SEQ ID NO: 4527 - protein, 211 aa, Unknown
  Mycobacterium sp. MCS
MRAAALVPVPTAWHAVGVPAHTPDLYEGDIKSVLLSEEQIQSRTAELAAQIADTYRAAIGDSGQDLLLVTVLKGAVMFVTDLARSIPLPTQLEFMAVSSYGSSTSSSGVVRILKDLDRDINDRDVLIVEDIVDSGLTLSWLLRNLATRQPRSLRVCTLLRKPDAVRADVDIEYVGFDIPNEFVVGYGLDYAERYRDLPYIGTLEPKVYTHD

SEQ ID NO: 4528 - protein, 72 aa, Arabidopsis thaliana
MGRRPARCYRQIKGKPYPKSRYCRCVPDSKIKIYHVGNKKKGGEEFPHRVQLVAREKGNVSSGTTLTCPYCL

SEQ ID NO: 4529 - protein, 88 aa, Oryza sativa
MAPRVSNFTSIPPSIAKPVIRRLARKGGVKRISGLIYKETRGVLEIFLKNVIRDAITYTEHAHRKTVMAMDVVYALKLQGRTIYDFGG

SEQ ID NO: 4530 - protein, 195 aa, Plantago major
VTTIFYLLCGCMGYAAFGDQAPGNLLTGFGFFDPYWLLDIANIAIVVHLVGAYQVYCQPLFAFIEKWSVRKWSRSDFVTAEYDIPIPLCGVYQLNLFRLVWRTIYVVFTTLIAMLLPFFNDVVGILGALGFWPLTVYFPVEMYIAQNKVRKWTSQWIGLQLLSIACLLVSVAAAVGSIAGVILDLRTFKPFKTVY

SEQ ID NO: 4531 - protein, 135 aa, Wigglesworthia glossinidia
MSEALKILNNIRTLRAQARECTLETLEEMLEKLEVVVSERREEDNQAQAEIEKKTRKLQQYREMLIADGIDPNELLKSMNFVKSSSKNKRAIRPAKYKYINANGESKTWTGQGRTPSIIKKAIDNDGKKLEDFLL

SEQ ID NO: 4532 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSYTPYGRYRDAKVQEALPVPLHLLPAPHLLPPDLPRAYRVYTPFARRFLGVEAPLPAPEALPKGPEEGEIPREDPGLPLPEPGEEAALAGLRAFLEAKLPAYAEERDRLDGEGGSRLSPYFALGVLSPRLAAWEAERRGGEGARKWVAELLWRDFSYHLLYHFPWMAERPLDPRFQALPWQEDEALFRAWYEGRTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 4533 - protein, 537 aa, Oryza sativa
MARGSGAGGGGGGGGGGLELSVGVGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFWSVSMGGGH

SEQ ID NO: 4534 - protein, 332 aa, Unknown
  Acidovorax sp. JS42
MPTRLPIDQPTLIMTMATHHQLIILGSGPAGWTAAVYAARANLKPLVLTGLQMGGQLMTTTEVDNWPGDAHGLMGPDLMTRMQAHAERFETEVVFDHIHTADLSKRPFTLTGDSAQYTCDALIIATGATAKYLGIPSEEAFKGRGVSACATCDGFFYKDQDVIVVGGGNTAVEEALYLSNIARKVYLVHRRDTLRAEKIMQDKLFAKVAAGKVETVWHHEVDEVLGNDMGVTGVRVKSTLDGSTRDIDAHGFFVAIGHSPNTELFKGQLAMNNGYLEIRSGLGGNATQTSVEGVFAAGDVADQHYRQAITSAGFGCMAALDAERFLDSAVVR

SEQ ID NO: 4535 - protein, 577 aa, Unknown
  Shewanella sp. MR-4
MHESQTTGSATQAVKTSRLSWFDDVLLLGIMAVLAGCGLIYEYLLSHYAGRILGALEAAIYTMIGLMIVSMGLGAFAARKIKDAFTGFVVLELTVALCGSLAILITAAVIGLGQQLPMLIASTLGLPPDQLPEGGMVGSLQKLSEYLPYIWGVSLGLMIGMEIPLIARVRQSLSDEHLLHNAGTIYGADYIGAGIGAAIWVGFMLAIDIQLAAALTASFNLLAGFVFIWRFWPKIQRAKLLLAGHFVVTGVLLLLAIQGPSWELQFNNLLYKDKVVYAKATRFQQLTFTERLRGNGLSPIYSLYINGRLQFSSIDEHIYHAFLVHPTLAASARHNKVLIIGGGDGLGLKQVLRWEPEQVTLLDLDAALVQLFKTPDTDMPKRLSQALLALNGNAFNDPRVKVIHDDAFNGVDKLIAAGDKYDAIIVDLPDPSHPDLNKLYSDYFYRKLKELMSSDGALTVQSTSPYHAQKAFISVAKTLALAGFDVKQYHHNVPSFGEWGWSIATLSGKDAQHRLGELTTLPIADDWLTLGLVKGAFEFPANFYQDAANIKPNELGSLQLYHYHQQAWSETQGLDLF

SEQ ID NO: 4536 - protein, 1197 aa, Cryptococcus neoformans
MSSIPRTSPQDDVRAHITASLCAQRAPDGTPEETLITFLKVYEEDPAGGTKSRYLILAVQRTGRVFIHKAKRNSNLSFSKGKTWYLEDVRVLEVMGPSDFALTMTTRRYHWTTERPKDQTAFLTSVVKVYKEYTHGRLPELINFVPPSTQPQPPSQQQMPPHTGLNEPFPIPRVGNSDLTPPQPFGRSYRANSSSSVNSSQTYGSHYQPSHSESSRGRPSLDDDRSPPSSAGAGAFARLPLSDTGRRPSVGDGRGVMSPRAVGPGNGVGMGPPPAQRKMSDDRAERIGPSALRNVSAASEYDPGAAGDASLRMKKSESDMGVIAEMERERSVLAGDGRKANQSNRIASAPVIREPSSPPPPLPPPPQSTSNPQASEQAKPKPAPPTITTTDLSVPSPGLTTPAAYSSSPASATRPYRRASFHPPPLDTTISRDVLLQSRTGLLPGAAGMTIDESEGDDGVLKNVEEMLEGFDWGMSAGGLGISGEGKKKGADVIENRLLDELTALDSAIIHAFLESDDRTAQVLAHIDEALMELDDIDLQITGYRMQLNAVSDDISYIESQGKGLQVQTSNQQVLLNELRQLLQIVEVPADDLHTLIKEPPSSEQGVKALERAAASLYKALQAGMDTANAEVAATIARMQEYREQSSKFCKRMSDYLDITFQYQADSTLSEFRKNFKKTMALESHQKMGEKLMIYTGLVLYIKEMDDARYQKLCSDYMSRASQLHQSEMRELLTYMASLNVSSGDAGADADFSSAPGANYARPSALQKSKTVIGLGLGNQPKQEKRTGNNVNRAAELYRQAFTQIINQIVIEEDFINAFLRPVDTESTFADYMELDSYFRRQAARHASRARSAGMIQLLRSMMDLIFGFVEVELKNWVEATVEKGPVLTTFSAIVGIIAVTERLAKEAEEENTSIFFAQLFDKQLLKQRLIMDMFVNKQIKLIEASKTVIKRRKGIIFFVKHFPVFVERVEQQMDGNGDLPIRVKVNEAYERVMTSVFGSLEQLAKMERAETQANEDKGQLNYHVIMIENLHCFVEDVSQIKSMAMAGFLQRAKARYEENVSMYIKLMLRRTFARFIDFFDGVDRLLQSTPANEVSLHHSYNRSALKKILKDHGAKDMRKAVETMSRRVDKHFADDEEPNTSTANTALISIIWKELTKEFAKEILRAQGIVAKSYGDSGLGLEFSAADVEATCKKMK

SEQ ID NO: 4537 - protein, 332 aa, Brassica napus
MDATREASVTDLKRPREEDDNNNTAAVASMETKEPACFSSVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHSSVEQIDMCEIDKMVVDVSKQFFPNVAIGFEDPRVNLVIGDGVAFLKNAAEGSYDAVIVDSSDPIGPAKELFEKPFFQSVARALRPGGVVCTQAESLWLHMDIIEDIVSNCREIFKGSVNYAWTSVPTYPSGVIGFMLCSTEGPDVDFKNPVNPIDDSSSKSNAPLKFYNAEIHSAAFCLPSFAKKVIESKAN

SEQ ID NO: 4538 - protein, 234 aa, Rhizobium leguminosarum
MAKADFYETLGVAKSADEKELKSAFRKLAMKFHPDKNPDDKDAERKFKEINEAYEMLKDPQKRAAYDRYGHAAFEHGGMGGGGGGFAGGGFSDIFEDIFGEMMGGGAARQRSSGGRERGADLRYNMEITLEESFSGKTAQIRVPTSITCDVCTGSGAKPGTQPKNCGTCQGTGRVRAAQGFFSIERTCPTCHGRGQIIPDPCPKCHGQGRVTEERSLSVNIPAGIEDGTRIRLQ

SEQ ID NO: 4539 - protein, 352 aa, Polyangium cellulosum
MAELDHWHPVLLSHELRRKPRNVRLAGHEIVVFRTSSGGLGAFTDRCPHRSMRLSEGWVEGDRLVCAYHGWRWAVDGRGEIPATPAARPCARREDMFEAVERYGAIWVKRAGSQAAFPRLEGEGYVPRGLLRHRATVPFELALDNFIEIEHTPFVHFMLGYPLERMPEVEARVTLTDETIRVVHSGPRRPMPRAMEKLLGIPEDAIFVVDWTSYFSPVYTIYNHSLRDPKTNQPVTFPLRSAVFFNPVGPESSEMYTFLFASLAPWSKFGAGAVLWPAMQVAMNIELRLDMRLLDRLTDKRGILKGNVLGRFDKPLVIARDRIDRIYRGRVAEAGDGHEAARPARRLPLAAP

SEQ ID NO: 4540 - protein, 334 aa, Atropa belladonna
ALKLFVSFTAINVGLIVFLLTTQCSWRKFGAKLLQKFMAPKLDKIIWTMNLGSACCVKVLNLNCSKYFSGPYGEDVLFIANDWHTALIPCYLKSMYQSRGLYTNAKIAFCIHSIAYQGRFAFSDFALLNLPDEYRSSFDFIDGYEKPIKGRKINWMKAGILESHRAVTVSPYYAQELVSGVDKGVELDNVLRKTCITGIVNGMDTQEWNPATDKYADVKYDITTVTDAKPLLKEALQAAVGLPVDRKIPLIGFIGRLEEQKGSDILVAAIDEFIGLDAQIIVLGTGKKKFEQETEQLEVLYPDKAKGVAKFNVPLAHMITAGADFMLAPSRFEP

SEQ ID NO: 4541 - protein, 199 aa, Magnetospirillum magnetotacticum
GAEIVLTPASKGMTGAVRQAEELLASTPGAIMPQQFKNAANPAIHERTTAEEIWNDTDGKVDIIVSGVGTGGTISGIGRVLKARKPGLKMVAVEPEDSPVLSGGAPGPHKIQGIGAGFVPDILDRGVIDEILQIGNETALSTARKAAKLEGVPVGISSGAAIAAALELGSRPENAGKVIVAIIPSFAERYLSTALFDQV

SEQ ID NO: 4542 - protein, 334 aa, Atropa belladonna
ALKLFVSFTAINVGLIVFLLTTQCSWRKFGAKLLQKFMAPKLDKIIWTMNLGSACCVKVLNLNCSKYFSGPYGEDVLFIANDWHTALIPCYLKSMYQSRGLYMNAKVAFCIHNIAYQGRFAFSDFSLLNLPDEYRSSFDFIDGYEKPIKGRKINWMKAGILESHRVVTVSPYYAQELVSGVDKGVELDNVLRKTCITGIVNGMDTQEWNPATDKYTDVKYDKTTVTDAKPLLKEALQAAVGLPVDRKTPLIGFIGRLEEQKGSDILVAAIHEFIGLDVQIIVLGTGKKKFEQEIEQLEVLYPDKAKGVAKFNVPLAHMITAGADFMLIPSRFEP

SEQ ID NO: 4543 - protein, 392 aa, Pseudomonas syringae
MHNPTPRTESPNALAFIKRFFAAEAAGGLILMAAALAALIVANSPLADSYFAALHTVLAGMSVEHWINDGLMAIFFMLVGLEIKREMLAGQLASWSQRALPGFAALGGMVVPALIYVAFNWGQPETIGGWAIPAATDIAFALGVLSLLGKRVPLSLKIFLSALAILDDLGAVLIIALFYTSDLSIPMLLAALGSIAVLVALNRLGVKKLLPYLLIGALLWFFMLQSGIHATLAGVALALCIPLGKADEEASSPLLHLEEKLHPWVAFAVVPIFGFANAGVSLAGITVDKLVDPVPLGVALGLLIGKQVGIFALAALAIRAGLARLPDGSNWGQLYGVAALCGIGFTMSLFIGALAFPGAPALVDEVKVGVLIGSVFSALLGVVVLRRFGARG

SEQ ID NO: 4544 - protein, 514 aa, Setaria italica
VGAEMAPWSKTGGLGDVLGGLPPAMAANGHRVMVISPRYDQYKDAWDTSVVSEIKVGDRYERVRFFHCYKRGVDRVFIDHPSFLERVWGKTGEKIYGPDAGVDYKDNQLRFSLLCQAALEAPRILSLNNNPYFSGPYGEDVVFVCNDWHTGPLSSYLKSNYQSNGIYRNAKTAFCIHNISYQGRFAFSDYPELNLPERFRSSFDFIDGYEKPVEGRKINWMKAGIIEADRVLTVSPYYAEELISGIARGCELDNIMRLTGITGIVNGMDVSEWDPSKDKYIATKYDVSTAIAAKALNKEALQAAAGLPVDRKIPLVAFVGRLEEQKGPDVMAAAIPQLMEEDVQIVLLGTGKKKFERMLMSAEEKYPDKVRAVVKFNAAVAHHIMAGADLLAVTSRFEPCGLIQLQGMRYGTPCVCASTGGLVDTVIEGKTGFHMGRLSVDCKVVEPADVQKVASTLKRAIKVVGTPAYEEMVRNCMIQDLSWKGPAKNWENVLLSLGVAGSQPGIEGEEIAPL

SEQ ID NO: 4545 - protein, 1021 aa, Corynebacterium glutamicum
MPNNKAVEAEISPSAVLAAEFDRDSLSEKTRVHQLAKRLGMVSKDVVVALDGIGLVKVAQSNLSKEEVEKLLDALSQPVLNAAPAAVPDVEPVEKIRRRVEKNVENEIHQIEEKVERELAAVAQPTDFEAAAREEATAELLEDIVPEITPAPVEASVYTPIFVAPAVVPTENVQDTDDEQVRERTARKRRGRRGTGRGRGAEAETVTEVSEEASTSEVEEVNEPIGIKGSTRLEAQRRRRTEMREENKKRRHVVSTQEFMERRESMERRMIVRERQRHDHPGLVTQVGVLEDDQLVEQFVTSDAQMSMVGNIYLGRVQNVLPSMEAAFIDIGKGRNGVLYAGEVDWKAAGLGGRGRRIEQALKAGDQVLVQVSKDPLGHKGARLTTQISLAGRYLVYVPGGRSAGISRKLPGPERKRLKEILGRVVPAQGGTIIRTAAEGVSEENIAADVNRLHTLWEQIKERTAEEKKSRGSKPITMYEEPDMLVKVIRDLFNEDFTSLIVDGDRAWNTVRAYIQSVAPDLVSRVEHFNRADFDGKDAFEAFDLNTQLEEALSRKVNLPSGGSLIIDRTEAMTVIDVNTGRYTGKGGGNLEETVTLNNIEAAEEIVRQMRLRDLGGMIVVDFIDMVLPENQELVLRRLNEALENDRTRHQVSEVTSLGLVQMTRKRIGAGLLETFSSPCEHCEGRGIIVHVDPVDTVDERVEAKAEERSRRHQRSNSTNKAAAEHPMVVAMRDLVESDEHDLDQEFEELAASVIVLDDSDLDDVVNDKLDEPERILAESTVEPEEGPRRRARRQRQESAADDIAAIAAAAVDIASEEDPDEPSGSSYVSDFEAEPIAPVVEKAAEPVAEPTADYEKARAEFEASPRRRRKTRGNSRSDHAPKPEDFAPVVEEVAETPVKTPARKAPRRNRPSELSSGAPSSAPSTRNRRRAVRRQLVEAPETVVEIAPEAAPEQVAEPQVEFDQPDNRRKRRRAVRVTAAPVEKKVASTSNARAPKKEPQAASTTNPGRRRRATRRGPRS

SEQ ID NO: 4546 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 4547 - protein, 313 aa, Eriolobus trilobatus
GGLGDVLGGLPPAMAANGHRVMTISPRYDQYKDAWDTEVTVELKVGDKTETVRFFHCYKRGVDRVFVDHPLFLEKVWGKTASKVYGPVAGVDFKDNEPRFSLLCQAALEAPRVLNLNSSKYFSGPYGEEVVFIANDWHTALLPCYLKAVYKPRGIYSTAKVAFCIHNIAYQGRFASADFALLNLPDEFKSSFDFIDGYEKPVKGRKINWMKAGILESDKVLTVSPYYAQELVSAVEKGVELDHIIRKTGIFGIVNGMDVQEWNPLTDKYITIKYDASTVADAKPLLKETLQAEVGLPVDRDIPVIGFIGRLEE

SEQ ID NO: 4548 - protein, 332 aa, Xanthomonas campestris
MPLFPLFANLQARAVLVIGGGEVATRKVLALLKAGAHIRLYAHALSPELEVLMQAGRFEQLRGSFDAAWIDDVWLVVAATDDTALNQQVAAAAGARQRLVNVVDDAELSTYQVPAIVDRDPLVIAISSAGAAPMLARRLRERLERELDASVGTFAGLFAHYRERIRSQFPDMNRRRRWFDRVIDGPVPLLLQGGDTAAADAAFRQALEDADAVPARGSVQLVGTGPGDPGLLTLKALRAMNLADVLLVAHDVPEAVVELARRDASRRVLPADVAEQQALLLQLAGDGLHVVALRGGAGFEAAHAQRIADALRVQGLACDQVPGVAAEPPSGD

SEQ ID NO: 4549 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGIITPKVE

SEQ ID NO: 4550 - protein, 313 aa, Eriolobus trilobatus
GGLGDVLGGLPPAMAANGHRVMTVSPRYDQYKDAWDTSVLVEIEVGSRVETVRFFHCYKRGVDRVFVDHPLFLEKVWGKTGSKIYGPRTGVDYMDNQFRFSLLCQAALEAPRVLNLNSNEYFSGPYGDDVVFIANDWHAALLPCYLKTIYKPKGIYKNVKVVFCIHNIAYQGGFPYSDFSLLDLPDNLKGSFDFIDGHDKPVKGRKINWMKAGILESDRVVTVSPYYAQELVSGEDKGVELDNIIRKTGITGILNGMDVQEWNPATDKYLDIKYDNTTVLDAKPLLKEALQAEVGLPVDRNIPVFGFIGRLEE

SEQ ID NO: 4551 - protein, 134 aa, Unknown
  Synechococcus sp. WH 5701
MRLLHTMLRVGDLERSLAFYTEVLGMRLLRRREYPSGRFTLAFLGYGEESDSTVIELTHNWDTTSYEIGTGYGHIAIGVDDIAGTCDAIAGKGGRVVRPPGPMKHGSTVIAFVEDPDGYKVELIQLAPRVDAAA

SEQ ID NO: 4552 - protein, 327 aa, Aquifex aeolicus
MSLKSCLMWVLGEHDEPYRKARETILKLVGNTPLVRVKKCLPEDIPEDVEIWAKLESFNPGGSVKDRPALSMFLDALKRGLIKEGKVVIDATSGNTGIALAMVGAALGVPVELAMPANVSEERKKIIKAFGAKLYLTDPLEGTDGAILFVRELVQKYPEKYVYLDQYNNPANWKAHFYSTGIEIWNQTKGRITHFVAGIGTGGTIMGTGRRLKIYNPNIQVIGVQPAYPFHGIEGLKHIESSIKPGIFDETFLDRTIFVETEDAYYWARELAKKDAIFVGQSSGAALWACIQLARELAKKGEKGVIVTVFPDGGEKYLTTALFSDKD

SEQ ID NO: 4553 - protein, 685 aa, Mastigocladus laminosus
  misc_feature (300)..(318): Xaa can be any naturally occurring amino acid
SQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQRVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCPAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPNTQSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 4554 - protein, 107 aa, Mannheimia succiniciproducens
MSEVLHATDASFEADVLRSDVPVLVDLWAPWCGPCRMVAPILDDLAAELAGKVKIVKINIDENQGTPAQFGVRSIPTLLMFKDGQLVGTQVGALPKNQLAAFVEKNL

SEQ ID NO: 4555 - protein, 313 aa, Eriolobus trilobatus
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYENAKVVFCIHNIAYQGRFPISDFSVLNLPENLKGSFDFIDGYNKPVKGRKINWMKAGILESDRVVTVSPFYAQELVSGEDKGVELDNIIRRTGITGIVNGMDVQEWNPATDKYLDTKYDNTTVLDAKPLVKEALQAEVGLPVDRNIPVIGFIGRLEE

SEQ ID NO: 4556 - protein, 817 aa, Xanthomonas campestris
MKQPRLVVIGNGMAGIRTVEELLKLMPGMYHITVFGAEPHPNYNRILLSPVLAGEQEFDDIVLNPLQWYRDNGIHLHLNKEVTRIDRVRRRVIAADGTEAEYDRLLIATGSVPFVLPIPGNDLKGVIGYRDIQDTRTMIDTARTRQHAVVIGGGLLGLEAANGLKVRGMEVTVVHLAGWLLERQLDPVAGNLLQQALRARGLEFRLNTATSALLGNAQGEVIGVRFADGSEIPADLVVMAAGIRPNTRLAEEAGIHCSRGIVVNDSLQSFDPRVYAVGECANHRGIAYGLVAPLFEQAKVCANHLAQFGIGIYRGSVASTKLKVTGIDLFSAGDFMGGDGCEEIVLSDPAGGVYKKLVIRDDVLVGACLYGDTSDGGWYFKLLKDGTPIQAQRDQLIFGESALGDSGTGGQDRASAMSDSDEVCGCNGVCKGTIVKAISEQGLFTVDEVKKHTKAASSCGSCTGLVEQILMNCLGSNFQETPKTKAVCACTDLSHGEVRRAIREHKLLTHAQAYAFMEWRTPNGCATCRPAINYYMLSTWPHEAIDDPQSRFINERAHANIQKDGTFSVIPQMKGGVTNASELRRIADVADKYAVPMVKVTGGQRIDLLGVKKEDLVDVWRDLGMQSGHAYGKSIRTVKTCVGSEFCRFGTQNSTQMGIDLETMLANMWSPHKVKLAVSGCPRNCAESGIKDVGIIAVDSGWELHVGGNGGIKTEVARFLVKVTTAEEVREYTGAFLQLYREQAYYLDRTVHYIARVGLDYIRAQVVDDAANRRALYERLLYSLEGLVDPWKARIAGERRQEYQPLRIAAPAATVKE

SEQ ID NO: 4557 - protein, 110 aa, Streptococcus pyogenes
MKWRKKMALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 4558 - protein, 395 aa, Streptomyces coelicolor
MIPNQWYPIVEAQEVGNDKPLGVRRMGQDLVLWRDIDGNLVCQGARCPHKGANLGDGRMKGNTIECPYHGFRYGADGACRVIPAMGSEARIPGSLRVPTYPVREQFGLVWMWWGDERPTADLPPVAAPAEVTDNRKLYATKRWTRPVHYTRYIESLLEFYHVTYVHRDHWFNYIDYLLLYGTPSKFGLDGRERYLAATRITNHRVETEAEGQTIRYSFDHCQEDDPTNTTHYVITFTFPCMVHVQTEQFETTSWLVPIDDQNTEHILRWYEYEQVKPVLRFEPLRRLLPWASLYMEKWVQDPQDVRIMEHQEPKISAGGVNKFIPVDEMNAKYISMRAKLIADASAAPSSPARAAEPEPEAAGRGGSAARATGNGRGAAGGRRGTKPKEDAAARP

SEQ ID NO: 4559 - protein, 313 aa, Eriolobus trilobatus
GGLGDVLGGLPPAMAANGHRVMTISPRYDQYKDAWDTEVTVELKVGDKTETVGFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNELKSSFDFIDGNDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 4560 - protein, 98 aa, Thermosynechococcus elongatus [sequence omitted]

SEQ ID NO: 4561 - protein, 193 aa, Plantago major
VFYMLCGCMGYAAFGDLAPGNLLTGFGFYNPFWLLDIANAAIVIHLVGAYQVYCQPLFAFIEKYANAKWPDREFITNDIEIPIPGLQEPYRLNFFRLVWRTAFVILTTVISMLLPFFNDVVGILGAFGFWPLTVYFPVEMYIAQKKIPKWSTKWICLQMLSMACLVISIAAAAGSVAGVILDLKVYKPFKTSY

SEQ ID NO: 4562 - protein, 313 aa, Frangula alnus
GGLGDVLGGLPPAMAANGHRVMTVSPRYDQYKDAWDTEVTIELKVGEKLEKVRFFHCYKRGVDRVFVDHPLFLEKVWGKTKSKIYGPITGEDYQDNQLRFSLLCQAALEAPRVLNLTSSKYFSGPYGDDVVFVANDWHTAPLPCYLKSLYKGRGIYKSARVAFCIHNIAYQGKFAFADFSLLNLPDEFKSSFDFIDGYDNPVKGRKINWIKAGILESDKVLTVSPYYAKELVSSVEKGVELDNILRKTGITGIVNGMDVQEWNPLTDKYTSVKYDASTVLDAKPILKEALQAEVGLPVDRKIPVVGFIGRLEE

SEQ ID NO: 4563 - protein, 912 aa, Xanthomonas campestris
MHRTTRSTCCYCGVGCGVLIHSTHDDAGERIVGIEGDPLHPANHGRLCSKGLALPQTAASQQGRVLAPELRRHRDAPRTAVSWDQALNHVTGKLAAIIDQHGPDAVAFYVSGQLLTEDYYVFNKLAKGLLGTNNIDTNSRLCMSSAVTGYKLALGADGPPTCYEDLELAQTVLFAGSNMAYAHPVLFRRLEDARARNPEIRWIVIDPRRTDTAAMADLHLAIEPGTDVALFNGMLHHLIWEGLVDARFVAAQTEDFDALKHMLREYTPRMSAEICGISHEDLVQAAEWFGRSPAALSLYCMGLNQSAHGTDKNLALINLHLATGQIGKPGAGPFSLTGQPNAMGGREVGGMATMLAAHREIGNAQERAEVERAWGVPAGRISATPGAPAVQLFERLRAGTLKAVWIVCTNPVHSMPDIDGVRAALEQAELVIVQDAFSGTDTVPYADVLLPAASWGEKDGTVTNSERCITRVRKAVEPPGQARADWWIAREVARRLEVRLAPQEGAGLFAFDTPAEIFDEHRALTVGRDLDIGGLDHAALDARGPQQWPFPAGATQGQARRYTDGVFATPNGRARFHATPYRKVAEPTSARFPMRLLTGRLRDQWHGMSRSGRAPGAFAHSPEPALRMHPDDAVRRGLQAGELVRVASKRGALVLPLELSDELRSGTVFAAMHWSAQTLASGGINEVSTPAVDTRSQQPELKHAAVRVEKAAFGWHLLAARRGDALALQQALQPLLRDCGYAGLRLHAEPGGDAGGQWAVLHAACERAPSAEWIDRLVAALQLPAGADVLEYRDLRRGLMRRVGWRLQDGHSHIDGVLLTAAQPSAANQSLLDTALRGQPWRGARLAVFAQTQGAPADPIVCTCMHVSSAAIHAAIDDGADLAQLKQRLGCGTVCGSCVPQLTRLCRPSQRA

SEQ ID NO: 4564 - protein, 258 aa, Xanthomonas campestris
MINSSSRCRDVVLLSAGPGDLELLTIKAVKALATAQVLLLDDLANPQIVELAPQARVIRVGKRGGCRSTPQDFICRLMRRYALQGVQVVRVKGGDALLFGRAGEEIAFLRAAGVGVQVINGVSAAFAAAAALEVSLTHRAHCHGITFVTAHTHDHGGPNWGALAASGTTLGIYMGLRRADAVASALLAHLPATTPAAIVQAATRAEQQRRLTTLGELGRTAATLPPDLPTLLLVGGAMAEANAACDDSLGLLLQQAVG

SEQ ID NO: 4565 - protein, 289 aa, Plantago major
  misc_feature (104)..(104): Xaa can be any naturally occurring amino acid
MAKTIVDSDYLRDVEKARRELRALISNKNCAPIMLRLAWHDAGTYDVSTKTGGPNGSIRNEEELTHGANNGLKIALEFCEQVKSKCAKISYADLYQLAGVVAVXVTGGPTITFVPGRKDSKISPREGRLPDAKKGAPHLKDVFYRMGLSDKDIVALSGGHTLGRAHPERSGFEGPWTAEPLKFDNSYFIELLQGESEGLLKLPSDLALLDDPEFRRYVELYAKDEEAFFKDYAESHKKLSELGFTPSPAAGVKAIVKDSTVLAQSAVGVAVAATVVILSYLYEVRRKMK

SEQ ID NO: 4566 - protein, 308 aa, Streptococcus suis
MAIYQNITQLVGKTPVIKLNNIVPEGAAEVYVKLEAFNPGSSVKDRIALAMIEDAEKAGTIKPGDTIVEPTSGNTGIGLAWVGAAKGYKVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 4567 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPGGAANNVFTNEFYLNLLNEDWKLEKNDANNEQWDSKSGYMMLPTNYSLIQDPKYLSIVKEYANDQDKFFKDFSKAFEKLLENGITFPKDAPSPFIFKTLEEQGL

SEQ ID NO: 4568 - protein, 580 aa, Unknown
  Rhodococcus sp. RHA1
MTTTFSDTDLRTDAQAWLDGFSRFLAAELAPTAVFAPQAYWRDVLAFTGDLRTFSDEIPAELLRRQELTKATNIRIAEDRTPPRLVERAGIPCLEVIFEFDTLAGSAVGVARLVDVPERGLLVRSLFTTLDQLADHPERTGEHRPVGQADSSKFGGPNWLDRRIAAQAYENRDPDVLIVGGGQSGLTLAARLGQLDVDALVVDTHARPGDNWRTRYHALTLHNAVWLNDLPYMPFPATWPQFVPKDKLAGWFEAYVEAMEINFWGTTAFIGGDYDEQSQSWVARVRRGDGTVRTLRPKHVVIATGVSGIPYVPELPGLSQFAGRTLHSSEYDDANDFAGQRVVIIGTGNSAHDVAQDLHAHGIDVTMVQRSSTTIVSVDPSAAAADASYLTAPTLEDCDLLSMATVYPDLYTGSQMITATMKELDKDLVAALNRIGFRTDYGEEDTGQQMKFMRRGGGYYLNVGCSDLLISGQVGLVQYADTAGFVAEGLSLTNGDVVEADAVILATGYQTQQEGVRALLGDEIADAVGPIWGYDDEGEVRNTWRRTAQPGLWFSSGNFQLCRIYSKVLAMQIRTELDNG

SEQ ID NO: 4569 - protein, 376 aa, Polyangium cellulosum
MHVEECHVVIVGAGPSGLAVGACLREQGIPFVLLEKSEAVGATWRRHYDRLHLNTIKQLSALPGQPWPEYSAPYPSRVEMVDYLERYAERFRLEPRLGVEVERAYHDGSRWVTRTHAGELRSQALVVATGYSRHPNVPTWPDQERFRGRILHSSAYRSGAEFRGQRVLVVGAGNSASEIALDLWEHCAETTLSVRSGNHVIPRELFKLPAQFNALALFERLPLAVGDRLATAILSRAVGDLSRWGIRRPAVGPGTRALKEGRMPLIDIGTVALIQQGKIKVVPGPRAFTETGVTFTDGRGLPFDVVVLATGYRPGLDDFLENATRYTDEHGCPRWHGAPTPAPGLFFIGFRNPITGQIRDIAAEAPRIARHIQGVN

SEQ ID NO: 4570 - protein, 356 aa, Polyangium cellulosum
MCYGLAMHAAPARDLIRHFHPVLPASKLGRKPVRVVLAGNAYALFRDEQGRPAALADACPHRLAPLSQGRVRPDGRLECPYHGWHFDAEGRGACPSQPSLTRCDTRSFQLVEQLGYLWLAHRDTPRSALPELDFSSDGFEYAGTFSHLAPAPLHVIFDNSSEDEHTPFVHGRLGWTPEDAARIDFSCDVFEDRTEVKYSAPQRPSTLARLMLLQPGDTFHNQWVTRFSPVYTVYTSWWTAQNGMERPVVARAGIFFVPETERTTFVRAFLFVKITDPRFRPLLPVVKSAAIALSWKEIRDDVKFIPHVADTPFEMKGMRLNKYDATLVHNHRLMRSIYFGETRGEAEGTGVGHASA

SEQ ID NO: 4571 - protein, 334 aa, Anisodus luridus
ALKLFVSFTAINVGLIVFLLTTQRSWRKFGEKLLQKFMAPKLDKIMWTMNLGSACCVKVLNLNCSKYFSGPYGEDVLFIANDWHTALIPCYLKSMYQSRGLYMNAKVAFCIHNIAYQGRFAFSDFSLLNLPDEYRSSFDFIDGYEKPIKGRKINWMKAGILESHRVVTVSPYYAQELVSGVDKGVELDNVLRKTCITGIVNGMDTQEWNPATDNYTDVKYDITTVTDAKPLLKEALQAAVGLPVDRKIPLIGFIGRLEEQKGSDILVAAIHEFIGLDVQMIVLGTGKKKFEQEIEQLEVLYPDKAKGVAKFNVPLAHMITAGADFMLVPSRFEP

SEQ ID NO: 4572 - protein, 319 aa, Clostridium difficile
MKMIKLATFAGGCFWCMVKPFDKYDGVIKVVSGYTGGHVENPTYQEVCSGTTGHLEAIQITYDDDIISYDELLNIFWKQINPTDDGGQFGDRGTQYKTAIFYHDEEQKNIALESREHLENSKIFDSKIVTDIIPATKFYEAEENHQDYYKKRPLNYNMYYKGSGRYNFVKSHWDGNNINREELKKTLTPIQFEVTQNDMTEVPFENEYYDNNKEGIYVDIVSGEVLFSSKDKFDSGCGWPSFSKPVIDKSIIERSDFSQGMYRVEVRSAKGNSHLGHVFDDGPKELGGLRYCINSASLKFIPRENMEALGYGEYLKLFE

SEQ ID NO: 4573 - protein, 244 aa, Fulvimarina pelagi
MARTNNPRGLHVKVKKKRGLKASSRRWIERQLNDPYVRQAKADGYRSRAAYKLIEMDDRYKLLKPGQRVVDLGAAPGGWCQVSVERVGSENDDIRVVGIDFLEVDPVSGAEILLMDFLDDEAPDRLMEALGGSPDIVLSDMAAPTIGHRQTDHLRTMHLCEVAADFAVRTLKPGGHFLCKTFQGGTERDLLELLKRNFKAVHHVKPPASRDGSVELYILAKDFKGRRESEAVDAMEDTEAGPLG

SEQ ID NO: 4574 - protein, 323 aa, Anisodus luridus
  misc_feature (204)..(220): Xaa can be any naturally occurring amino acid
ALKLFVSFTAINVGLIVFLLTTQCSWRKFGAKLLQKSMAPKLDKIIWTMNLGSACCVKVLNLNCSKYFSGPYGEDVLFIANDWHTALIPCYLKSMYQSRGLYMNAKVAFCLHNIAYQGRFAFSDFSLLNLPDEYRSSFDFIDGYEKPIKGRKINWMKAGILESHRVVTVSPYYAQELVSGVDKGVELDNVLRKTCITGIVNGMXXXXXXXXXXXXXXXXXDITTVKDAKPLLKEALQAAVGLPVDRKIPLIGFIGRLEEQKGSDILVAAIHEFIGLDVQIIVLGTGKKKFELEIEQLEVLYPDKAKGVAKFNVPLAHMITAGA

SEQ ID NO: 4575 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 4576 - protein, 859 aa, Mycobacterium smegmatis
MQSTRNVVVVGHGMVGHRFVEALRARDTEGSWRVTVLGEEREAAYDRVGLTGYTEHWDRSLLALPGNEYAGDDLVELHLGSAVVEIDRPARTVRTADGCTFSYDALVLATGSYAFVPPVPGRDLPGCHVYRTLDDLDAIRASAANASKSKSPVGVVIGGGLLGLEAANALRQFGLRTHVLEMSPHLMAAQLDEAGGVLLNRMMRDLGIEVHTAVSTQSIAPAQKRKPLRRSEIDDSLRVSLDDGTAIDAGVVIFAAGVRPRDELAREAGLDMAQRGGVLTDSNCVTSDPNIYAIGEVAAVDGRCYGLVAPGYTTAEVVADRLLGGSAEFPGADMSTKLKLLGVDVASFGDAKGITPNCLEVVVNDPVKQTYAKLVLSDDAKTLLGGILVGDASAYGVLRPMVASELPGDPLALIAPTTGGDAPGLGVGALPDIAQICSCNNVTKGDLTEAIAGGCCDVADLKKCTLAGTSCGSCVPLLKQLLEAQGVEQSKALCEHFSQSRAELFEIISATEIRTFSGLIERFGTGKGCDICKPTIASILASTSSDHILDGEQAALQDSNDHFLANIQRNGSYSVVPRVPGGDITPEQLILIGEIARDFGLYTKITGGQRIDMFGARVEQLPEIWRRLVEGGMESGHAYGKSLRTVKSCVGSDWCRYGQQDSVQMAINLELRYRGLRAPHKIKMGVSGCARECAEARGKDVGVIATDSGWNLYVGGNGGMTPRHAQLLAGDLDDETLIRYIDRFLMFYIRTADRLQRTAPWVEALDGGIDHLRDVVCDDSLGLAEEFEAAMARHVEGYACEWKGVLQDPDKLARFVSFVNAPDTPDPTVSFTERSGRKVPDLRPVSIGMPTIRPLQEMS

SEQ ID NO: 4577 - protein, 218 aa, Actinobacillus pleuropneumoniae
MYGQYKKLRNEFTSVLTGKSLTWGGSLIRPEATGYGAVYFADAMLATHGQGFDGKRVVISGSGNVAQYAAEKAIQKGAKVLTVSDSNGYVLFPDSGMTEKQLADLLVLKNERRERLSVYAKEQGVQYFEGQKPWGVKCDIALPCATQNELDGEAAKELVKNGCFCVAKGANMPTTLEGVEVFIAAKILYAPGKAANAGGVAHFRFRNEPKRNALSLDS

SEQ ID NO: 4578 - protein, 334 aa, Atropanthe sinensis
ALKLFVSFTAINVGLIVFLLTTQCSWRKFGAKLLQKFMAPKLDKIIWTMNFGSACCAKVLNLNCSKYVSGPYGEDVLFIANDWHTALIPCYLKSMYQSRGLYMNAKVAFCIHNIAYQGRFTFSDFSLLNLPDEYRSSFDFIDGYEKPIKGRKINWMKAGILESHRVVTVSPYYAQELVSGVDKGVELDNVLRKTCITGIVNGMDTQEWNPATDKYTDVKYDITTVTDAKPLLKEALQAAVGLPVDRKIPLIGFIGRLEEQKGSDILVAAIHEFIGLDVQIIVLGTGKKKFEQEIEQLEVLYPDKAKGVAKFNVPLAHMITAGADFMLIPSRFEP

SEQ ID NO: 4579 - protein, 530 aa, Clostridium difficile
MEKMFCFQCEQTAGGKGCTINGVCGKKGGTANLQDELTGVLIGLSRATIGNKNRPTSETDKIMIEGLFTTITNVSFDDEAIKRQIEKTEVEKSKLVPRCSDCSTTCNRNDNYDMKDLWNDNEDIRSLKSLILFGLRGMAAYAYHAMVLGYTDKDVNEFFYEGLIAVGGDLSIDELLGLVMKTGEINLKCMELLDRANTETYGTPEPTQVSMKIEKGPFIVVTGHDLYDLHKLLEQTKDKGINIYTHGELLPAHAYPKLKEYKHLKGNFGTAWQNQQKEFDNIPAPILFTTNCLMPVKDSYRDRVFTTEVVAYPGMVHIDEDKDFSSVIEKALELGGYREDVHMTGINGGDTLTTGFARGTVSSVQDKVVDAVKSGAIRHFLLVGGCDGAKPGRNYYTEFVKQAPKDTVILTLACGKYRFNDLDLGDIGGLPRLMDMGQCNDAYSAIKVAVSLANAFECGVNDLPLSMVLSWYEQKAVCILLTLLHLGIKNIYIGPSLPAFLSKNVLDILVDKFALTPISTPEEDMKKILG

SEQ ID NO: 4580 - protein, 426 aa, Lactuca sativa
MPTDIEDEIKDEKNPRPLDEDDIALLKTYGLGPYSNSIKKAEKDVKEMSKRINDLCGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDMESRTQIFKIHTRTMNCERDVRFELLARLCPNSTGADIRSVCTEAGMYAIRARRKTVTEKDFLDAVNKVIKGYQKFSATPKYMVYN

SEQ ID NO: 4581 - protein, 334 aa, Hyoscyamus niger
ALKSFVSFTAISVGLIVFLLTTQCSWRKFGAKLLQKFMAPKLDKIIWTMSSGSACCVKVLNLNCNEYFSGPYGEDVLFVANDWHTALVPCYLKSMYQSRGLYMNAKVAFCIHNIAYQGRFAFSDFSLLNLPDEYRSSFDFIDGYEKPIKGRKINWMKAGILESHRVVTVSPYYAQELVSGVDKGVELDNVLRKTCITGIVNGMDTQEWNPATDKYTDVKYDITTVTDAKPLLKEALQAAVGLPVDRKIPLIEFIGRLEEQKGSDILVAAIHEFIGLDVQIIVLGTGKKKFEQEIEQLEVLYPDKAKGVAKFNVPLAHMITAGADFMLVPSRFEP

SEQ ID NO: 4582 - protein, 334 aa, Hyoscyamus niger
ALRLFVSFTAINVGLIVFLLTTQCSWRKFGAKLLQKFMAPKLDKIIRTMNLGLACCVKVLNLNCSKYFSGPYGEDVLFIANDWHTALIPCYLKSMYQSRGLYMNAKVAFCTHNIAYQGRFAFSDFSLLNLPDEYRSSFDFIDGYEKPVKGRKINWMKAGILESHRVVTVSPYYAQELVSGVDKGVELDNVLRKTCITGIVNGMDTQEWNPATDKYTDVKYDITTVTDAKPLLKEALQAAVGLPVDRKIPLIGFIGRLEEQKGSDILVAAIHDFIGLDVQIIVLGTGKKKFEQEIEQLEVLYPDKAKGVAKFNVPLAHMITAGADFMLVPSRFEP

SEQ ID NO: 4583 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEKLEHKIIMQRRKKQRGQRNYRRRNNHF

SEQ ID NO: 4584 - protein, 334 aa, Scopolia carniolica
ALKLFVSFTAINVGLIVFLLTTQCSWRKFGAKLLQKFMAPELDKIIWTMNLGSACCVKVLNLNCSKHFSGPYGEDVLFIANDWHTALIPCYLKSMYQSRGIYMNAKVAFCIHNIAYQGRFAFSGFSLLNLPDEYMSSFDFIDGYEKPIKGRKINWMKAGILESHRVVTVSPYYAQELVSGVDKGVELDNVLRKTCITGIVNGMDTQEWNPATDKYTDVKYDITTVKDAKPLLKEALQAAVGLPVDRKIPLIGFIGRLEEQKGSDILVAAIREFIGLDVQIIVLGTGKKKFEQEIEQLEVLYPDKAKGVAKFNVPLAHMITAGADFMLVPSRFEP

SEQ ID NO: 4585 - protein, 991 aa, Solanum pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGVEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 4586 - protein, 175 aa, Vibrio vulnificus
MNTQLATFGGGCFWCTEAMFSQLKGVLDVKSGYSGGHVKHPCYREVCSGKTGHAEVIQVSFDPDIIRYEALLLVHLTTHNPTTLNRQGADRGTQYRSIILAHDEEQKRIAQQVIAEVAPYFDEPIVTEVVDFEQFYQAETHHQNYYSDNPKKQYCAVVIEPKLRRLRERYADLLG

SEQ ID NO: 4587 - protein, 1060 aa, Yersinia pestis
MTSQEKVPLQVQLSLPQILSRRDWENPQITQYHRLEAHPPFHSWRDVESAQKDRPSPQQQTLNGLWSFSYFTQPEAVPEHWVRCDLAEAKPLPVPANWQLHGYDAPIYTNIQYPIPVNPPRVPDLNPTGCYSRDFTLEPSWLASGKTRIIFDGVSSAFYLWCNGQWVGYSQDSRLPAEFDLTPYLQAGSNRIAVLVLRWSDGSYLEDQDMWRMSGIFRDVKLLHKPEIHLRDIHIMTHLSPEFTSANLEVMAAVNIPSLQLNDPQVTGSYQLRVQLWLADKLVASLQQPLGTQAIDERGPYTDRTQLVLRIDQPLLWSAEQPTLYRAVVSLLNHQQELIEAEAYDVGFRQVAIHQGLLKINGKAVLIRGVNRHEHHPQTGQAIDEESLLQDILLMKQHNFNAVRCSHYPNHPLWYRLCDRYGLYVVDEANIETHGMQPMSRLSDDPSWFSAFSERVTRMVQRDRNHPCIIIWSLGNESGHGATHDALYRWIKTNDPTRPVQYEGGGANTLATDILCPMYARVDEDQPFPAVPKWSIKKWIGLPNESRPLILCEYAHAMGNSFGGFARYWQAFRQYPRLQGGFIWDWVDQSLTHHNDHGQPYWAYGGDFGDTPNDRQFCMNGLVFPDRSPHPSLYEAQCAQQFFQFSLLSTTPLVINITSEYLFRESDNEQLYWRIMLEGESVLEGSQPLNLSPESSQCYRLAEKLPTLNKPGQLWLNVEIRQPKETPWSPAQHRSAWHQWRLPQPLFSPSSDLTNATAHYAPQLQHNLQLQHDLQLQQDEQHIKVTYQQQCWQFSRQTGRLAQWWVADKPMLLRPLQDQFVRAPLDNDIGISEATHIDPNAWVERWKKAGMYQLQQRCLSLHVDHLSHSVQISAEYGYEFEQEPLLHSHWVYRFDRHGRMTIDVNVRIATSLPAPARIGMCCQLADISPTVEWLGLGPHENYPDRQLAAQYGHWSLPLEQMHTAYIFPSENGLRCNTHTLNYGRWTLTGDFHFGISRYSTQQLMVTSHQHLLEPEEGTWLNIDGFHMGVGGDDSWSPSVHIDDILTRETYQYQICWQYKV

SEQ ID NO: 4588 - protein, 334 aa, Scopolia carniolica
ALKLFVSFTAINVGLIVFLLTTQCSRRKFGAKLLQKFMAPKLDKIIWTMDLGSACCVKVLNLNCSKYFSGPYGDDVLFIVNDWHTALIPCYLKSMYQSRGLYMNAKVAFCIHNIAYQGRFAFSDFSLLNLPDEYRSSFDFIDGYEKPIKGRKINWMKAGMLESHRVVTVSPYYAQELVSGVDKGVELDNVLRKTCITGIVNGMDTQEWNPATDKYTDVKYDITTVKDAKPLLKEALQVAVGLPVDRKIPLIGFIGRLEEQKGSDILVAAIREFIGLDVQIIVLGTGKKKFEQEIEQLEVLYPDKAKGVAKFNVPLAHMITAGADFMLVPSRFEP

SEQ ID NO: 4589 - protein, 384 aa, Rhodobacter capsulatus
MAKVDFYEVLGVSKGASAEEIKKAYRSKAKELHPDRNQGQSAAEAQFKEVNGAYDVLKDGDKKAAYDRYGHAAFEGGMGGGGPRGPYGQGADFSSAFSDVFEDLFGDFMGGRGGPGGGGRRVRRRGSDLRYNMRVTLEEAFKGAQKTITVPGSAACGSCNGTGAEGGAEPQTCPTCSGLGKVRAQNGFFTVERTCPTCGGQGQVVKNPCRVCHGSGRIEKERTLSVNIPAGVETGTRIRLAGEGEAGMRGGPSGDLYIFIEVREHAIFQRDGVNLFCRVPVSMVSAALGGEVEVPTIDGGRSKVKVPVGSQSGRQMRLRGKGMPALRGGGIGDMVIELAVETPVNLTARQKELLDEFQRIQAENNPEGASFFQKVKSFWDGMKG

SEQ ID NO: 4590 - protein, 400 aa, Zea mays
MATGEEHVAAPAPAVEETPEKKQASTTELPAPSGWTKKLAPTRGGRGGRFEVIFVSPTGEEIKSKRQLTQYLKAHPGGPASSEFDWGTSDTPRRSARLSEKVKATESPEGEKTPKRARSSSKRGKKEEKVDAEDANEAGEDGAAAEGKGTDVEMKDAENAEDEKKDVPSAEKTEEVDDKKDAENVEMKDAAEKTEEVEDKKEEAPTVDAAENTVEGDDKKEEPPAEKTDEKEEAPAVDAAEKNEEGDDKKEEEPPAEKKTVEKEVVPAVDAAENTEQSTGGQAQPNDVAAPESENKGDGKPAESESAPLAFVDDAAPLVIVGEEKTEDSQAAESAVPSLASSEGEKKENGGATEPAAPPPVDAEKGAENSGQVNTAPQEPTAANCDKGQIQPGASAVRCT

SEQ ID NO: 4591 - protein, 257 aa, Glycine max
KQGTATLGGQIKDLVILSYEDRLVLFSRYLPQLVMESLGQEIDLNGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHLAANDRALIVEGSCGSPRSIKVFLGECNIDGLYA

SEQ ID NO: 4592 - protein, 478 aa, Xanthomonas campestris
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 4593 - protein, 352 aa, Campylobacter jejuni
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCVCRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKTLGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 4594 - protein, 115 aa, Zea mays
  misc_feature (97)..(97): Xaa can be any naturally occurring amino acid
GRPRRTADMLQTVLRGFYGKPHGTFSGVDIGQVLLSFLCKDNNASHAIEALRRAMFKFLVLLKIIVSRKWCFTKFIRSYYLNYKSDGRIVPDGVNSXLLFNHVILYIRAPGKAFL

SEQ ID NO: 4595 - protein, 313 aa, Frangula alnus
  misc_feature (185)..(185): Xaa can be any naturally occurring amino acid
  misc_feature (246)..(246): Xaa can be any naturally occurring amino acid
  misc_feature (258)..(258): Xaa can be any naturally occurring amino acid
  misc_feature (266)..(266): Xaa can be any naturally occurring amino acid
GGLGDVLGGLPPAMAANGHRVMTVSPRYDQYKDAWDTEVQVEIKVGDRIETVRFFHCYRRGVDRVFVDHPMFLEKVWGKTGSKVYGPETGVDYQDNQLRFSLLCQAALEAPRVLNLNSNKFFSGPYGEDVVFLTNDWHTALLPCYLKSMYKSRGIYKSAKVAFCIHNIAYQGRFGFSDFSLLNLXDEFKSSFEFIDGYEKPAKGRKINWMKVGVLEADRVVTVSPSYAQELVSGVEKGVELDNIIXKTGITGIVNGMXVQEWNPAXDKYIDVKYDATTVMDAKPLLKEALQSEVGLPVDSNIPVIGFIGRLEE

SEQ ID NO: 4596 - protein, 219 aa, Arabidopsis thaliana
METGLNILKLSLCVSLVVVGSYAQAPAPWNPSNGFRPGTCDHYECPTYKLVEAGYGFEIRMYDAALWISTSPIPSLSMTQATKTGFRRLNRYIEGDNKSNVKMNMTAPVIAQATPGRSVYTVSLYLPKKNQQNPPQADDLHVRSTKPTYVAVRQIGGYVSNNVAKEEAAALMESLRDSNWILPIEKSKGKSPAYLLAVYNPPSHTTARVINEIMVPFNM

SEQ ID NO: 4597 - protein, 502 aa, Oryza sativa
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGYLLSTMTNYSSKFGHAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 4598 - protein, 312 aa, Gillenia trifoliata
GGLGDVLGGLPPAMAANGHRVMTVSPRYDQYKDAWDTSVPVEIEVGGRVETVRFFHCYKRGVDRVFVDHPLFLERVGKTESKIYGPRAGVDYTDNQFRFSLLCQAALEAPRVLNLNSNKFFSGPYGDDVMFIANDWHTALLPCFLKTIYKPKGIYKNAKVAFCIHNIAYQGRFPFSDFSLLGLPENLKSSFDFIDGYNKPVKGRKINWMKAGIIESDRAVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 4599 - protein, 160 aa, Unknown
  Acinetobacter sp. ADP1
MTNLYQFEAELLEGDTKSLADYQGKVLLIVNTASKCGFTPQFAGLEKIYEKYKDRGFEVLGFPCNQFGGQDPGSNNEIGAFCQRNYGVSFPMFAKVDVKGPEAHAIFRYLTREAKGILGSENIKWNFTKFLVGRDGKVLNRYAPTTKPESLEEDIEKALA

SEQ ID NO: 4600 - protein, 313 aa, Gillenia trifoliata
GGLGDVLGGLPPAMAANGHRVMTISPRYDQYKDAWDTEVTVELKVGDKTETVGFFHCYKRGVDRVFVDHPLFLEKVWGKTASKIYGLITGVDFKDNQLRFSLLCQAALEAPRVLNLNSSKYFSGPYGEEVVFIANDWHTALLPCYLKAIYKPKGIYKTAKVAFCIHNIAYQGRFAFADFALLNLPDEFKSSFDFIDGYDKPAKGRKINWMKAGILESDKVLTVSPYYAEELVSAVEKGVELDNIIRKTGILGIVNGMDVQEWNPLTDKYTTVKYDASTVADAKPLLKEALQAEVGLPVDRDIPVIGFIGRLEE

SEQ ID NO: 4601 - protein, 1232 aa, Xanthomonas oryzae
MKRMLINATQAEELRVAIVDGQTLYDIDIEQPSKEQKKSNIYKGRITRLEPSLEAAFVDYGAERHGFLPLKEISRDYFQAGVDHNKSTIRELLREGQEIVVQVDKEERGNKGAALTTFISLAGRYMVLMPNSPSAGGVSRRIEGEDRAALKEALDKLDIPDDMGVIIRTAGVGRDAEELQWDLDYLLQTWKAIAEAALSKPAAFLIYQESRLIIRALRDYLRADVGEILVDTPELYADAQEFMKQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASSKHQREVENKLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEDSGKPSYQRGTPRKLPVHALTKAQLNIPAPPAVTSIKPSQPAPVREETPAPVAPVAAPAPVVTVPIPAPVTGVVGWLKRIFGGVEPLAPAPESIPRPRQNDAGRNHRNERGERGGQRRDGRDARNGGHSGNQQRGNGNGANKERRDERRQPASGQGAQNGAQAQQQAQTPKPPRNEAQSPKQQQPQQAQQQKPKPQNQTPRPPRTPAQQDGAQAERQPRPARQDEGMAAAQTVTSTAAMATTSSVVAAITDAAAPATAQTNANEAAQAHAVDVTVSASTADPGADASVAAPAQDAAGDDAANGEGGSRRRRGRRGGRRRRRGVGANGGEGGASVDGLEGDDLDGDADNDLDSDSEGDAAAAQAHASAAPRAGQPEFDFDDDAPAPTVRAKPEPTAQAAAKPRPVPKERAEPQVGNDTSLTTAPVSNTVPASQPPVATPVAKADTNHERPAAPTVAADAPAKPAPAATASTAVNADVAATQAVKQRPAPVAQHAPAAPAPVAAPAPVASTPVPAGAAVAPVAETASTAPVATPSAPASTVASPVSNVAATSTQHQPLGSASARAAASDTDKAAAPNADRQQRAAAADVATPATTQAAPVQTTPVKQTADLSAPVAAMPAAQAEVVTATSPHAEPPAAQAPSSEVAVTATSTLVQASPTADATPVRKRYAPVQTTMLDTLSPNDAATSAPAASEHPCARCSTARSNGSGIGIGSGRQAQADGGGIRSQACCPIDGGRQGAG

SEQ ID NO: 4602 - protein, 109 aa, Arabidopsis thaliana
  misc_feature (10)..(10): Xaa can be any naturally occurring amino acid
  misc_feature (22)..(22): Xaa can be any naturally occurring amino acid
  misc_feature (43)..(43): Xaa can be any naturally occurring amino acid
  misc_feature (49)..(49): Xaa can be any naturally occurring amino acid
MASSMLSSAXVGTAPAQATMVXPFTGLKSSAAFPVTRKTNKGXSSIASXWGRVSYIKVWPPIGKKKFETLSYLPDLSDVQFAKEVDLPFPHQGDSLVLLLLSHKHRIWN

SEQ ID NO: 4603 - protein, 313 aa, Heteromeles arbutifolia
GGLGDVLGGLPPAMAANGHRVMTVSPRYDQYKDAWDTSVLVEIQVGGRVETVRFFHCYKRGVDRVFVDHPLFLEKVWGKTGSKIYGLRTGVDYMDNQFRFSLLCQAALEAPRVLNLNSNKYFSGPYGDDVVFIANDWHTALLPCYLKTIYKPKGVYKNAKVAFCIHNKAYQGRFPFSDFSLLDLPDNLKGSFDFVDGYEKPVKGRKINWMKAGILESDRVVTVSPYYAQELISGEDKGVELDNIIRKTGITGIVNGMDVQEWNPATDKYLDIKYDNTTALDAKPLLKEALQAEVGLPVDRNIPVFGFIGRLEE

SEQ ID NO: 4604 - protein, 685 aa, Mastigocladus laminosus
  misc_feature (300)..(318): Xaa can be any naturally occurring amino acid
SQGNPIWRVRGDKAHPSSQGMVCVKGATIAESLDKNRLHYPMVRDSLDQKFRRVSWDEAFDLITKRIQAVRFTQGPEAICMYGSGQFQTEDYYIAQKLLKGCLGSNNFDANSRLCMSSAVAGYIQSFGADGPPCCYEDLELTDCAFLIGTNTAECHPIVFNRLEKYHKRNRKVKMIVVDPRRTPTAEAADLHLAIRPGTDIDLLNGIAHLLMRWNYIDVGFIDDCTSNFPAYAEVICHYSPEIVADRCGIDIKDLETAARYWGESQRVLSLWSMGVNQSSEGTAKVRTIINLHLMTGQIXXXXXXXXXXXXXXXXXXXREAGGLAHLLPGYRLVKNPQHRAEVEEFWGLKRGQISPNPGLTAWDMITGLEDGTVGLLWIAATNPAVSMPDLERTKAALMRSPFTIYQDAYYPTETATYAHVLLPAAQWSEKTGVMTNSERTVTLCRAFRRPPGEAKADWEIFAEVGRRLGFVGEFAFANSAEVYAEFVKLTRDRPCDMTGLSHEQLRSQGPTQWPHPAEEMGRTGDGEINFTPPPHHKSPSTPSSKRLYTNLRFHTPDGRARFGAYHSRGLAEPPDPDYPFVLTTGRLYGHWHTLTRTGRIEKTRQMHPEPFIEIHPRDAARLEITDNQLVEVRSRRSKTFFPAKITKAIAPGTVFVPMHWGALWADNAEANALTHPESCPDSLQ

SEQ ID NO: 4605 - protein, 313 aa, Heteromeles arbutifolia
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYNDNQFRFSLLCQAALEAPRVLNLNSNKYFSGPYGDEVVFIANDWHTALLPCYLKAIYKPKGIYENAKVVFCIHNIAYQGRFPISDFSVLNLPENLKGSFDFIDGYYKPVKGRKINWMKAGILESDRVVTVSPFYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 4606 - protein, 871 aa, Thermosynechococcus elongatus
MTLDAADLDAITQEARHCFLYEDAPEYLLLLEQWAEQVVTDPERHYTAEDYNTLMRAAHSLKGGAGIAQLSELQALSHRLEDILEALKEGRLGDRPRAHHLLVQGIEQAQELLAAAKQNHSLTPTPPYQALLAALTELLSTVSDPSSPPTVAPPDLRTALTQTLEESLQLLEASATDAERETALAQLIATAHTLGKQYPLPWLQQLAAELPKLAADLPLGELVPAIVAECRQLQQAELVKLLPPEPTPPPPAETAPPQDSYLRIPVSRLDRLGNTVSELLIGQERLTLYQQQFLRANRELKQRLDQFRPIRDQVQTFYDRLATPLGGPGRPTNGHNDFDALEFDRYTELHTALQDFQELLVRIQETGADIDLLSRDLQEALDLNRQHLNSLYAELTNSRLVPFRQLAQMFVTAVQALGDRHHKPVQLVIEGGDTLVDQVILQQLKAPLTHLVRNAFDHGLEPPKQRQQLGKSPTGTIWLRARLRGNAVEIQVADDGRGIDLQRVSQKAVELRLCSAEQVPHLSREQILEFLFVPGFSTAKQVSDLSGRGVGLDVVREQVQRSRGHLQITTEPQRGTTFTLTLPLTLSLLPMVLCQVGELTLAIPDLSIREVIALKEYTDIRHPSATIDWQGQSIPLYPLHQLLPYQRPLSGPTRPLGVGVVVDVAGQAVALAVNYLIAERELVVKPFDQTVPVPPYVMGCTVLGSGEVVPVLAPDNFTVLLRPVEVRASPMESPQQPITPQVLIVDDSITVRRLLDRVLRQAGYNVVQCRDGKEALDFLLAAGDQVSLVITDIEMPRLDGYDLLEAIRLSARLRHLPVAMLTSRGGDTHRQKALQLGANGYITKPFQPQGILQTVTQLLTGRHGGVATLSQ

SEQ ID NO: 4607 - protein, 249 aa, Listeria monocytogenes
MPVISMKQLLEAGVHFGHQTRRWNPKMKKYIFTERNGIYIIDLQKTVKKVDEAFNFMREVASDNGTILFVGTKKQAQESVRDEAIRSGQYFVNHRWLGGTLTNFETIQKRIQHLKKIERMEADGTFEVLPKKEVVLLKKEQEKLERFLGGIKDMKGLPDALFIVDPRKERIAVAEARKLHIPIIGIVDTNCDPDEIDYVIPANDDAIRAVKLLTAKMADAIIEVNQGEELTEAEVAPVEEKATEETTEA

SEQ ID NO: 4608 - protein, 430 aa, Nicotiana alata
MAVIISVKVLLIQLFVLVLGSFSKLSHGYYQAQPFLTLPLPFDLPPAKIPLLPIRGVPSISLVPPPPPPPSPRSPPPPSPSPPPPSPSPPPPTPSPPPPSTLIPFIPPFTGGLLPPLPGSMLPGLLPLIPNLPDVPPIGGGPPVNRPKPSAPSPPVKPPPPPPSPCKPSPPDQSAKQPPPAKQPPPPPPPPPVKAPSPSPAKQSPPPPRAPSPSPATQPPTKQPPPPPRAKKSPPPPPPPPVAYPPVMAPSPSPAAEPPIVAPFPSPTANPPHVPRRPAPPVVKPLPPLGKPPIVNGLVYCKSCNSYGVPTLLNASLLQGAVVKLICYGKKAMVQWATTDNKGEFRIMPKSLTTTDVGKCKVYLVKSPNPNCNVPTNFNGGKSGGLLKPLLPPKQPITPAVVPVQPPMSDLYGVGPFIFEASSKMPCAKN

SEQ ID NO: 4609 - protein, 311 aa, Brassica napus
MSSLVFKLFLFVSLFQISISARKLAQDEPNQFQSLKYHKGALLSGKISINLFWYGKFKPAQRAIISDFITSLSHSSSDQPSVATWWKTTEKYYKLAAGDKTPSPSLSLTLKSQILDETYSLGKSLTDRDIRKLASKGDQYDAVNVVLTSADVAVTGFGMSRCGTHGHARGNAGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGNLLVDTTTGGSFNAYGANGRKFLLPALYDPTTSDCSTMV

SEQ ID NO: 4610 - protein, 909 aa, Unknown
  Bradyrhizobium sp. BTAi1
MTETSFALRIDDQVVDVPAGTTLLEAARQCGIAIPNVCACDRTGYAAEASCRFCLVEIKGERTLAPSCRREAEEGQVVRTSSERVLQTRRLVAELTLSEQGPEALRPGSRLAEALAQVGVGATRFGHRPTIERVTQQHPAITVDLDACIRCGLCRTACQDVQVNGVIGVAGRGAEACIVFDANVPLTDSSCVACGECVQVCPTGALAPVAAPIAETEPTTTAETICPFCSVGCRIELTVADGRVVRADGADGPANRSRLCVKGRFGFDFLHHPDRLTVPLIRRQDAPKHAVAVAGPDAVRDFFRPASWDEALDRAAAGLRAVADRHGADALAVLGSAKASNEDAYILQKLARTVLGTPHVDHCTRLCASVPPLGEAIGYSAVTAPIDEIDRADVVLMVGSNPEVNHPVGATFMKNAVRRGTKLILVDPYRQSFARHATYHLALRPGTDVTLISAMLNVVICEGLYDRTFVRERIDGFDELAARVRGVTPQLAQRLTGVDADLLVSAARMFATAERAMSFWGMGASQHVHGADNIRCVIALALICGHVGKPGSGLHPLRGQNNVQGSCDAGLIPSSFPGYAPVSDPQARARFTALWGTELPAKAGLTQVEILNAAHEGRIRGLYVAGGNPAMANPDLARTREALARLDHLVVQDIFPTETAAFADVILPAAALAERSGSVTNTDRVVQLLTPAVPAPGAARPDWWITAELARRLDAPWRHDALAGLFDEMAAAVPMLAGTSWSMLEGRGALALPLASANGSARSLFAERFPTPAGRARIAALDGRGPAEEPDADYPLILVTGRLLEHWHTGSMTRRAPVLHALAPEPMVRIAADVFDALGLECAARVRVATRRGGVTVAPCRDVGLQAGVIWMPFAYFEAAANDLTNSALDPTTRVPEYKYCAARITSET

SEQ ID NO: 4611 - protein, 334 aa, Capsicum chinense
TSKLFVSFTAINVGLIAFLLTTQCSWREFGAKLLQKSMAPKLDKIIWTMNLGSACCVKVLNLNCSKSFSGPYGEDVLFIANDWHTALIPCYLKSMYQSKGIYMNAKVAFCIHNIAYQGRFSFSDFSLLNLPDEFRSSFDFIDGYEKPVKGRKINWMKAGILESHRVVTVSPYYAQELVSGVDKGVELDNVLRKTSITGIVNGMDTQEWNPATDKYTDVKYDITTVMDAKPLLKEALQAAVGLPVDRNIPLIGFIGRLEEQKGSDILVAAIHEFIGLDVQIVVLGTGKKKFEQEIEQLEVLYPNKAKGVAKFNVPLAHMITAGADFMLVPSRFEP

SEQ ID NO: 4612 - protein, 334 aa, Physalis alkekengi
ASKPFVSFTAINVGLIVFLLTTQCSWRKFGEKLVQKSMAPKLDKIIWIMNLGSVCCVKVLNLNCSKYFSGPYGDDVLFIANDWHTALIPCYLKSMYQSRGIYVNAKVAFCIHNIAYQGRFSFSDFSLLNLPDEYRSSFDFIDGYEKPVKGRKINWMKAGILESHRVVTVSPYYAQELVSGVDKGVELDNVLRKTCITGIVNGMDTQEWNPATDKYTDVKYDITTVMDAKPLLKEALQAAVGLPVDRNIPLIGFIGRLEEQKGSDILVAAIHKFIGLDVQIVVLGTGKKKFEQEIEQLEVLYPDKAKGVAKFNVPLAHMITAGADFMLVPSRFEP

SEQ ID NO: 4613 - protein, 804 aa, Clostridium perfringens
MRKIIHINDQWFYANDYKDEYLKNEFDFSNFERVDLPHTNIELPYNYFDEKSYQFISTYVKTLKFDNSIKGKKVFLDFEGVMIAAEVYLNGIHVGGHKGGYTNFSIDITEALKINEDNVLKVVVDSTERPDIPPHGYVVDYLTYGGIYREVSLRIVEPIFINNLYARAYDCLKEEKRLELDIEINNFEKYRDDLEIVVEFGDDTFEETLSTKLPIEEGTSIKNIEIDQLNMVKLWDIENPNLYEIKVKLLKDSEVIDEYKDTFGFREAEFRQDGFYLNGRRVKLVGLNRHQAYPYVGYAMPQRVQEKDAEILKYELGLNIVRTSHYPQSVHFLRKCDEIGLLVFEEIPGWQHIGDEAWQAESIKNVEEMIKRDYNRPSIVLWGVRINESQDSHDFYVKTNAMAKSLDPIRQTGGVRYLENSDFLEDVYTMNDFIHSGGEKVLRTQSEVTGQADKVPYLVTEYNGHMYPTKSFDQECKKVEHAYRHLRVINESFGLDEISGAIGWCAFDYNTHSSFGSGDKICYHGVSDMFRNPKYAAYSYASQKKVEDGVVLEPITLGAKGERDGGAILPFTVLTNCDYIKIFKDGIYIDTYYPNKEKFPNLPHPPIEVSHILSMDSEIPLTEEAKKEIKDFVLNKLKDSNLTNLAEEDFKYIEEFSERVNIPVFKIMSLVYKLAGGWGDKENSLIIKGFIDNKEVASKEIGELRSMNKLEVTPDDLELSLDKTSYDATRIVVKLLDNLGEVLFLNNDFIEVEIDGPLSIMGPSKFGISGGITAFWVRTQGQTGLCKIKVKSMYFEEEISIEVK

SEQ ID NO: 4614 - protein, 334 aa, Lycium barbarum
ALKLFVSFTAINVGLIVFLLTIQCSWRKFGAKLLQKSMAPKLDKIMWTMNLGSASCVKVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIRKFIGLDVQILVLGTGKKKFEQEIEKLEVLYPDKAKGVAKFNVPLAHTITAGADFMLVPSRFEP

SEQ ID NO: 4615 - protein, 334 aa, Lycium barbarum
ALKLFVSFTAINVGLIVFLLTIQCSWRKFGAKLLQKSMAPKLDKIMWTMNLGSASCVKVLNLNCSKYFSGPYGEDVLFIANDWHTALIPCYLKSMYQSKGIYLNAKVAFCIHNIAYQGRFPFSDFSLLNLPDEYRSSFDFIDGYEKPIMGRKINWMKAGILESHRVVTVSPYYAQELVSGVDKGVELDNVLRKSCITGIVNGMDTQEWNPATDKYTDVKYDITTVIDAKPLLKEALQAAVGLPVDKKIPLIGFIGRLEEQKGSDILVAAIHKFIGLDVQIIVLGTGKKKFEQEIEKLEVLYPDKAKGVAKFNVPLAHTITAGADFMLVPSRFEP

SEQ ID NO: 4616 - protein, 334 aa, Nicotiana tabacum
KLKLFVSFTAINVGLIVFLLTTQCSWRKFGAKLLQKSMAPKLDKIIWTMNLDSACCVKVLNLNCSEYFSGPYGEDVVFIANDWHTALLPCYLKSMYQSRGIYMNAKVAFCIHNIAYQGRFAFSDFSLLNLPDEYKSSFDFIDGYEKPVKGRKINWMKAGILESHRVVTVSPHYAQELVSGVDKGVELDNVLRKTCITGIVNGMDIQEWNPATDKYTDVNYDITTVMDAKPLLKEALQAAVGLPVDRKIPLIGFIGRLEEQKGSDILVAAIHKFIGLDVQIIVLGTGKKEFEQEIEQLEVLYPNKAKGVAKFNVPLAHMITAGADFMLVPSRFEP

SEQ ID NO: 4617 - protein, 458 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKASVDTRQSIDQTRPLSCSKGGSVANPCNKRLMTFTYNYLPTNIHVKRSCLC

SEQ ID NO: 4618 - protein, 72 aa, Oryza sativa
  misc_feature (2)..(2): Xaa can be any naturally occurring amino acid
  misc_feature (4)..(6): Xaa can be any naturally occurring amino acid
  misc_feature (11)..(11): Xaa can be any naturally occurring amino acid
  misc_feature (19)..(19): Xaa can be any naturally occurring amino acid
  misc_feature (50)..(50): Xaa can be any naturally occurring amino acid
YXKXXXITFSXTPVFADPXGPGLRALTLSQIDSDLDLARSTIASKLSNKXFDSNGLSESSRFSYPYNIEIKT

SEQ ID NO: 4619 - protein, 424 aa, Ralstonia solanacearum
MSNTQSFFSQSLAERDAPIRSSLLKELERQQSQVELIASENIVSRAVLEAQGSVLTNKYAEGYPGKRYYGGCEYADEVESLAIDRVKQLFNAGFANVQPHSGAQANGAVMLALTKPGDTVLGMSLDAGGHLTHGAKPALSGKWFNAMQYGVNRDTMLIDYEQVEKLAQEHKPSLIIAGFSAYPRKLDFARFRAIADSVGAKLMVDMAHIAGVIAAGRHDNPVDHAHVVTSTTHKTLRGPRGGFVLTNDEEIAKKINSAVFPGLQGGPLMHVIAGKAVAFGEALKPEFKTYIDSVLANAKALGEVLKAGGVDLVTGGTDNHLLLVDLRPKGLKGTQVEQALERAGITCNKNGIPFDTEKPTITSGIRLGTPAATTRGFGVAEFEQIGRLILEVFEALRANPDGDRATEHRVRSEIFALCDRFPIY

SEQ ID NO: 4620 - protein, 84 aa, Arabidopsis thaliana
MASSMLSSGAVVTSPAQANMVAPFTGLKSSASFPVTRKANKDITSITSKGGRVYVLANGKRGVAGAPIKTGKNKFETLSYPPCP

SEQ ID NO: 4621 - protein, 334 aa, Nicotiana tabacum
KLKLFVFFTAINVGLIVFLSTTQCSWRKFGAKLLQKSMALKLDKIIWTMNLGLACCVKVLNLNCSEYFSGPYGEDVVFIANDWHTALLPCYLKSMYQSRGIYVNAKVAFCIHNIAYQGRFSFSDLSLLNLPDEHKSSFDFIDGYEKPVKGRKINWMKAGILESHRVVTVSPYYAQELISGVDKGVELDNVLRKTCITGIVNGMDIQEWNPATDKYTDVKYDITTVMDAKPLLKEALQAAVGLPVDRKIPLIGFIGRLEEQKGSDILVAAIHKFIGLDVQIIVLGTGKKEFEQEIEQLEVLYPNKAKGVAKFNVPLAHMITAGADFMLVPSRFEP

SEQ ID NO: 4622 - protein, 189 aa, Legionella pneumophila
MTIPDKIKAVYEKSTCLYTSNEVEAALDRMAIKIHETLQDKNPVIICVMVGGLVPLGNLLHRLDFPLEVDYVHATRYRGDLTGGDILWKVRPSSNLAGRTVLVVDDILDGGITLAAIVNEIKAMGAAEVYSAVLVDKYRKRVPNGLQKADFVGLQVEDHYIFGYGMDYHEYLRNAPGIFIVHPDHEASK

SEQ ID NO: 4623 - protein, 325 aa, Xanthomonas oryzae
MPLFPLFANLQGRAVLVIGGGDVATRKVLALLKAEAHIRLYAHALSPELAVLMQAGRFEQLVGEFDPAWIDDVWLVVAATDDTDLNQRVAAAAGARHRLVNVVDDAELSTYQVPAIVDRDPLVIAISSAGAAPMLARRLRERLERELHASVGTLAALFAQHRERIRQRLPDMNRRRRWFDRVIDGQVPQLLQAGETAAAHAAFATALEAVDSVPARGSVQWVGAGPGDPGLLTLNALRALNLADVLLLASDVPAAVVELARRDAQRQPWPATPADQQATLLELIGAGLHVVILRLGSGDAIPAALAAALHAQGAVSARVPGLPVP

SEQ ID NO: 4624 - protein, 404 aa, Nanoarchaeum equitans
MNPKEEALKVLKEADEVANIDVYEYLKEPERVVETYFPARTKNGIEYFKGYRVQYNTALGPAKGGIRFSPTVTKEEVEALALWMVIKNALLGLPFGGGKGGVVVNPKEYEEWELENIARGFVRSIAEFIGEDKDIPAPDVYTNERIMAYMMDEYEKIVRHKAFGVITGKPIILGGNPVRNIATSLGGYYVLNEAVKLKKVENTVAIQGFGNAGQGIAKLLDGQYKIVAVSDSKGGIYCKDGIDIEKLIEVKKKTGSVINYEGCEKITNEQLLELDVGILIPAAIEGVITKQNADKIKAKIILELANGPTTREADKILYEKGVLVLPDVLANAGGVTVSYIEWVGNKRGMPFNEKETKELLKEKMVHAFLDVLEVSNKYNIDMRLASYIIALERVKQAMRYRGLI

SEQ ID NO: 4625 - protein, 416 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKARRWTHGRV

SEQ ID NO: 4626 - protein, 477 aa, Oryza sativa
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRKINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSLIALTLPPPSLAEDTDDSSMDPGAELCQQITVSQLVAAAIARGFARAEVETDMETKIAAKNFEIARLSDRVQYYEAANREMSQRNQEAIELERSKYSLWCVESPRCQRCRGNNEISERRDRSGSGARLGLQLPLAQQPLPGPTYLQRSPKPVKTLIPTAIRAR

SEQ ID NO: 4627 - protein, 376 aa, Corynebacterium glutamicum
MTLSERKLTTTAKILPHPLNAWYVAAWDYEVTSKKPMARTIANKPLALYRTKDGRAVALADACWHRLAPLSKGKLVGTDGIQCPYHGLEYNSAGRCMKMPAQETLNPSAAVNSYPVVEAHRFVWVWLGDPTLADPTQVPDMHQMSHPEWAGDGRTISADCNYQLVLDNLMDLTHEEFVHSSSIGQDELSESEFVVTHTEDSVTVTRWMHDIDAPPFWQKNMNDKFPGFEGKVDRWQIIHYYYPSTICIDVGVAKAGTGAQEGDRSQGVNGYVMNTITPDSDRSSHYFWAFMRNYRLESQTITTQLRDGVSGVFKEDEDMLTAQQDAIDANTDYEFYSLNIDAGGMWVRRILEEALSKEGRLDIPTTFPRATPKPEA

SEQ ID NO: 4628 - protein, 75 aa, Passiflora amethystina
GTNGEVMPGQWEYQVGPSVGIDAGDHIWCSRYILERITEQAGVVLTLDPKPIEGDWNGAGCHTNYSTSSMREDGG

SEQ ID NO: 4629 - protein, 313 aa, Heteromeles arbutifolia
GGLGDVLGGLPPAMAANGHRVMTISPRYDQYKDAWDTEVTVELKVGDKTETVRFFHCYKRGVDRVFVDHPLFLERVWGKTASKVYGPVAGVDFKDNQLRFSLLCQAALEAPRVLNLNSSKYFSGPYGEEVVFIANDWHTALLPCYLKAVYKARGVYGIAKVAFCIHNIAYQGRFAFADFALLNLPDEFKSSFDFIDGYEKPVKGRKINWMKAGILESDKLLTVSPYYAEELVSAVEKGGELDNIIRKTGIFGIVNGMDVQEWNPSADKYTTIKYDASTVAYAKPLLKETLQAEVGLPVDRDIPVIGFIGRLEE

SEQ ID NO: 4630 - protein, 313 aa, Lindleya mespiloides
GGLGDVLGGLPPAMAANGHRVMTISPRYDQYKDAWDTEITVELKVGDKTETVRFFHCYKRGVDRVFVDHPLFLEKVWGKTASKIYGPVAGVDFKDNQLRFSLLCQAALEAPRVLNLNSSKHFSRPYGEEVVFIANDWHTALLPCYLKARYKTKGIYKTAKVAFCIHNIAYQGRFAFADFALLNLPDEFKSSFDFIDGYDKPVKGRKINWMKAGILESEIVLTVSPYYAKELVSSVEKGVELDNIIRITGICGIVNGMDVQEWNPLTDKYTTVKYDASAVADAKPLLKEALQAEVGLPVDRDIPVIGFIGRLEE

SEQ ID NO: 4631 - protein, 313 aa, Lindleya mespiloides
GGLGDVLGGLPPAMAANGHRVMTVSPRYDQYKDAWDTSVQVEIEVGGRVETVRFFHCYKRGVDRVFVDHPLFLERVWGKTGSKIYGPRAGVDYKDNQFRFSLLCQAALEAPRVLNLNSNKYFSGPYGDDVVFIANDWHTALLPCYLKTIYEPKGIYENAKVAFCIHNIAYQGRFPFSDFSHLDLPDNLKGSFDFFDGYNKPVKGRKINWMKAGILESDRVVTVSPYYAQELVSGEDKGVELDNIIRKTGITGIVNGMDVQEWNPATDKYLDIKYDNTTVLDAKPLLKESLQAEVGLPVDRNIPVIGFIGRLEE

SEQ ID NO: 4632 - protein, 57 aa, Passiflora antioquiensis
WEYQVGPSVGIDAGDHIWCSRYILERITEQAGVVLSLDPKPIEGDWNGAGCHTNYST

SEQ ID NO: 4633 - protein, 313 aa, Lindleya mespiloides
GGLGDVLGGLPPAMAANGHRVMTVSPRYDQYKDAWDTSVLVEIEVGGRVETVRFFHCYKRGVDRVFVDHPLFLEKVWGKTGSKIYGPRTGLDYADNQFRFSLLCQAALEAPRVLNLNSNKYFSGPYGDDVVFIANDWHTALLPCYLKTIYRPKGIYKNAKVAFCIHNIAYQGRFPFSEFSLLDLPDTLKGSFDFIDGYDKPVKGRKINWMKAGVLESDRVVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 4634 - protein, 612 aa, Carboxydothermus hydrogenoformans
MCGIAGMISFSKDLSPFVPLLEKMTQSLTHRGPDALGIWHSENIILGHRRLAVIDPERGRQPMIRTFGDWQYVIVYNGELYNTKELRDELEARGHHFYTTCDTEVLLVSYIEWGKECLSKLNGIFAFAIFDEKENQLFLARDRLGVKPLFYALVNDTLIFASEIKTLLLHPDIPSRLSTDGLKEVLFLGPARTPGMGVFAHISELLPGDYAVFNPEGLFIKPYWRLTSNPHPDDFPTTVKKTRELLEDAVIRQLVSDVPICTLLSGGLDSTVITAFAASHLHSRGETLNTFSVDYAENELYFTESAFQPNCDAMFIPLVAKEFNTLHRNIVLTQEELFEALFPALIARDLPGMVDIDSSLWLFSREIKKEATVGLSGECADEIFGGYPWFFRKEALEAKTFPWALSLDRRKTLFRQDLIAELKPDEYVQKRYHEALEEIPEISGLSPEEKRLREITYLTLTRWMPILLDRKDRMTMAWGLEVRVPYCDHRLVEYLWNVPWHFKTAGGQEKGLLRQAVADLIPDYILKRKKSPYPKTHHPLYTKLVREALTQILAENSSPINFLIDENEVRKLITNPSPPNARPWFGQLMGDTQIMAYLIQLNYWFKKYHISF

SEQ ID NO: 4635 - protein, 519 aa, Triticum aestivum
MEAPHIHPPMDVHEPAPPSPLFSDISPHFPLSIADAGAGALDLSFTSTASASTSSFTTATTFSARSSLSLPSFSSSTSLSPRPHSSSTSQHWTHLAAARAATPDGVLRLAHLHLVRELGQGHLARVFLCRLKSSPPASPLFALKVVDLRDDDPSRVCHVLAESRVLSSLDHPFVPTLYARLDAGRYACFLMDYCSGGDLHSVLRRRPGGRLPVAAARFYAAEVLLALEYLHVLGFVYRDLKPENVLLRGDGHVVLSDFDLALPASVEPAVRRRQVRQQSQRRKRSLLPSCFSSNRGSDEDDVDAKERFEFVAEPTAANSKDCVGTHEYLAPELVSGNGHGNGVDWWAFGVFLYELVYGRTPFKGPAKDVTLKNILSKQVTYPKLDGEAEAAAQLKDLVGRLLERDPRRRMGSARGAAEIKRHPFFAGVDWALIRCVTPPVVPEADAAAAASPASAARQAKLGSWNSLGGSSFKKSSSFKKSSSFGRRSSYEERQGVFRKLMSWNHESRSKKTKTSRMKP

SEQ ID NO: 4636 - protein, 206 aa, Thiomicrospira crunogena
MARSKSSAGWLKEHFDDYYVNKAKQDGWRSRAIYKLQEIDEKDQLFSKGMTVIDLGAAPGGWSQWTTHQTGDEGRVFALDILPVEPFAGVTFIQGDFQEDDVYQSLLDALDGREVDLVMSDMAPNMTGNKGVDIPRAMYLVELCVDLADQVLKPNGDLLMKVFQGEGYDQLLKSLREKYQKVLTRKPKASRPRSKEIYLLARGKKA

SEQ ID NO: 4637 - protein, 313 aa, Lyonothamnus floribundus
GGLGDVLGGLPPAMAANGHRVMTVSPRYDQYKDAWDTSVLVELEVGGKIETVRFFHCYKRGVDRVFVDHPLFLERVWGKTASKIYGPRAGVDYKDNQLRFSLLCQAALEAPRVLNLDSNKYFSGPYGEDVVFIANDWHTALLPCYLKTIYKPKGIYKNAKVAFCIHNMAYQGRFSFSDFSLLDLPDQLRGSFDFIDGYNKPVKGRKINWMKAGILESDRVVTVSPYYAQELVSGEDKGVELDNIIRKTGITGIVNGMDVQEWNPATDKYLDVKYDNTTVLDAKPLLKEALQAEVGLPVDRDIPLIGFIGRLEE

SEQ ID NO: 4638 - protein, 438 aa, Zea mays
MGRLSGSGSRKPPPFLSPSSSFSSSSYSKRSRTVRRLPSLPRPPLAPPAPHPAGRTRRRKAPARLWMRMDRWGRCEVFMTNGAFVAERSGVHARDLRIVGPLLSRCPGILAREKAMVIDLEFIRAIVTADEVLLLEPLAQEVIPFIDKLRRHFPLKSLEVDVGATQVGNVNGKHAKTAAECELPLPFEFQVLELALEAVCLSFHSSLSDLNRHTIFVMDELTKNVSTRNLERVRSLKRNLTSLLAGVQKVRDEVEHLLDHNENMAQLHLSRKQIKCPQDEILLASAALNSNLPSKTKLGTPNSVVNQAMGIAMTAPLADNVGDLEILLESYFMQLDGIRNRIMMVRGYIVDTEDYINIQLDNQRNELIQFHLVLIIVSFGIAMNTLIAGAFAMNMPHNGEMKKFVGPFWPFVGATSSFCLLVSVVLLGYARGNRLLGS

SEQ ID NO: 4639 - protein, 86 aa, Oryza sativa
  misc_feature (53)..(53): Xaa can be any naturally occurring amino acid
  misc_feature (60)..(60): Xaa can be any naturally occurring amino acid
MGPMAMTGASLLKTSFAGARLPGAARKPTVSVAPRTGGVICNSISSSGSTPSXDLNAIRXRPIKACIVCREMTTRYVTDMSHLLPT

SEQ ID NO: 4640 - protein, 305 aa, Carboxydothermus hydrogenoformans
METRELVIIGGGPAGLAAAIYGARAALNPLVLERGVPGGQAATTEWIENYPGFEDGIGGFELMVHMQRQAEKFGAEFKNADVTGIKKENGVFILNTSTGEIAAKTVIIATGAEPKELGVPGEREFRGRGVSYCATCDGNFFRGKTVAVVGGGDSALEEAIYLTKLVEKVYLIHRRDGFRAAKVIQERAKANPKIEFVLNTVVEEIAGERKVEKVIVKNVQTGEKSEILVDGVFIYVGLKPNTAFLEGFLELENGYIKTDENMATAIPGLFAAGDVRLKDLRQVVTAVADGAQAAVAAEKYLEGNK

SEQ ID NO: 4641 - protein, 483 aa, Gloeobacter violaceus
METSALQSGAQATHEKPSIGLIGLAVMGENLALNIANHGFPISVYNRTAAKTQELAEGRARGKALYPTFTMEEFVASMERPRKIIILVKAGAPVDAVIDQLKPLLEKDDVIIDGGNSLFTDTEKRSGEIEALGLRFVGMGVSGGEEGALKGPSLMPGGPKTAYDDLAPILTQIAAQVDDGPCVTYIGPRGAGHYVKMVHNGIEYGDMQLIAEAYDLLRQTLGLGAAELHDIFAEWNAGELKSFLIEITADIFTKIDPETGKPLVDLILDKAGQKGTGKWTSQNAYDLGIPIPTINAAVESRILSAYKSERVAASKILSGPERPPFTGEKKQFIDAVRDALYCAKICSYAQGMALLKAASHEYDYHLNLSELARIWKGGCIIRAIFLDKIKNAFLRDPALTNLLIDSEFSGDIQARQANWRYAVQTAAQLGIPAYATGASLAYYDAYRTAQLPLNLTQAQRDYFGAHTYERIDKEGVFHTEWFS

SEQ ID NO: 4642 - protein, 686 aa, Methanocaldococcus jannaschii
MHKNKNLKELGETMEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLCHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 4643 - protein, 240 aa, Wigglesworthia glossinidia
MLNLSMKDMIQSGVHFGHQTRYWNPNMKPFIFCKKNKVHIINLEKTLIMFEIAMNELSKISKRDGKILFIGTKRAASEAIKNSAINCNQFFVNYRWLGGMLTNWKTVRQSIKRLKELESQSKDGTFKKLTKKEALIRTRTLNKLENSLGGIKNMGGLPDAIFVIDVEHEKTSIKEANKLGIPIFAIVDTNSNPKDIKFVIPGNDDSIRAIDLYLKTVSETIKNSKISNKEINKKIIIKNN

SEQ ID NO: 4644 - protein, 444 aa, Unknown
  Synechococcus sp. RS9916
MTRSPSARPLPTTGAITGVGEAIAFFRNADFAQQRFERLGDVFETKLIGQRLVFIRGDAAISDLLGQAEAVEGWWPESVRRLLGSRSLANRNGAAHKARRRVVGQLFSSAALQRYSPRIVEQVNALAQDLLNSTHTPIPLAERMRRFAFSVIASTVLGLDDNDRDALFGDFEIWTRALFSVPLAIPGTAFAKALAARERLLIRLKEVLAKADGSRGGLDLMTGGLDEAGLPLSDDDLVEQLLLLLFAGYETTASSLSCLMRELLLQPTVDQWLREETNALAWPPHDAEAAMAYDSQRAPRLNAVVQEVMRMTPPVGGFFRRTTGAVTLAGVEVPAGSVIQVALAASNRHGAGDLDAFRPSRHLEPGNGGPTLMPFGGGERVCLGKALAELEIRLMVVGLLQQVDLELTPDQDVSLQLIPSPTPRDGLRVRATADHERHPSLKTD

SEQ ID NO: 4645 - protein, 416 aa, Actinobacillus pleuropneumoniae
MNIQDYDPILWQAIENENRRQEEHIELIASENYASPRVMQAQGSQFTNKYAEGYPGKRYYGGCEYADIVEQLAIDRAKQLFGADYVNVQPHSGSQANAAVYGALIQPNDTILGMDLAHGGHLTHGAKVSFSGKIYNSVLYGITAEGLIDYEDVRQKALECKPKMIVAGFSAYSQIVDWAKMREIADEVGAYLFVDMAHVAGLIAAGVYPSPLPYAHVVTTTTHKTLGGPRGGLILSACGDEEIYKKLQSSVFPANQGGPLVHIIAAKAVCFKEALEPEYKIYQQNVVKNAKAMVEVFKQRSYEVISNGTENHLFLVSFVKQGLTGKAADAALGQANITVNKNSVPNDPQKPFITSGIRIGTPAVTRRGFKEADVQALAGWMCDVLDSIGKDNHEQVIAETKAKVLDICARLPVYAK

SEQ ID NO: 4646 - protein, 229 aa, Zea mays
KELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFRGRTAEEMAEAARQAVAALETLEQAFRECSKGKAFFGGDSVGLVDVVLGGLVGWLYATEAICGVKALDAGRTPLLAAWAERFCALEGVKGLIPDVDRLLEYTKARRAVFGLPPLRP

SEQ ID NO: 4647 - protein, 102 aa, Glycine max
  misc_feature (50)..(50): Xaa can be any naturally occurring amino acid
  misc_feature (55)..(55): Xaa can be any naturally occurring amino acid
MEGGPGRCYRQIKNKPYPKAMYCREVPDPKIRIYDDGMNRKGVDENPYCXHLVNXEKENVSIDAHKAACIACIKYMTNSEGKDAYHLPVRVHPLHVHGINKM

SEQ ID NO: 4648 - protein, 305 aa, Unknown
  Saccharum hybrid cultivar H32-8560
  misc_feature (22)..(22): Xaa can be any naturally occurring amino acid
  misc_feature (25)..(25): Xaa can be any naturally occurring amino acid
  misc_feature (27)..(27): Xaa can be any naturally occurring amino acid
  misc_feature (57)..(57): Xaa can be any naturally occurring amino acid
  misc_feature (67)..(67): Xaa can be any naturally occurring amino acid
  misc_feature (139)..(139): Xaa can be any naturally occurring amino acid
  misc_feature (142)..(143): Xaa can be any naturally occurring amino acid
  misc_feature (149)..(149): Xaa can be any naturally occurring amino acid
  misc_feature (160)..(160): Xaa can be any naturally occurring amino acid
  misc_feature (175)..(175): Xaa can be any naturally occurring amino acid
  misc_feature (180)..(180): Xaa can be any naturally occurring amino acid
  misc_feature (225)..(225): Xaa can be any naturally occurring amino acid
MQIFVKTLTGKTITLEVESSDXIDXVXAKIQDKEGIPPDQQRLIFAGKQLEDGRTLXDYNIQKESTXHLVLRLRGGMQIFVKTLTGKTITLEVESSDTIDNVKAKIQDKEGIPPDQQRLIFAGKQLEDGRTLADYNIQXESXXHLVLRXRGGMQIFVKTXTGKTITLEVESSDTXDNVKXKIQDKEGIPPDQQRLIFAGKQLEDGRTLADYNIQKESTLHLVLRXRGGMQIFVKTLTGKTITLEVESSDTIDNVKAKIQDKEGIPPDQQRLIFAGKQLEDGRTLADYNIQKESTLHLVLRLRGGQ

SEQ ID NO: 4649 - protein, 381 aa, Unknown
  Saccharum hybrid cultivar H32-8560
  misc_feature (119)..(119): Xaa can be any naturally occurring amino acid
  misc_feature (210)..(210): Xaa can be any naturally occurring amino acid
  misc_feature (271)..(271): Xaa can be any naturally occurring amino acid
  misc_feature (286)..(286): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIFAGKQLEDGRTLADYNIQKESTLHLVLRLRGGMQIFVKTLTGKTITLEVESSDTIDNVKAKIQDKEGIPPDQQRLIFAGKQLEDGRTLAXYNIQKESTLHLVLRLRGGMQIFVKTLTGKTITLEVESSDTIDNVKAKIQDKEGIPPDQQRXIFAGKQLEDGRTLAXYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 4650 - protein, 124 aa, Aggregatibacter actinomycetemcomitans
MSSSVPSLGAFLAKVEQRDGNQPEFLQAVREVFTSIWPFLEQNPKYCSEALLEALVEPERAIQFRVAWTDDKGQVQVNRAFRIQFKSAIGPFKGGMRFHPSVNQSILKFLGFEQIFKNALTTFA

SEQ ID NO: 4651 - protein, 257 aa, Salmonella enterica
MSETFDPRCVWFVGAGPGDRELITLKGYRLLQQAQVVIYAGSLINTELLDYCPAQAERYDSAELHLEQIIELMAAGVKAGKTVVRLQTGDVSLYGSVREQGEELTRRGIDWQVVPGVSAFLGAAAELGVEYTVPEVSQSLIITRLEGRTPVPAREQLEAFASHQTSMAIYLSVQRIHRVAERLIAGGYPATTPVAVIYKATWPESQTVRGTLADISDKVRDAGIRKTALILVGNFLGKEYHYSRLYAADFSHEYRKA

SEQ ID NO: 4652 - protein, 378 aa, Unknown
  Nostoc sp. PCC 7120
MNFELERSDLTKTIVVKIGTSSLTQPETGQLALSTIATLAETLSHLRQQGNRVILVSSGAVGVGCARLGLTERPKAIALKQAVAAVGQGRLMRVYDDLFTTLQQPIAQVLLTRSDLVQRSRYLNVYNTFRELLALGVIPVVNENDTVAVDELKFGDNDTLSALVASLVEADWLFLLTDVDRLYSADPRSVPDARPISLVTSIKELADLQVQTGSQGSQWGTGGMMTKISAARIAIAAGVRTVITQGRYPRNIEKIIQGELIGTHFQPQPEPTSARKRWIAYGLVPVGKLYLDSGAIAAIVKAGKSLLPAGVKTVAGEFEPQDAVQLCDPQGNEIARGLVNYSSNDLQKICGRHSKEIPTILGYVGAETVIHRDNLVLT

SEQ ID NO: 4653 - protein, 66 aa, Ustilago maydis
MAHADHTRDPCPWVILNDFGGAFAMGAVGGTIWHGIKGARNSPRGERLPGSLSAIKARAPACSCKG

SEQ ID NO: 4654 - protein, 208 aa, Oryza sativa
MVPPCAQVVVSCVHRARKTREIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 4655 - protein, 622 aa, Streptomyces griseus
MCGIAGWVVRQDGRPREDPAVAEAMAGAMACRGPDEQGVRGGRHVTLVHTRMAVIDLLGGRQPMAADESEDPAATLTYCGEIYNAAELRSDLAGRGHRFRTRSDTEVVLRAYLEWGERCPERLEGMFAFAVWDARTRSLFLARDRFGVKPLYYAETGDGLVFGSEPKALLVHSDVSPEVDLDGLRVLFSMARAPGECVYRSLSDLPPAHTLRFGPDGRLSLRRYWQLEARPHEEDLAGTVATVRGLLESSVARELVSDVPLSVLLSGGLDSSTVAALAARALADGDGGPVRTTTVTYSGYGDNFQPDLVRSAPDSPYARAVAEHIGAEHLEIELTTADLIDPVARRTVLRAQDVPAPFGDMDTSTYQAFAGVRRHSRVALTGESADEIFGGYSWVHIPDLAHEEQFPWVAFEQWHPGTRRGLGQGLLSPAFKDRLDMGSYYAERYAQAMSRIPRLPREGEEERRAREICDLHLTHWLPRLLERNDRLSMVSGLEVRVPFCDHRLVQYAYNIPWAMKTFDGREKSVLRAAARDLLPERVLDRPKAPFPVSQDATYTKALHQELTEVLADPASPVLPLLDLEAARAVVAREGGADLQDWLHRMNVEMVLQVDAWLRELGGDVEL

SEQ ID NO: 4656 - protein, 99 aa, Brassica napus
MAAARSLSGAVKSLCSAASHNISGSIVLRRSYVATVPGFGKGGSTRVTVGKMEQRANQEAESAWAPDPVTGYYRPSNRADEIDPAELREMLLKNKAKPF

SEQ ID NO: 4657 - protein, 453 aa, Thiomicrospira crunogena
MTDKIVEKVAVQSDESRNQGRRAFLKGSAAVAGGVLFTKAASAAEGAKYDPAKAVAPYAGKEEMTDVLDVQAARKSLGFGVRKYPYGMPSPYEKEVQRRTLEWLTPDSMASITMTPLQSLHGIITPNGLHFERFHGGVPTIDPDKHRLVIHGLVERPLIFTMDDLKRFPSISRIHFVECPANGAMEWKGVQLNSVQWTHGMMSCVEYTGVRLSDLLKEAGIKPEGKWILPEGADASGMSRSIPVDLAMDDCFVAYAQNGEALRREQGYPIRLVVPGCEANMWVKYLRRIYVHDVPMQHREETSKYTELMPDGTAQRFSWYMEANSVITYPSPDFKMQGPGKYFVRGLAWSGRGKVAHVDVSFDGGKNWKEAHFTSPVLDKAWTRFEIEWDWDGSEAFMMSRVTDETGYVQPPMPQMRKLEGTNNVYHRTAMVTWRIHAWDGGKNGGMIENVQY

SEQ ID NO: 4658 - protein, 259 aa, Glycine max
  misc_feature (169)..(169): Xaa can be any naturally occurring amino acid
MANAIIMPGFLLRPTTQTTPFRLPNHTHSFHSPRCSLSLTPQSAKAFAVPRRKALSLILSSYFLSEAGLALAQQSPVFREYIDAFDGYSFQYPGSWIQVRGAGADIFFRDPFVLDENLSLEISSPSSSQYKSVEDLGPPQEAGKKVLKQYLTEFMSTRLGVRRESNILXSTSSRVADDGRLYYQVEVNIKSYANNNELAVMPEARVVRLEWDRRYLSVLGVENNQLYELRLQVPENVFSEEENDLRRIMDSFRVNKIAA

SEQ ID NO: 4659 - protein, 59 aa, Passiflora arborea
MPGQWEYQVGPSVGIEAGDHIWCSRYILERITEQAGVVLTLDPKPIEGDWNGAGCHTNY

SEQ ID NO: 4660 - protein, 313 aa, Malacomeles denticulata
GGLGDVLGGLPPAMAANGHRVMTISPRYDQYKDAWDTEVTVELKVGDKTEPVRFFHCYKRGVDRVFVDHPLFLEKVWGKTASKIYGPTAGVDFKDNQLRFSLLCQAALVAPRVLNLNSCKYFSGPYGEEVVFVANDWHTALLPCYLKAMYKPKGIYKTAKVAFCIHNIAYQGRFAFADFALLNLPDEFKSSFDFIDGYDKPVKGRKINWMKAGILESDKVLTVSPYYAEELVSSVEKGVELDNIIRKTGILGIVNGMDVQEWNPLTDKYTTVKYDASTVADAKPLLKEALQAEVGLPVDRDIPVIGFIGRLEE

SEQ ID NO: 4661 - protein, 187 aa, Glycine max
HSLTWDENLWSSNQQQLHHHVQFAFSVCFLFPLQSCQNLLNRLGFGSARAPENMDSSIPQGPDDDIPAPGQQFAEFGAGCFWGVELAFQRVPGVTKTEVGYTQGLVHNPTYEDVCTGTTNHSEVVRVQYDPKICSYETLLDVFWARHDPTTLNRQGNDVGTQYRSGIYYYTPEQEKAAKESLEQQQK

SEQ ID NO: 4662 - protein, 59 aa, Passiflora aurantia
MPGQWEYQVGPSVGIDAGDHIWCSRYILERITEQAGVVLTLDPKPIEGDWNGAGCHTNY

SEQ ID NO: 4663 - protein, 313 aa, Malacomeles denticulata
GGLGDVLGGLPPAMAANGHRVMTVCPRYDQYKDAWDTSVLVEIEVGGRVETVRFFHCYKRGVDRVFVDHPLFLEKVWGKTESKIYGPRTGVDYMDNQFRFSLLCQAALEAPRVLNLNSNKYFSGPYGDDVVFIANDWHTALLPCYLKTIYKPKGIYKNAKVVFCIHNIAYQGRFTFSDFSLLDLPENLKGLFDFIDGHSKPVKGREIDWMKAGILESDRVVTVSPYYAQELISGEDKGVELDNIIRKAGISGIVNGMDVQEWNPAADKYLDIKYDNTTVLDAKPLLKEALQAEVGLPVDRNIPVFGFIGRLEE

SEQ ID NO: 4664 - protein, 359 aa, Arabidopsis thaliana
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVNSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 4665 - protein, 59 aa, Passiflora auriculata
WEYQVGPSVGIEAGDHIWCSRYILERITEQAGVVLTLDPKPIEGDWNGAGCHTNYSTQS

SEQ ID NO: 4666 - protein, 313 aa, Malus sargentii
GGLGDVLGGLPPALAANGHRVMTVSPRYDQYKDAWDTSVLVEIEVGGRVETVRFFHCYKRGVDRVFVDHPLFLEKVWGKTGSKIYGPRTGVDYMDNQFRFSLLCRAALEAPRVLNLNSNEYFSGPYGDDVVFVANDWHAALLPCYLKTIYKPKGIYKNAKVVFCIHNIAYQGRFPYSDFSLLDLPDNLKGSFDFVDGHDKPVKGRKINWMKGGILESDRVVTVSPYYAQELVSGEDKGVELDNIIRKTGITGILNGMDVQEWNPATDKYLDIKYDNTTVLDAKPLLKEALQAEVGLPVDRNIPVFGFIGRLEE

SEQ ID NO: 4667 - protein, 280 aa, Unknown
  Nocardioides sp. JS614
MTSGDGSRTNRLRVALLQVAYGDDESLSDRVQRVSQWIREVGPADLVVLPELWAHGGFASTTWRATAELMNGPTIAQMASVAREVGVWLHAGSIIERAEDGADRGAERRGLWNTSVLISPQGTVHKTYRKIHRFGFGDGEPRVLEAGTDLAVAELVHDTGASRVGMATCYDLRFPELFRRLGDLGADVIVLPAAWPMRRVEHWRLLGRARALENQAWVLQCNTAGTHSGLDMGGHSQVVAPTGEVVAELGSDEDVLLTDIDLNLVASVRADFPVLADRRI

SEQ ID NO: 4668 - protein, 59 aa, Passiflora auriculata
WEYQVGPSVGIEAGDHIWCSRYILERITEQAGVVLTLDPKPIEGDWNGAGCHTNYSTKS

SEQ ID NO: 4669 - protein, 313 aa, Mespilus germanica
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFHFSLLCQAALEAPRVLNLNSNKYFSGPYGDDVLFIANDWHTALLPCYLKAIYKPRGIYENAKVVFCIHNIAYQGRFPISDFSVLDLPENLKGSFDFIDGYNKPVKGGKINWMKAGILESDRVVTVSPYYAQELVSGEDKGVELDNIIRKTGITGIVNGMDVQEWNPATDKYLDTKYDNKTVLDAKPLVKEALQAEVGLPVDRNIPVIGFIGRLEE

SEQ ID NO: 4670 - protein, 613 aa, Kineococcus radiotolerans
MRPERSQETRHPREPPLRRPWAGGRTGSRSSARPRRRRCAPPQRCSSSGGSCTGWGSPGPRCSTPSRSWLCSPARPCCCSGCTPAPDAVRRGHLRTGPEPGVPPPAAPGRPPRCGRPREGDPPVPGAGGRWCRYCVPRCAGKSGRRSLQRSVKSSTREQTPVTSPTPHDPTPPTPPRGSTPLFSRGSWLETRRITDVLRKETIGGALLLLGTVVALVWANSPWSSSYAGLRDTVIAPSLLHPLHLDLTLGQWAADGLLAIFFFIAGLELKREFVAGDLRDPRRALVPVAAAVGGMAVPAVVYVLVARSAGDGALNGWAIPTATDIAFAVAVLAVISTHLPTALRTFLLTLAVVDDLLAITIIAIFYTDTLAVLPLLGALAVIAVFGLLVQKRIRSWWLLIPLAVVAWALMHASGIHATVAGVLLGFTVPVLRSRAAGGPEAGPGMAEHFEHVWRPLSAGFAVPVFAFFSAGVTVGGLSGLVDSLQDRVALGIVAGLVVGKAAGILGATAAVSRFTRARLDPSLSWWDVLGASLLGGIGFTVSLLIGELAFGAGSVRDEHVKVGVLTGSLLAAALAAVVLRARNRVYRRLHEAERVDEDADGVPDVYQAPRLNG

SEQ ID NO: 4671 - protein, 237 aa, Brassica napus
MGSYSIASAISRVSVSPLNRFVKLYSTAFSYINCPCNRALRPKRFDQLRVFSMASEAKESAANNPGLSTVRDEATKGYIMQQTMFRVKDPKASLDFYSRVLGMSLLKRLDFSEMKFSLYFLGYEDTSTAPTDPTERTVWTFGRPATIELTHNWGTESDPEFKGYHNGNSEPRGFGHIGVTVDDVHKACERFEQLGVEFVKKPNDGKMKNIAFIKDPDGYWIEIFDLKTIGTTAGNAA

SEQ ID NO: 4672 - protein, 384 aa, Nitrosomonas europaea
MNQPSVVVVGSGLAGYTVVRELRKLDAAVPITLLSADHGSFYSKPMLSNALATGKTPDSILSAGTMQMSGQLDITVRPYTSVNAIDVAAGSVSFEEGGQLTYDRLVLALGADPIRLPIPGEGVDEILSVNNLDDYRKFREALESKRHIAILGAGLIGCEFANDLAAKGYQVSVFDLSPQPLGRLLPPEAGRFFRDKLTAAGVNFLLGTTVERVSKENGYYQLFYEGGKVVQADMILSAVGLRPRTRLAAVAGIQVNRGIAVNRYLQTSIQNIYALGDCAEVEGKVLPFILPIAHAGRALAATIAGNPTLLHYPAMPVMVKTPACPTVVSPPDPAVQGEWEVVAIENGMKALYHDEAGNLHGFALLGTATVERNTLASRLPPVLA

SEQ ID NO: 4673 - protein, 55 aa, Passiflora biflora
WEYQVGPSVGIDAGDHIWCSRYILERITEQVGVVLTLDPKPIEGDWNGAGCHTNY

SEQ ID NO: 4674 - protein, 313 aa, Mespilus germanica
GGLGDVLGGLPPAMVANGHRVMTVSPRYDQYKDAWDTSVQVEIEVGGRVETVRFFHCYKRGVDRVFVDHPLFLEKVWGKTGSKIYGPSAGVDYLDNQFRFSLLCQAALEAPRVLNLNSNKYFSGPYGDDVVFIANDWHTALLPCYLNTIYKPKGIYKNAKVVFCIHNIAYQGRFPFSDFSLLDLPDDLKGSFDFIDGHNKPVKGRKINWMKAGILESDRVVTVSPYYAQELVSGEDKGVELDNIIRKTGITGILNGMDVQEWNPATDKYLDIKYDNTTVLDAKPLLKEALQAEVGLPVDRNIPVFGFIGRLEE

SEQ ID NO: 4675 - protein, 416 aa, Fulvimarina pelagi
MRIVVVGAGHAAVQLVTSLRQDGFEGTLTMVGDEPHLPYQRPPLSKTFMKDGDASRLLLKPESFFASNQIEVIKGTRVTEIDRANKHIVTDRDDTIGYDRLVLAIGAENVRPPLTGADHPALLELRTLAHAETIRERLAVAKQAIVIGGGFIGLEFAAMAALQRVTSTVTEASSRLMARAVSPAISAHFLDFHRSIGNTVLLDAPVAEIAGSNEGRIESVRLADGQSLAGELVLLAAGVKPSTTLAEKAGLQCRNGIVVDGQLTTDDPAIFAIGDCAAVLTIDGIHQRLESVQAATDQAKHLSRYLAKGEGGTSYHAVPWFWSDQGDQKLQIAGLPSAANYFEARPGDGSCLTVLGYRDDHLVSVETVNAAGDHMAARRLLALPGSLTRARIEADGHDLRAIAKSMAPPTLRRARA

SEQ ID NO: 4676 - protein, 421 aa, Carboxydothermus hydrogenoformans
MTRGITIGIIIVALTLLAGTFVAYITAKNDVPYRTLTTGFKKDEIKPEKYGQKFPVEYKYYLKNKEMALAPSKYGGSVKRDHLKEFPYMKTLWAGFAFSKDYTEDRGHVYALEDVKETKRISEKTALACMTCKSSQVPVYMDKWGVDNFYKARFREKQNLFTIPIGCYDCHDAQTMKLRITRPALKDALKRIGRDPEKFTEKELKNYICAQCHVTYYIDKATNRVIFPWDGGVDPEDMYRHYEKRNFYEWVHPLSGTKMLKSRHPEFEMFSGSVHSAVGLTCVDCHMPYVYEGGKKYSSHWWTSPLRTLEQSCRKCHREEEAKLRERVFYIQDRTYDLLNRAGKANEEAIKAINEAVYSPGADKALIEKARKLHREAQWYWDYVSSENSMGFHNPEKALTTLGKSIDLALRAKATALQAKK

SEQ ID NO: 4677 - protein, 176 aa, Unknown
  Shewanella sp. MR-4
MKHTTEVMISAEEISQKLDQMAEQINAHYANSERLLMVGLLKGSVVFMADLCRRIKGHVEIDFMSVSSYGNAMTSSRDVKVLKDVQSDIAGRDVLIVEDLIDSGNTLNKVREMLLLREPKSLALCTLLDKPERREVDVKVDFIGFTIPDEFIVGYGIDYAEQYRNLPYIAKVVPLE

SEQ ID NO: 4678 - protein, 213 aa, Glycine max
MAVLPSSSSSLELTISVPGFASSPTLLPSSSVKELDINQVPLEEDWMASNMEDEEESSNGEPPRKKLRLTKEQSLLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 4679 - protein, 173 aa, Chlamydomonas reinhardtii
  misc_feature (34)..(34): Xaa can be any naturally occurring amino acid
  misc_feature (39)..(39): Xaa can be any naturally occurring amino acid
SLYPLLREVSIGTDPYEVFGDADWALMIGAKPRXPGMEXADLLQQNGEIFQVQGRALNESVSRNCKVLVVGNPCNTNALIAMENAPNIPRKNFHALTRLDENRAKCQLALKSGKFYTSVSRMAIWGNHSTTQVPDFVNARIGGLPAPDVIRDMKWFREEFTPKVALRGGALIK

SEQ ID NO: 4680 - protein, 129 aa, Nitrosomonas europaea
MRILHTMLRVGNLERSIRFYTDVLGMQILRRKDYPEGKFTLAFVGYQSETEGTVLELTHNWETDHYDLGTGFGHIAIEVDNAYEACEKVRNLGGRVTREAGPMKHGATVIAFIEDPDGYKIEFIQKKTA

SEQ ID NO: 4681 - protein, 591 aa, Fulvimarina pelagi
MCGICGEIRFDGENASPERVQRMGDCLARRGPDGSGQVMRGRVGLAHRRLKIIDLSEKAEQPMVDPVLGLTIAFNGCIYNYPELKKELEAKGYTFFSTGDTEVIVKAYHAWGRDCVKRFHGMFAFAIHERETGRVMLARDRFGIKPLYLSQNDKRLFIGSSLQSILKSGDVDTGIDKVALHHYMTFHAVVPPPHTILKGVRKLPPATTRMIEADGTYDDEVFWWPEFAPKSGDEKLTSDDWRDMVMEAMKLAVDRRMVADVPVGVLLSGGVDSSLIVGLLAEKGQKDLNTFSIGFEDANGEVGNEFEYSDLIANHYGTEHHKLFVPGDELIQELPKAIEVMSEPMVSYDNIGFFLLSREVAKHIKVVQSGQGADEVFAGYHWYPKVAGANDPLAAYQRAFFDRDHETLGTHLNPEWMPETDVSKEFVANHFAMEGATEAVDKALRIDAHVMLVDDPVKRVDNMTMAWGLEARVPFLDHELVELAARVPADEKLKQDGKGVLKEVARQVIPSEVIDRKKGYFPVPQLKYLSGPTLDFVKDALHSDAAKSRGLFRKEYTDALFANPSEHITPLRGSELWQVALLEMWLQAQGV

SEQ ID NO: 4682 - protein, 230 aa, Vigna radiata
ELKCFDGFKSGRSDPSGIIGSPFVCRVKIALKLKGVEYKYVEENFRNKSEQLLKYNPVHKKVPVFVHGDKPLPESLVIVEYIDETWNNNPILASDPYQRALARFWSKFIDDKIVGASWKSVFTVDEKEREKNIAETYESLQFLENEIKEKKFFGGEELGLVDIAAVYVAFWIPLIQEIAGLELLTSEKFPNLYRWSQEFLNHPIVKESLPPRDPVFAFFKGRYEGLFSSK

SEQ ID NO: 4683 - protein, 316 aa, Haemophilus ducreyi
MTIFADNSYTIGNTPIVRLKHFGQNGNLLVKIEARNPSFSVKCRIGANMVWQAEKDGILTKDKEIVDATSGNTGIALAYVAAARGYKITLTMPETMSDERKRLLRGLGANLVLTESTLGMKGAIAKAEEIFASDPNRYIMLKQFENPANPAIHQQTTGPEIWQATEGKIDVIVAGVGTGGTITGVSRYIKQDKGKQIISVAVEPKESPVITQTLNGEEVQPGPHKIQGIGAGFIPKNLDLTLIDRVEQVSSEEALKIAHQLMAKEGILVGISSGAAVAAADRLAKLPEFADKQIVAVLPSASERYLSTLLFEGIEI

SEQ ID NO: 4684 - protein, 287 aa, Symbiobacterium thermophilum
MELFLTENQTEDMRLSVRATRVLHHEKTPYQELLVVETPQWGRLMALDGFFQTCDRDEFVYHEMGAHVPLCTHPNPRRVLIIGGGDGGMAREAARHPEVERVDLVEIDERVVECCKQYFPQIAVALSGNPKVHVHIADGIQWVQEHEAEYDVVIIDSSEPIGPGEGLFTANFYARVFRCLKDDGILVAQTESPWVNAPVIQRAYRGIRQSFPITRLYTCAVPTYPTGLWSFTLGSKKYDPLQAEPEKRVGTLGELRYYTPEVHRAAFQLPVFVQRILAEAEAEEEQP

SEQ ID NO: 4685 - protein, 631 aa, Emericella nidulans
MGLLSFRQPSWRISRSQFYPIWALSQLLLNPIAVLAQSAADYYVESLPGAPEGPLLKMHAGHIEVDPEHNGHLFFWHYQNRHIANRQRTIIWLNGGPGCSSMDGALMEIGPYRLKDNETLEYNEGSWDEFANLLFVDQPVGTGFSFANTNSYLHELDEMAAQFITFLEKWFAVFPEYERDDIYIAGESYAGQYIPYIAKAIQDRNKDIHEKQSSSARWNLRGLLIGNGWISPAEQYPAYLSFAYEEGLVEEGSKLGKELETLLSICKSKMETGPKISITDCEAVLNKLLDKTVDSNNQCINMYDIRLRDGSCGTTWPPDLVDVKPYLHTYEVIQALNISPEKESGWDECDGNVGAAFRPQKSEPSVKLLPGLLESGIEILLFSGDKDLICNHVGTEQLISNMKWAGGTGFETSPGVWAPRHDWTFEDEPAGYYQYARNLTYVLLYNASHMAPFDLPRRTRDMVDRFMHVDIASIGGAPADSRIDGEPLPQTSVGGQPNSTVHQEEEQQKIKETEWNAYAKSGEAVLVVVIIGVLVWGFLIWRSRRRHNGYSGIAIKSPSRTSIMGRFHNNHSNGADVEAGDFDEAELDDLHSPGLDRENYAVGEDSDDEAHRQDLPRAQESSSKSENNLVT

SEQ ID NO: 4686 - protein, 567 aa, Vibrio vulnificus
MTKIVIVGGVAGGASAAARARRLSEDAQIIMFERGPFVSFANCGLPYHIGGDIKERSKLLLQTPESFLARFNVDVRVMNEITAINRHEKTVTVKNLIDGSEYAESYDFLLLSPGAGPVVPPIPGIDNPLTHSLRNIPDMDRIIQTIQTNNVEHATVVGGGFIGLEMMEAFHQLGIKTTLLELADQVMTPVDREMAGFAHGEIRAKGIDLRLGTALSSVEYIANDHVASENAGEDIQHQHISGHLALSLSTGDTLNTDVLIMAIGVRPETKLAQQAGLQIGELGGIYTNDMMQTSDPSIYAVGDAVEEKDFVTGKQTLVPLAGPANRQGRMAADNMLGRSERYQGTQGTAICKIFDLAVASTGKNEKQLKRDGVEYEKVYVHTASHASYYPGAEIVSFKMLFDPKTGKIFGAQAVGKDGVDKRIDVMAVAQRAGMTVEQLQHLELTYAPPYGSAKDVINQAAFVANNLIKGDAKAIHFDEIEHLNDDQLLLDVRNPGELQAGGYLPGAINIPVDQLRQRMDELPKDKEIIIYCQVGLRGNVAYRQLVNNGYKARNLLGGYRTYMFSKC

SEQ ID NO: 4687 - protein, 315 aa, Oryza sativa
MGTLVGHVAPGAGFLLVGLWHLYNHIRLFLLRPTAYVAPVWFPVRRARYLELALVIAGAVASILMELVVGPARHQPFDADGTVPSDHLHNFEHASISLALLVYAAAAAALDVGRVPHGRAVSQLVAAVAFAQQLMLFHLHSADHAGVEGQYHLLLQGVVAVTLAATVLGVAAPRSFAVSLVRSASLVLQGVWFLAMGVMMWTPALLPKGCFLSREDGHDVARCRADDGGDALARAKALVNLEFSWYLSGTVVLVVALYLRLCRLYPEEPRYMPLVRGDCRDDDEDGGGDGDDNDVEAGKGGAGHVLREPLEIARP

SEQ ID NO: 4688 - protein, 480 aa, Unknown
  Burkholderia sp. 383
MQATGAFMKTLFLQAPSYDGFDGGAGSRYQAKREIRSFWYPTWLAQPAALVPGSRVVDAPADGLSVEETLKIANDYDLVIIHTSTPSFPTDAMFAQDLKKMKPSMLVGMVGAKVMVDPHNSLTASESIDFVCREEFDYTCKEIAEGKPFPEIKGLSWRAKDGSIEHNEARPILENMDELPFVAPVYKRDLKIDNYFIGYLNYPYVSIYTGRGCKSRCTFCLWPQTVSGHRYRTRSVENVLAEAKWIRDNMPEVKELMFDDDTFTDDLPRAEAIAIGLGKLGMTWSCNAKANVPYKTLKVMKENGLRLLLVGFESGDDQILVNIKKGVRTDFARRFSADCKKLGIKIHGTFILGLPGETQETIKKTIEYAKEINPHTIQVSLAAPYPGTTLYKQAVENGWMEENKTINLVSKEGVQLAAIGYAHLSRDEIYHHLEQFYRQFYFRPSKIWEIVREMLTSWDMMKRRLREGVEFFRFLRAHEA

SEQ ID NO: 4689 - protein, 120 aa, Glycine max
  misc_feature (58)..(58): Xaa can be any naturally occurring amino acid
  misc_feature (88)..(88): Xaa can be any naturally occurring amino acid
  misc_feature (92)..(92): Xaa can be any naturally occurring amino acid
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 4690 - protein, 323 aa, Capsicum baccatum
EVKVGDNIEVVRFFHCYKRGVDRIFVDHPMFLERVWGKTASKIYGPKAGQDYLDNELRFSLLCQAALEAPRVLNLNCSKSFSGPYGEDVLFIANDWHTALIPCYLKSMYQSKGIYMNAKVAFCIHNIAYQGRFSFSDFSLLNLPDEFRSSFDFIDGYEKPVKGRKINWMKAGILESHRVVTVSPYYAQELVSGVDKGVELDNVLRKTSITGIVNGMDTQEWNPATDKYTDVKYDITTVMDAKPLLKEALQAAVGLPVDRNIPLIGFIGRLEEQKGSDILVAAIHEFIGLDVQIVVLGTGKKKFEQEIEQLEVLYPNKAKGVAK

SEQ ID NO: 4691 - protein, 327 aa, Unknown
  Mesorhizobium sp. BNC1
MSRHWTIAVLGAGAWGTALALTMQRAGHGARLWARDQNLVREINNARSNSRYLPGVKIDPAVLATDDMAAALEGADCVLAAIPAQSLRSVLAVAGTALKAHIPVVLCAKGIERETGQLMSEAARQALPENPLAALSGPSFAADLARGLPTAVTVAAQDGALAADLAKKLSAPNLRCYSSDDLMGVELGGALKNVLAIAAGATSGAGLGASAVAAITTRGFVELRRIGAAFGARAETLMGLSGLGDLILTCNSPQSRNFAYGAALGRGERLDNLPLAEGVFTASIAARMVSERGLEAPIIETVNGMLNGGLTVHAAMQALLARPLKSE

SEQ ID NO: 4692 - protein, 466 aa, Arabidopsis thaliana
MSEEVPQQFPSSKRQLHPSLSSMKPPLVAPGEYHRFDAAETRGGGAVADQVVSDAIVIKSTLKRKTDLVNQIVEVNELNTGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPENHDVSMPMKEESTERNMETQEVDDTQRVYSDIESHDFVDGIMKIVPPDLDMGVDYWFRSEVGEVSITDMWPDEYWNQMITFDQDHAGPSDNKILEQPQTPSSPTPEESTATRSPTGS

SEQ ID NO: 4693 - protein, 323 aa, Jaltomata sinuosa
EVKVGDSIEIVRFFHCYKRGVDRVFVDHPIFLEKVWGKTGSKIYGPKAGQDYLDNELRFSLLCQAALEAPRVLNLNCSKYFSGPYGEDVLFIANDWHTALIPCYLKSMYQSRGIYVNAKVALCIHNIAYQGRFAFSDFPLLNLPDEYRGSFDFIDGYEKPVKGRKINWMKAGILESHRVVTVSPYYAQELVSTVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEQEIEQLEVLYPDKAKGVAK

SEQ ID NO: 4694 - protein, 323 aa, Lycianthes heteroclita
EVKVGDSIEIVRFFHCYKRGVDRVFVDHPMFLEKVWGKTGSKIYGPKAGQDYLDNELRFCLLCLAALEAPRVLNLNCSKYFSGPYGEDVIFIANDWHTALIPCYLKSMYQSKGLYVNAKVAFCIHNIAYQGRFAFSDFSLLNLPDEFRSSFDFIDGYEKPVKGRKINWMKAGILESHRVVTVSPYYAQELVSGVDKGVELDNVLRKTCITGIVNGMDTQEWNPSTDKYTDVKYDITTVMDAKPLLKEALQAAVGLPVDRNIPLIGFIGRLEEQKGSDILVAAIDKFIGLDVQIVVLGTGKKKFEQEIEQLEVLYPNKAKGVAK

SEQ ID NO: 4695 - protein, 302 aa, Streptomyces coelicolor
MTGTDTRQLAALRPRLPSPLHEVADGRFERHGVRLLLKRDDLIHPELVGNKWRKLAPNLATADGRTVVTFGGAYSNHLRAAAAAGRLLGLPTVGVVRGQELAGLPLNPSLARCAADGMRLHFVDRSTYRRKSEPETLAALLRAAGAEGAVVVPEGGSNADAVRGCRALGEELGTHADVAAVACGTGGTLAGLAAGLPRGRRALGIPVLKGGFLEGDIRRLQERAFGGPRGDWSLEDRFHHGGYARTTPGLDAFAADFEHRHGLPVERVYVAKMLYALLTLTEEGAFPRGTTLAAVVTGRPFP

SEQ ID NO: 4696 - protein, 275 aa, Xanthomonas campestris
MPQVTMRQMLEAGVHFGHQTRYWNPKLAPYIFGARGKIHIINLEKTVPLFNDAMNFLSSIAQKRGTVLFLGTKRSARESIKEEAERCNMPFMTQRWLGGTLTNFRTVKQSVARLKELEAAETDGTFEKLVKHEVLGLRREREKLDASLGGIKEMNRLPDAIFVIDIGHEDIAIKEAKKLGIPVIAVVDTNYDPALVDYAIPGNDDAIRAVQLYARAAADAVLEGKAAAPNSASVREEEFSAEAGDEGKGRRAPAKKATEKKADAPAAAPEAPAAE

SEQ ID NO: 4697 - protein, 720 aa, Rheum australe
MMNLWSSDDNVAFADAFMSLDSSSAAAWPPAPSSHQYNHQYNLQHQQQLQHQPQQQQQQQQMANSAGGGWQQAMAGGAQMNPAQMMNQDSLQQRLQALIDDARESWTYAIFWQCNVEPTGQSLLGWGDGYYKGDDSANKNASSAAPAAGSRPPKNPAEQEHRRRVLRELNSLISGSSSPQNDAVDDDVTDTEWFFLISMTQAFPFGVDLPGQAILGSNPIWAYGSDRLAGSPWDRARQGAAFGLQTIVCIPSGTGVLELGSTELVFNSSVLMNKVRVLFNFGSGDASLLTAAASSSAPAAAPPPPISTATTDEAENDPAALWISDPSSSAAEVKEALNPRITVRESSIPIGSNSIPVHQPAKPPQLDVQSSIGLTENSIGIHSQKSHNQPLQHQGFFTKELNFSEFAMKPESGEILNFGESKRNSLGNGNGLNSQFLVEESNKNIISKKRSPTSRGSAEEGMLSFTSSVVLPSSMAVKSSATGAGDSDHSDLEASVVKEADSSRVVDPEKRPRKRGRKPANGREEPLNHVEAERQRREKLNQRFYALRAVVPNVSKMDKASLLGDAISFINELKSKLQNVESEKETLLSQVECLKTEVLASRDHQSRSSNGGGGVQNHHHPSLEQDMNMLNGSCKQSDLDVDVKIIGRDAMVRVNCSKSNHPAARLMVALKELDLEVTHASVSVVNDLMIQQATVRMGSRYYSPDHLRMVLEAKVSDIRG

SEQ ID NO: 4698 - protein, 271 aa, Chlorobium tepidum
MIRLATVQFTPRLGERQANLEAIRSLLDPVEADIVVLPELCSSGYFFTSREELAPFAESPGGVACSFFQGLADAKRAIIIAGMPETAQGCFYNSVFVFRPGVADPLVYRKSHLFYKERFVFEPGDTGFPVIRDEQLDISIGIMLCYDWRFPEVSRVLALGGADLIACPSNLVTDAWRKVMPARAIENKLYVAVANRCGTETRGDETLLFKGCSAVYDPYGETVALADADNDRVLLAEIDPRSCRDKSFNEFNDIFADRRPELYGAICCPRR

SEQ ID NO: 4699 - protein, 59 aa, Passiflora biflora
WEYQVGPSVGIDAGDHIWCSRYILERITEQVGVVLTLDPKPIEGDWNGAGCHTNYSTKS

SEQ ID NO: 4700 - protein, 422 aa, Sulfolobus tokodaii
MNSAVQETLTSNLYDQQVKKLYHVGGILGLTEDVLQVLSTPERVIQVKIEIKGADGKVKTFVGWRSQHNSALGPYKGGVRYHPDVTQDEVIALSMMMTWKNSLLQLPYGGGKGGIRVDPSKLTKEELEALSRRYVDALYKYIGSDIDIPAPDVNTNPQIMAWYLDEYIKITGKADFAVFTGKPIELGGLPARIYSTGLGVATIAKASAKKFLGGIEGATVIIQGFGNVGTYTAKFLQEMGAKIIGVSDSKGGVIDPNGIDVQKIIEIKESTGSVINYPSGKKVTNDELLISECDILIPAALENVINKFNAPKVKAKLIVEGANGPLTADADAIMKERGIPVVPDILANAGGVVGSYVEWANNKMGEIMSEEEARKLIIQRMENAFEGVYQKYNKLGDQDLRTAAMAISIERVVNAMKARGML

SEQ ID NO: 4701 - protein, 323 aa, Lycianthes rantonnei
  misc_feature (239)..(239): Xaa can be any naturally occurring amino acid
EVKVGDSIEIVRFFHCYKRGVDRVFVDHPMFLEKVWGKTGSKIYGPKAGKDYLDNELRFSLLCQAALEAPRVLNLNCSKYFSGPYGEDVLFIANDWHTALIPCYLKSMYQSRGIYVNAKVAFCIHNIAYQGRFAFSDFSLLNLPDEFRSSFDFIDGYDKPVTGRKINWMKAGILESHRVVTVSPYYAQELVSGVDKGVELDNVLRKTCVTGIVNGMDTQEWNPATDKYTDVKYDITTVXDAKPLLKEALQAAVGLPVDRTIPLIGFIGRLEEQKGSDILVASIHKFIGLDVQIVVLGTGKKEFEQEIEQLEVLYPNKAKGVAK

SEQ ID NO: 4702 - protein, 313 aa, Mespilus germanica
GGLGDVLGGLPPAMAANGHRVMTISPRYDQYKDAWDTQVTVELKVGDKTETVGFFHCYKRGVDRVFVDHPLFLEKVWGKTASKIYGPTAGVDFKDNQLRFSLLCQAALVAPRVLNLNSSKYFSGPYGEEVVFVANDWHTALLPCYLKAIYKPKGIYKTAKVAFCIHNIAYQGRFGFADFALLNLPNEFKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 4703 - protein, 75 aa, Passiflora caerulea
GTNGEVMPGQWEYQVGPSVGIDAGDHIWCSRYILERITEQAGVVLTLDPKPIEGDWNGAGCHTNYSTKSMREDGG

SEQ ID NO: 4704 - protein, 313 aa, Peraphyllum ramosissimum
GGLGDVLGGLPPAMAANGHRVMTVCPRYDQYKDAWDTSVLVEIEVGGRVETVRFFHCYKRGVDRVFVDHPLFLEKVRGKTGSKIYGPRTGVDYMDNQFRFSLLCQAALEAPRVLNLNSNEYFSGPYGDDVVFIANDWHTALLPCYLKTIYKPKGIYKNAKVVFCIHNIAYQGRFPFLDFSVLDLPENLKGSFDFIDGHDKPVKGRKINWMKGGILESDRVVTVSPYYAQELISGEDKGVELDNIIRKTGITGIVNGMDVQEWNPATDKYLDIKYDNTTVLDPKPLLKEALQAEVGLPVDRNIPVFGFIGRLEE

SEQ ID NO: 4705 - protein, 330 aa, Mycobacterium smegmatis
MITLTATAPESLSRSTASQRPPLRVGLVQHRWRPDAGELVKVLREGIDRAAGEGAKAVFLPEITLLRYPADTPAGPNPGDVAEDLTGGPTFELAAEAARANGIFVHASLYEKAPAADGLGYNTAILVSPEGELVGRTRKMHIPISAGYYEDTYFRPGPARPSDGDPYPVYSPEGLGARIGLPTCWDEWFPEVARCYSLGGAEIVVYPTAIGSEPVFPAFDTQPLWQQVIVANGISSGLFMVVPNRTGDEGSLSFYGSSFISDPFGRVLVSAPRDEEAVLVADLDLDQRRDWLELFPFLLTRRPESYGALTEPVDPDHPYGAGHAATAVVK

SEQ ID NO: 4706 - protein, 367 aa, Oryza sativa
MAAVVFDAAILSKQEAIPAQFVWPADEAPAADDGVVEEIAIPVVDLAAFLASGGIGRDVAEACERHGFFQVVNHGVDPALLAEAYRCCDAFYARPLAEKQRARRRPGENHGYASSFTGRFDCKLPWKETMSFNCSAAPGNARMVADYFVDALGEEYRHMGEVYQEYCDVMTRLALDVTEVLAVALGLGRGELRGFFADGDPVMRLNHYPPCRQPHLTLGTGPHRDPTSLTLLHQDDVGGLQVLPDDAAAAAGGWRAVRPRADAFVVNIGDTFAALTNGRHASCLHRAVVNGRVARRSLTFFLNPRLDRVVSPPPALVDAAHPRAFPDFTWREFLEFTQRHYRSDTNTMDAFVAWIKQRNGYESLDKY

SEQ ID NO: 4707 - protein, 60 aa, Passiflora candida
VMPGQWEYQVGPSVGIDAGDHIWCSRYILERITEQAGVVLSLDPKPIEGDWNGAGCHTNY

SEQ ID NO: 4708 - protein, 505 aa, Kineococcus radiotolerans
MTTTTTAPAGTTPQIAINDIGSAEDFLAAVDATIKYFNDGDIVSGTIVKVDRDEVLLDIGYKTEGVIPSRELSIKHDVDPNEVVGVGDEVEALVLQKEDKEGRLILSKKRAQYERAWGTIEAKKEADEVVEGVVIEVVKGGLILDIGLRGFLPASLVEMRRVRDLQPYVGKTIEAKIIELDKNRNNVVLSRRAWLEQTQSEVRQNFLTTLQKGQVRSGVVSSIVNFGAFVDLGGVDGLVHVSELSWKHIDHPSEVVEVGQEVTVEVLDVDMDRERVSLSLKATQEDPWQQFARTHAIGQVVPGKVTKLVPFGAFVRVDDGIEGLVHISELAERHVEVPEQVVQVNSDIFVKVIDIDLERRRISLSLKQATESLAAAGEEFDPSLYGMAADYDEQGNYKYPEGFDPETNDWLEGFEAQREEWEGQYALAHERWEQHKKQVAEAAEAEAKAEAEGVTAATSSSSSSSSSSSSSSAPSSYTSEAPEAAGTLASDEALAALREKLTGGN

SEQ ID NO: 4709 - protein, 605 aa, Oryza sativa
MELALVGNPSNGVAKPSCNSVGSLPVVSSNAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPIAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 4710 - protein, 313 aa, Peraphyllum ramosissimum
GGLGDVLGGLPPAMAANGHRVMTISPRYDQYKDAWDTEVKVELKVGDKTETVRFFHCYKRGVDRVFVDHPLFLERVWGKTASKVYGPAAGVDFKDNQLRFSLLSQAALEAPRVLNLNSSKDFAGPYGEEVVFIANDWHTALLPCYLKAVYKPRGIYSTAKVAFCIHNIAYQGRFAFADFALLNLPDEFKSSFDFIDGYETPVKGRKINWMKAGILESDKLLTVSPYYAEELVSAVEKGVELDNIIRKTGIFGIVNGMDVQEWNPLTDKYTTIKYDASTVADAKPLLKETLQAEVGLPVDRDIPVIGFIGRLEE

SEQ ID NO: 4711 - protein, 367 aa, Pyrococcus furiosus
AHHHHHHGSKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 4712 - protein, 605 aa, Oryza sativa
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEHAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCEQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 4713 - protein, 60 aa, Passiflora capsularis
WEYQVGPSVGIDAGDHIWCSRYILERITEQAGVVLSLDPKPIEGDWNGAGCHTNYSTKSR

SEQ ID NO: 4714 - protein, 313 aa, Peraphyllum ramosissimum
GGLGDVLGGLPPAMAANGHRVMTVSPRYDQYKDAWDTGVPVEIEVGGRVETVRVFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYENAKVVFCIHNIAYQGRFPISDFSVLNLPENLKGSFDFIDGYNKPVKGRKINWMKAGILESDRVVTVSPFYAQELVSGEDKGVGLDNIIRKTGITGIVNGMDVQEWNPATDKYLDTKYDNTTVLDAKPLVKEALQAEVGLPVDRNIPVIGFIGRLEE

SEQ ID NO: 4715 - protein, 553 aa, Rhodospirillum rubrum
MPTIATALLDALKAHGATRIFGIPGDFALPFFRVAEQSALLPLYTLSHEPGVGFAADACARMGRGLGVAAVTYGAGALNMVNPVAGAWSEKSPLVVISGAPGVAESAGGLLLHHQAKTLDSQWRIFEEITCARTRLDDPLTAPGEIARVLRACLEHSRPVYIEIPRDIVDAPCAAVDRLPPTPVDGEAVEAAAGEIMARLAAASAPALLLGVEVRRHGIEADVAELARRLGLPIATTFMGRGLLSEEGAAGGAPDSLMGTYLGLAGRPEVRAVIEDSDGLLMLGVILSDTNFGVSGKRIDLRRAMLAADRQVALGFHTYNDIPLADLVAALLRQAEGFARQDAKALPKPTALPRDMIADGAPIGPMDIAAAINDLFSAHGVMPIASDMGDCLFTALDTTHAPLVAPGYYATMGFGVPAGLGVQASCGRRPLILVGDGAFQMTGWELGNCARYGWDPIVIVFNNASWEMLRTFQPDTAYNDLADWRFADLAAGLGGVGHRCQTRADLARALDRAAREPGRFHLIEAVLARGAISDTLQRFVTTMKGRHAAAADA

SEQ ID NO: 4716 - protein, 340 aa, Unknown
  Bradyrhizobium sp. BTAi1
MLSTKQPVLRRFWYAIMPMDHLKDGPKPFTLLGQPIVLFLDDKGEPAALEDRCCHRTARLSKGWCNNGHVVCGYHGWEYDRDGKLVMVPQFPFEQPIPEARARAFRARQRYGYVWVALDEPLSDIPDIPEDGKPGYRRIHQFYDTWNTAALRLMENSFDNAHFAFVHKSTFGDISQPKPEKYEIVETEEGFDAETIITVRNPPNAARITGTTEPVTKRHQRNKWFMPFCRRLDMEYPSGIRHIIFNCATPIADGRIQVVQLLFRNDTEADCSTQELIDWDAAIIAEDREMLESTDPDAIVDMSRKIEMHMPSDRPGMIMRKRLLDLLRAHDEDEIPAGAA

SEQ ID NO: 4717 - protein, 551 aa, Coccidioides immitis
MAHIFELAETLSLSPNYSNGMKSSSQLKFPATEVFHGFNRPSRIEGDVQNLEVTGQIPTDIDGTFFRVQPDHRFPPVYDSDIHFNGDGNVTAIRIANGSAHFKQRYVHTDRYDAESKAGKALFGKYRNPYTDNEAVKGVIRTAANTNIFFWRGMLLATKEDGPPYAMDPDTLETIGRYDFEGQILSPTFTAHPKFDPRTGEMVCYGYEAGGDGNDGSSDIVVYSINAEGVKTEECWYKAPFCGIIHDCGISDNWVVLPMTPLKCDPERLKKGENHWAWDPNEDQWYGLVPRRGGKPEDIRWYRSKNAFQGHTVSCYETPGGKVVFDLTIADGNVFFFWPPIDTPAGTVAKRNKLQNKTTRWIFDPNTPTNSWVDPAEEFDTYSGEFSRIDDRFTTMKYNHYWQAVIDGTKPYDFAKCGSPAGGLFNSLGHFTWDSSARETFWAGPCATFQEPAFIPRAGSTQEGDGYIIALLNHLDVLRNDVCIFDAQNISQGPVAVIHLPFKLRLGLHGNFVEQGEIEAWKQKRERELGPVKAASAPLPWQQKATSAGEV

SEQ ID NO: 4718 - protein, 313 aa, Photinia villosa
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDDVLFIANDWHTALLPCYLKAIYKPKGIYENAKVVFCIHNIAYQGRFPISDFSVLDLPENLKGSFDFIDGYNKPVKGRKINWMKAGILESDRVVTVSPYYAQELVSGEDKGVELDNIIRKTGITGIVNGMDVQEWNPATDKYLDTKYDNTTVLDAKPLVKEAPQAEVGLPVDRNIPVIGFIGRLEE

SEQ ID NO: 4719 - protein, 356 aa, Medicago truncatula
MSLLSDLINLNLSESSEKIIAEYIWVGGSGMDLRSKARTLPGPVSDPSKLPKWNYDGSSTNQAPGQDSEVILYPQAIFKDPFRQGNNILVICDVYTPAGEPLPTNKRYNAAKIFSHPDVAAEVPWYGIEQEYTLLQKDTNWPLGWPIGGYPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMRENGGYEIIKKAIEKLGLRHKEHIAAYGEGNERRLTGKHETADINTFSWGVANRGASVRVGRDTEKDGKGYFEDRRPSSNMDPYVVTSMIAETTLLWKP

SEQ ID NO: 4720 - protein, 107 aa, Carboxydothermus hydrogenoformans
MVLKFTDANFEDEVINSDMPVLVDFWAEWCGPCRMIAPIIERLAIDYLGQVKVGKLNVDENRETAIALGIMSIPTVMIFKDGKVLDTIIGYQPENVFREKIEKALKK

SEQ ID NO: 4721 - protein, 831 aa, Unknown
  Rhodococcus sp. RHA1
MANTPSSSKLLVVGNGMAGARTVEEILNRGGGERFAITMIGDEPYGNYNRIMLSHVLSGEAATDDEDLILNPMGWYTANGVKLHAGDRAVVLDRFAKTVTCESGRVVDYDVLIIATGSNTFFPNMDGLREHDGRLARGVFGFRNIADTNGMLQMAQARDDVSAVVIGGGLLGLEAAYGLRTQGLTVNVVHSPGHLMNQQLDERGGSVLRAEIEKLGVGVHTSMRTTAVLRDEAGLVTGVSFVDGSTLDADMVVVTAGIRPNTELARAAGLVVERGVVVDDQMRCEDEGSVYAVGECAQHRGETYGLVAPVWEQSVILAEVLTGSNPEAAYVGSRTTTKLKVAGVDVAAMGVKGPETADDEFVQYYEPRSGTYKSLVVRDGKLIGATLMGDISKAGFLTQAFDGKVPLPEERISMLFDVGSQSAATSVADLPDDQQVCNCNGVSKGDLVACVHSGAKTLTDVCAQTRAGKGCGSCKGLVADIVACAAGGELEADPSADWYVPCIPMTKPELIATIRERDLRAVSQVFAELATDAKEDASAKMPLASLLRTIWGPDWVDERGALFINDRVHANIQRDGTFSVVPQMKGGVTTPEQLRTIADVADKYGVPLVKVTGGQRIDLLGIKKEDLPKVWGDLDMPSGFAYGKSMRTVKTCVGTDFCRYGLGDSTSLGIALEERFQGLETPAKLKLAVAGCPRNCSEALCKDFGVVAVGDGRWEIYVGGAAGAHIRKGDLLATVESPKAVVELGGRFIQYYRENAKWLERTYDFVPRVGLEHLQALLVRDEEDIVTGLDERIQTAVDGYRDPWKERSAPKSPAQFAPSLPLLPLPQVPVR

SEQ ID NO: 4722 - protein, 540 aa, Oryza sativa
MSSYVTTPHHHHHHGCCSGSRRLQAPAPPARPRLVVAAAARHVALPPRRAVASRAMSAEAPLGVAPAAAEEEMAAVVDEMAEEAAVWCAVHGLVVGDRAEPRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKSAVIMMVVQPEERNMYDQYWLINHLKESHGVKTIRKTLAQVEAEGQVLPDGTLVVDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDEW

SEQ ID NO: 4723 - protein, 123 aa, Unknown
  Synechocystis sp. PCC 6803
STLYEKLGGTTAVDLAVDKFYERVLQDDRIKHFFADVDMAKQRAHQKAFLTYAFGGTDKYDGRYMREAHKELVENHGLNGEHFDAVAEDLLATLKEMGVPEDLIAEVAAVAGAPAHKRDVLNQ

SEQ ID NO: 4724 - protein, 324 aa, Glycine max
MHETHSIGGGRFYGGGDRRLRPHHQQQQPPPLKCPRCDSLNTKFCYYNNYNLSQPRHFCKNCRRYWTKGGVLRNVPVGGGCRKSKRSNKPKTTTTTTTSNTNNNRSSFSATAPATAPTPPAPELEHHSHSHSSSESSTLTVTATEEMSAPPPTTSNAPSKNSLLLDNDHREAKMFANPNPNPSLDSGGIFSEIGNFTSLINLNNNEAFGFGNNKNNNSILDATSFRFGISVTNQVQAAAGGGHGQWQQQNHQEFGTASFLDHTVPLEFSSLQHKTGHQGGFGSLDWQPGADQGLFDLPNTVDQPYWTHAHWSDQDNTSSLFHLP

SEQ ID NO: 4725 - protein, 241 aa, Coccidioides immitis
MAALPRRTTSLTRLTNETKVQVSLSLDGGVLLPFEPCEHFPQNSPEEATQILPLAGSAHSTQFTSTQQITINTGIGFLDHLLHALAKHAGWSLAVRCKGDLIIDDHHTTEDTFLALGTAFTRALGPRVSLVRFARGDAPLDEALSWAVIDISSRPYSVINLGLQREKIGALSTEMIPHALESFAQTAGVTLHVGCMYGSNDHHRAESAIKAVAVAIRGATTRRGAGEVGGGGEVVSTKGVL

SEQ ID NO: 4726 - protein, 109 aa, Triticum aestivum
MSAAEGAVVFSEEKEALVLKSWAIMKKDSANLGLRFFLKIFEIAPSARQMFPFLRDSDVPLETNPKLKTHAVSVFVMVIHHASPNDVLLYRYASMADQCVCASMCCDWR

SEQ ID NO: 4727 - protein, 112 aa, Unknown
  Shewanella sp. MR-4
MKLITAIIKPFKIDDVREALTQLGIQGMTVTEVRGFGRQKGHTELYRGAEYAVDFLPKMKLEIAIHSELEDAVIEAIVAAAHTGKVGDGKIFVTPLEQVIRVRTAEEGSDAI

SEQ ID NO: 4728 - protein, 108 aa, Zea mays
  misc_feature (100)..(100): Xaa can be any naturally occurring amino acid
MGKRPAKCYPQIKNKPYPKSRNCRGVPDPKIRIYNVGMKKKGVDEFPYWGHLVSWKKENVSREALEAARIACNKNMTKSAGKDAFHLRVRVHPFHVLRIXKMLSCAGA

SEQ ID NO: 4729 - protein, 446 aa, Legionella pneumophila
MEIKRVLKDRLTARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDDTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRPGISRFEGNTVHFTDGTQGEFDTIIFATGYQISFPFFDKSCIDFSNSTTIPLYRKMMHPEFENLYFIGLCQPQGCIWPLADYQSKIVARIIAGTLKRPEQLHRKIAKEINKPHHRFKSHMRHALEVDYHIFRKELLEMLGQKHKRLKFYP

SEQ ID NO: 4730 - protein, 291 aa, Burkholderia pseudomallei
MRKTTVAVTQMACDWNVDANLSRAERLVRDAAARGAQIVLLQELFETPYFCIDQHPAHLALAQPYEGHPWLMRFASLARELGVVLPVSFFERAGQTQFNSVAIFDADGRALGIYRKTHIPDGPGYTEKYYFTPGDTGFRVWDTAYGRIGVGICWDQWFPECARAMALAGAELLLYPSAIGSEPHDASIDSRAHWRNAQRGHAAANLMPVAASNRVGVERGASGEIVFYGSSFIAGADGEMIVECDRHDEAIATAEFDLDALAYRRRGWGVFRDRRPECYRALSEGAADRVR

SEQ ID NO: 4731 - protein, 436 aa, Zea mays
  misc_feature (57)..(57): Xaa can be any naturally occurring amino acid
MPVAVAATGCQVLFIYAVRAHNPRDPPPLVVCARGSSQVRSRRESGGASPGFKVMAXSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAAQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYTVTGLLAETTILWQPSLEAEALAAKKLALKV

SEQ ID NO: 4732 - protein, 356 aa, Unknown
  Populus tremula x Populus alba
MSLLTDLINLKLSDITDKIIAEYIWIGGSGMDMRSKARTLSGPVTDPAQLPKWNYDGSSTGQAPGEDSEVILYPQAIFKDPFRRGNNILVMCDAYTPQGEPIPTNKRYAAAKIFSSPEVAAEEPWYGIEQEYTLLQRDVNWPIGWPVGGYPGPQGPYYCGIGADKAYGRDIVDAHYKACLYAGINISGINGEVMPGQWEFQVGPSVGISAGDHIWAARYILERITEQAGVVLSFDPKPIKGDWNGAGAHTNYSTKSMREDGGYEVIKKAIEKLGLRHKEHISAYGEGNERRLTGRHETADINTFSWGVANRGASIRVGRDTEKEGKGYFEDRRPASNMDPYVVTSMIAETTILWKP

SEQ ID NO: 4733 - protein, 323 aa, Physalis alkekengi
EVKVGDSIETVRFFHCYKRGVDRVFVDHPMFLEKVWGKTGSKIYGPKAGQDYLDNELRFSLLCQAALEAPRVLNLNCSKYFSGPYGDDVLFIANDWHTALIPCYLKSMYQSRGIYVNAKVAFCIHNIAYQGRFSFSDFSLLNLPDEYRSSFDFIDGYEKPVKGRKINWMKAGILESHRVVTVSPYYAQELVSGVDKGVELDNVLRKTCITGIVNGMDTQEWNPATDKYTDVKYDITTVMDAKPLLKEALQAAVGLPVDRNIPLIGFIGRLEEQKGSDILVAAIHKFIGLDVQIVVLGTGKKKFEQEIEQLEVLYPDKAKGVAK

SEQ ID NO: 4734 - protein, 136 aa, Rheum australe
MARTKQTARKSTGGKAPRKQLATKAARKSAPATGGVKKSHRFRPGTVALREIRKYQKSTELLIRKLPFQRLVREIAQDFKTDLRFQSSAVAALQEAAESYLVGLFEDTNLCAIHAKRVTIMPKDMQLARRIRGERA

SEQ ID NO: 4735 - protein, 323 aa, Solanum adscendens
EVKVGDSIEIVRFFHCYKRGVDRVFVDHPMFLEKVWGKTGSKIYGPKAGQDYLDNELRFSFLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVILGTGKKKFEQEIEQLEVLYPNKAKGVAK

SEQ ID NO: 4736 - protein, 323 aa, Solanum aggregatum
EVKVGDSIEIVRFFHCYKRGVDRVFVDHPMFLEKVWGKTGSKIYGPKAGQDYLNNELRFSLLCQAALEAPRVLNLNCSKYFAGPYGEDVLFIANDWHTALIPCYLKSMYQSRGIYLNTKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAK

SEQ ID NO: 4737 - protein, 323 aa, Solanum aligerum
EVKVGDSIEIVRFFHCYKRGVDRVFVDHPMFLEKVWGKTASKIYGPKAGQDYLDNELRFSLLCQAALEAPRVLNLNCSKYFSGPYGEDVFFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAK

SEQ ID NO: 4738 - protein, 393 aa, Leptospira interrogans
MKPPVNQSCQHYPECAGCDRLHIGYEKQLQHKQEEIEKRFKGFKGLEIRQIIKSPKDQMYRHKVQLPFGHRKIGKKSVLTLGLHNKENTFIIDQKECRIQDEDLTTVAAAIRHWARNENLEPYHEKKGSGLLRHIVLRKANATQEILVGIVTNESEIPGRKKLTDRLYSYIQQFLYKENSKADVVGILQNVNRKNTKVVLGEKEVTWYGRHFVKEKIGKLDFQIGLSTFFQVNPFQIENLYNLILEDLPENKCVVDAYCGIGTISLYIASKSKKVIGLEENSSSIRSAIGASKANGIENVHFIKGKVLDTLRAALNENSDVVVLDPPREGLDAETKSILLNSKVNQILYVSCNPETLLRDAIELTKSFKYEKITPVDLFPHTSHLESVSVFTK

SEQ ID NO: 4739 - protein, 334 aa, Mycobacterium tuberculosis
MAGIASTVAVMGAGAWGTALAKVLADAGGEVTLWARRAEVADQINTTRYNPDYLPGALLPPSIHATADAEEALGGASTVLLGVPAQTMRANLERWAPLLPEGATLVSLAKGIELGTLMRMSQVIISVTGAEPAQVAVISGPNLASEIAECQPAATVVACSDSGRAVALQRALNSGYFRPYTNADVVGTEIGGACKNIIALACGMAVGIGLGENTAAAIITRGLAEIIRLGTALGANGATLAGLAGVGDLVATCTSPRSRNRSFGERLGRGETLQSAGKACHVVEGVTSCESVLALASSYDVEMPLTDAVHRVCHKGLSVDEAITLLLGRRTKPE

SEQ ID NO: 4740 - protein, 65 aa, Passiflora cincinnata
GTNGEVMPGQWEYQVGPSVGIDAGDHIWCSRYILERITEQAGVVLSLDPKPIEGDWNGAGCHTNY

SEQ ID NO: 4741 - protein, 323 aa, Solanum amygdalifolium
  misc_feature (64)..(64): Xaa can be any naturally occurring amino acid
EVKVGDSIEIVRFFHCYKRGVDRVFVDHPMFLEKVWGKTASKIYGPKTGQDYLDNELRFSLLCXAALEAPRVLNLNCSKYFSGPYGEDVFFIANDWHTALIPCYLKSMYQSRGIYLNAKVAFCIHNIAYQGRFAFSDFPLLNLPDEFRGSFDFIDGYEKPIKGRKINWMKAGILESHRVVTVSPYYAQELVSAADKGVELDNVLRKTCITGIVNGMDTQEWNPATDKYTDVKYDITTVMDAKPLLKEALQAAVGLPVDRKIPLIGFIGRLEEQKGSDILVAAIRKFIGLDVQIVVLGTGKKKFEQEIEQLEVLYPNKAKGVAK

SEQ ID NO: 4742 - protein, 541 aa, Triticum aestivum
MMGLGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGSLELGDYLALGAIFSATDSVCTLQVLNQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSIGLSSIIVALVLVARAAFVFPLSYLSNLTKTTPGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLPGNGPETDLENAVSIRRPTSLRMLLASPTRSVHHYWRKFDNAFMRPVFGGRGFVPFVPGSPTESSVPLLAHGSEN

SEQ ID NO: 4743 - protein, 65 aa, Passiflora cincinnata
GTNGEVMPGQWEYQVGPSVGIDAGDHIWCSRYILERITEQAGVVLFLDPKPIEGDWNGAGCHTNY

SEQ ID NO: 4744 - protein, 564 aa, Xanthomonas campestris
MCSIFGIFGLQPGDDLQALRRQALECSQRQRHRGPDWSGVYVDAGAILVHERLAIVDPAGGSQPLLSEDGSLALAVNGEIYNHRELKAELLQPYAFQTGSDCEVINALYREDAPASYLNRLNGIFAFALWDKAAGRVIIARDPIGVVPLYWGHDREGRLRVASELKSLVDDCADAAQFPPGHWYDSATGALSRYYERSWREYSEVENVQVPLQELREAFERAVHRQLMTDVPYGVLLSGGLDSSLVAAVAARYARHRIEENDTTEAWWPRLHSFAIGLTGSPDLAAAEVAAAALGTVHHGFEYSFEEGLDALPEVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSTGATRIEKGILREAFAGYLPESILWRQKEQFSDGVGYGWIDGLKAHAAAHVSDRELAAADRRFPVNPPQTKEAYFYRSLFEQFFPSQAAAETVPGGKSIACSSPTAIAWDASFAAMADPSGRAIAGVHAQALAS

SEQ ID NO: 4745 - protein, 550 aa, Chlorobium tepidum
MESLYTSTLSEISEEEIVKGRIVSISNKDVTIDVGFKSEGIVSLLEFRDDDEIKVGDDVEVYLENIEDKMGQLILSKRKADVLRIWDKIYDSIENDTIINGKIINRVKGGMTVSLSGVEAFLPGSQIDVKPVRDFDALVGKTMDFRVVKINPVTQNIVVSHKVILEEEYAAKREEMLANIKVGMVLEGTVKNITDFGIFVDLGGLDGLVHITDITWGRINHPSEVVELDQPIKVVVVGFDENTKRVSLGMKQLEAHPWENIEIKYPVGIKATGRVVSITDYGAFVEIEKGIEGLVHISEMSWTQHIKHPSQFVSLNQEVEVVILNIDKEHTKLSLSMKRVSEDPWIALSEKYVEGSLHKGTVSNITDFGVFVELEPGVDGLVHISDLSWTKKIRHPSELVKKGQELEVKVLKFDVNARRIALGHKQINNDPWGEFEQKYAVGAECTGAISQIIEKGVIVILPGEVDGFVPVSHLLQGGVKDIHSSFKIGDELPLRVIEFDKENKRIILSALEYFKDKSKEEIEAYLQAHPNEKKEIEAASAELEPQPKGR

SEQ ID NO: 4746 - protein, 58 aa, Passiflora cinnabarina
WEYQVGPSVGIDAADHIWCSRYILERITEQAGVVLTLDPKPIEGDWNGAGCHTNYSTK

SEQ ID NO: 4747 - protein, 281 aa, Chlamydia muridarum
MVLSCELTLKELLESGAHFGHQTSRWNPKMKPFIFEEKNGLYIIDLAKTLAQLKKAVSCIQKTVEQGKSILFVGTKKQAKQIIKEAAIECGEFFASERWLGGMLTNMATIRNSVKTLNNIEIDLASSNSVLTKKETALLAKRHRKLLNNLEGVRHMNSLPGLLVVIDPGYERIAVREAGKLGIPVMALVDTNCDPTPINHVIPCNDDSIKSIRLIVNALKDAIIDTKKRSGFEILSPVRPIERPAEEIVEGLPLPNEAQNDANSKEGFLVWTDTDNSEALR

SEQ ID NO: 4748 - protein, 239 aa, Oryza sativa
MEGGGGGADAQAQAQPVAQAPPAMQPMQQLSRYESQKRRDWNTFLQYLRNHRPPLTLARCSGAHVIEFLKYLDQFGKTKVHASGCAYYGQPSPPAPCPCPLRQAWGSLDALIGRLRAAYEESGHAPESNPFAARAVRIYLREVRDAQAKARGIPYEKKKRKRTQQQQPPPQPPLPPQHQPGAAAGEASSSSSAAAAAVAAEGSGSSAATAAATSQTGGGGGSTTTTTASAAAPTTATRV

SEQ ID NO: 4749 - protein, 58 aa, Passiflora cirrhiflora
WEYQVGPSVGIDAGDHIWCSRYILERITEQAGVVLSLDPKPIEGDWNGAGCHTNYSTK

SEQ ID NO: 4750 - protein, 155 aa, Rhodospirillum rubrum
MSHSPETPPRMTIGLVAHDGQKRAMGQWVAANATVLGHHALVATGTTARVLKEQNPTFDITGLKSGPFGGDQQLGALIAEGHLDCLIFFVDPMEPQPHDVDVKALIRLAQVHEIPAACNRATADLMITSPLFGVLRAGSFPPAEERFAVYANRKV

SEQ ID NO: 4751 - protein, 58 aa, Passiflora citrifolia
WEYQVGPSVGIEAGDHIWCSRYILERITEQAGVVLTLDPKPIEGDWNGAGCHTNYSTK

SEQ ID NO: 4752 - protein, 299 aa, Arabidopsis thaliana
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGGGAEFEVEGRQHGLVRTYRILPPPLNTRPVNSLTSPQPSELLTTLPSKPNKAHRKVWPGQVHWVRSNDIASSSYKLLTWRVKTEPVLNLPSFLDPNHCEDDVEQEAGVEKVKTESNGDKSEKEDGGGSHSYDESMSFYDVGMMMMEHVLDDNEEEEEEEEDGWCLV

SEQ ID NO: 4753 - protein, 357 aa, Dioscorea gracillima
LKQKIDRMYNGEKINCTENRSVLHIALRAARDKVIESDGKNVVPDVWHVLDKIKEFSEIIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 4754 - protein, 507 aa, Mycobacterium smegmatis
MHTEVVAKYLSTLPEDDTHPYRTGAWRPQTTEWDADDLTVVEGEIPADLDGVYLRNTENPMHPAFKVYHPFDGDGMLHVVGFRDGKAFYRNRFVRTDGLLEENAEGGPLWPGIAEPVELAKRDYGWGARTLMKDASSTDVTVHRGVALTSFYQCGDLYRINPHTGDTLGKENWNGGFPVDWGVSAHPKNDDRTGELLFFNYGKQAPYMHFGVVDQNNNLVHYTDVELPGPRLPHDMAFTENYVILNDFPMFWDAEFLKHNAHIPRLHRDLPSRFAVVPRRGGDIKWFEADTTYVLHFTNAFEDGDEIVMDGFFQGSPEPDDDPADNGMSRKWQRFFRYLSLDGMQTRLHRWRFNLVTGETREEQLSDSLTEFGMINPDFATQDYRYIYAATGKPGWFLFDGLVRHDLRTGSEERYTFADGVYGSETAMAPRVGGSGEDDGYLVTLISDMNDDASYCLVFDAARVGDGPVCKLALPERISSGTHSTWVSGAELRRWHTSDDAAAAIGM

SEQ ID NO: 4755 - protein, 537 aa, Brachymonas petroleovorans
MSSSPSSAIHFDAIVVGAGFGGMYMLHKLRDQLGLKVKVFDTAGGIGGTWYWNRYPGALSDTHSHVYQYSFDEAMLQEWTWKNKYLTQPEILAYLEYVADRLDLRPDIQLNTTVTSMHFNEVHNIWEVRTDRGGYYTARFIVTALGLLSAINWPNIPGRESFQGEMYHTAAWPKDVELRGKRVGVIGTGSTGVQLITAIAPEVKHLTVFQRTPQYSVPTGNRPVSAQEIAEVKRNFSKVWQQVRESAVAFGFEESTVPAMSVSEAERQRVFQEAWNQGNGFYYMFGTFCDIATDPQANEAAATFIRNKIAEIVKDPETARKLTPTDVYARRPLCDSGYYRTYNRSNVSLVDVKATPISAMTPRGIRTADGVEHELDMLILATGYDAVDGNYRRIDLRGRGGQTINEHWNDTPTSYVGVSTANFPNMFMILGPNGPFTNLPPSIEAQVEWITDLVAHMRQHGLATAEPTRDAEDAWGRTCAEIAEQTLFGQVESWIFGANSPGKKHTLMFYLAGLGNYRKQLADVANAQYQGFAFQPL

SEQ ID NO: 4756 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 4757 - protein, 78 aa, Arabidopsis thaliana
  misc_feature (72)..(72): Xaa can be any naturally occurring amino acid
MAPSMRLCFSMDASPARGGFDRAFYGLKSSAAFPATRKANNDITFITSNGGRVNCMQEWPPTGKKKFETLSXYPPDLT

SEQ ID NO: 4758 - protein, 439 aa, Mycobacterium smegmatis
MTDTDLTNLPGTGEFFRRGNYAPVPDELTDYDLPVTGAIPPELDGWYLRNGPNPRQATAHWFTGDGMIHGVRIENGAAKWYRNRWVRTDSFIESFPVYNADGTRNLRASVANTHIVNHAGKTLALVESSLPYEITGDLETVGAYDFGGKLVDSMTAHPKICPTTGEMHFFGYGSLFEPYVTYHRADADGELTINRPVDVKAHTMMHDFAMTSGHVIFMDLPVVFDLDIALKGTGDMPYRWSDTYGARFGLLRRDDPFGEIRWFDIDPCYIFHVVNAYEHGNTVVVQAVRYPELWRDNGSFDAQAVLWSWTIDLQTGAVTERQLDDLAVEFPRIDDRLAGLHARYSVAAGDHGWVRYDMTTGDAQRHDLGTGGPGEAVFVPGAGPADESNGWYLGYVYDPERDGSDLVILDASDFGGKPVARIELPRRVPYGFHGNWISA

SEQ ID NO: 4759 - protein, 493 aa, Oryza sativa
MYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 4760 - protein, 135 aa, Actinobacillus pleuropneumoniae
MRILHTMLRVGDLDRSIKFYTEVLGMRLLRTSENPQYKYSLAFVGYADESESAVIELTYNWGVESYELGTAFGHVALGVDDIYATIESVRAAGGKITREPGPVLGGTTVIAFAEDPDGYKIEFIENKNAQAALGN

SEQ ID NO: 4761 - protein, 294 aa, Oryza sativa
MDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 4762 - protein, 197 aa, Oryza sativa
MMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 4763 - protein, 112 aa, Unknown
  Shewanella sp. MR-7
MKLITAIIKPFKIDDVREALTQLGIQGMTVTEVRGFGRQKGHTELYRGAEYAVDFLPKMKLEIAIHSEQEDAVIEAIVAAAHTGKVGDGKIFVTPLEQVIRVRTSEEGSDAI

SEQ ID NO: 4764 - protein, 280 aa, Vibrio vulnificus
MLIKSKHFPHREALSGTLYHQIYSIGSTMTLTSLSSLQNQGFVSLVGAGPGDPDLLTVKGYRVIQQAEVVVYDRLVSPEILALANEKAEMIYVGKKLDFHCVPQEEINQILVRKALEGKRVVRLKGGDSFIFGRGGEELEELAEHGVRFEVVPGITAAAGATAYAGIPLTHRDHAQSVQFITGHIQKDGKEIEWPSLAQANNTLVFYMGLKQCRYIAEKLLENGLDASTSCAIIENGTRREQRVLTGSLTQLPELATQAISPALIVVGSVTSLHDKLKWF

SEQ ID NO: 4765 - protein, 617 aa, Desulfitobacterium hafniense
MCSILGLVNFKRKISPQEIQCLSTMGKTLIHRGPDQNGLEYGEHFAFQHNRLAIIDIEKGRQPMTATHQGYDYTIVYNGELYNTADLRQELLEHGVKFKTYCDTEVVLYAYIIWGEQCSSKLNGIYAFVIYDSKEKKTYLSRDRFGVKPFFYTFVEGALLFASEIKALLKHPQVKPRLDYQGLWQLLYMMPVKEEGTAIFKDIFELPTASHAFYSLAPGASEAELKIAKYWTMEAYENQDSEAAIVATTRDLLVDAIERQLVSDVPLCTFLSGGLDSSIITAVAAQKYQAEGRQLATYSFEHEGNKDHFKQTLFQPQSDDEFAVYLAQHLHTQHQILTAKKEHLVDYLDEAVRYRDYPGMADIDSSLLFYCRQVKEHHTVALSGECSDEVFGGYPWFYRPEMLTRGFFPWIHEPHARISLFKPELVRPQEGFAYTSEIYRRSVEACPLLPDESETMQNSRIASWLSINYFMTSLLERKDRMSMASGLEVRVPFSDHRLVQYVYNVPWEIKFKDGVEKALLRAAMQDYLPPKILYRKKSPFPKTHDPHYEELVFHLFRKRLDSGSGMLAELLQKDVLNRLISPGNNTWFGQLMGLPQLLAWLVQLDYWFEAYQVQLVG

SEQ ID NO: 4766 - protein, 520 aa, Cryptococcus neoformans
MFYAMRTLASLAILPLVLSLQLPHFPTPQDTLELAESFIHSGHAHAGDHAAEVEMVHANDMRLSTIGDEHVILTHKKYPNHKVRIKSTTGWCDPDVKSYSGFLDVGYGKNLFFYFFESRSKPSEDPIVMWINGGPGCSSSLGMLMELGPCSVKDDPKGVNDTERNPYAWNEKANVFFLDEPIGVGFSHANNGQTVSTTEEAAIDVQAFISIFFETFKEFEGRAFHMAGESYGGRYLPVFASAVVDGNKQLIKDGKTPINLNSVMIGNGVTDYFTTTESYFPFQCTVHGDLTEPVQSIGACVAMAEAVPKCHKLAKKGCLETHDYTTCSMAINYCEEVLGETFLSAGVNPYDVTMPCTVEELADSLCYPVTKKIGTYLDLPDVRHTLGVEKLRSNWSSCDGPVFTRFTQSLDNTGKTWLYVAGLLERGVRVLNYVGMLDFICNHVANELWMERLEWSGKEGYNAAQFSDWVVDGHRAGEFKTYGNLTMLKIRGAGHMVPYDKPKEALSMVTSWLDAAALDQ

SEQ ID NO: 4767 - protein, 339 aa, Arabidopsis thaliana; identical to SEQ ID NO: 339

SEQ ID NO: 4768 - protein, 853 aa, Vibrio vulnificus
MSKLKLVIVGNGMVGHRYIEDLVDKTDVSNYDITVFCEEPRVAYDRVHLSSYFSHHTADELSLVKTGFYEKHAIKVLLGERAININREKQTVYSSSGREIQYDKLILATGSYPFVPPIKGNESKDCFVYRTIEDLKAIEACAKKSKSGVVIGGGLLGLEAAGALKALGMETHVVEFAPKLMAEQLDQAGGDQLRQKIERMGVKVHTSKNTLEIAAEGEQARNVMRFADGTELETDFIVFSAGIRPQDKLARQMGLGIAPRGGIEINDHCQTTDNNIYAIGECASWNKMFYGLVAPGYKMATVAVDHLLGNIDSKFEGADMSAKLKLLGVKVGSIGDANGRTPGCKSYVYQNEELEVYKRLIVSPDNKKLLGAVMVGDTSDYGDLLQLMLNEIELPQHPDTLILPAHAGAEKPKLGADSLPDSAVICSCFDVTKGKIAQAVADGHHTIGDIKAVTGAGTGCGGCIPLVTSVLNAELAKAGVEVKSDICEHFAYSRQELFHLIRIEEIKTFDELLAKHGKGYGCEVCKPAVGSILASCWGEHILKPQLVKLHDTNDNFLGNMQKDGTYSVIPRMAGGEVTPQALKVLAEVAAEYNLYTKVTGAQRIGLFGAQKDDLPAIWKKLIAAGYETGQAYAKALRMAKTCVGSTWCRYGVQDSVGLGVFIENRYKGIRTPHKMKFGVSGCTRECAEAQGKDLGIIATDAGWNMYVCGNGGMKPRHADLLASDLDQETLIKYIDRFMMFYIRTSAPLQRTSVWLGNMEGGVDYLRQVIVEDKLGINEQLEADIAKLVEAYRCEWNETINDEAQLTRFAHFINSDKRDENVVFVSERQQHRPATFAEKHPELKGDILHVAVTE

SEQ ID NO: 4769 - protein, 99 aa, Mastigocladus laminosus
MATYKVTLINEAEGLNKTIEVPDDQYILDAAEEAGIDLPYSCRAGACSTCAGKLISGTVDQSDQSFLDDDQIEAGYVLTCVAYPTSDCVIETHKEEELY

SEQ ID NO: 4770 - protein, 323 aa, Solanum aphyodendron
EVKVGDSIEIVRFFHCYKRGVDRVFVDHPMFLEKVWGKTGSKIYGPKAGQDYLDNELRFSLLCQAALEAPRVLNLNSSKYFSGPYGENVLFITNDWHTALIPCYLKSMYQSRGMYLNAKVAFCIHNIAYQGRFAFSDFPLLNLPDEFRGSFDFIDGYEKPVKGRKINWMKAGILESDRVVTVSPYYAQELVSAADKGVELDNVLRKTSITGIVNGMDTQEWNPATDKYTDVKYDITTVMDAKPLLKETLQATVGLPVDRKIPLIGFIGRLEEQKGSDILVAAIHKFIGLDVQIVVLGTGKKKFEQEIEQLEVLYPNKAKGVAK

SEQ ID NO: 4771 - protein, 323 aa, Solanum appendiculatum
EVKVGDSIEIVRFFHCYKRGVDRVFVDHPIFLEKVWGKTGSKIYGPKAGQDYLDNELRFSLLCQAALEAPRVLNLNCSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDNVLRKTSITGIVNGMDTQEWNPATDKYTDVKYDITTVMDAKPLLKEALQAAVGLPVDKKIPLIGFIGRLEEQKGSDILVAAIHKFIGLNVQIVVLGTGKKEFEQEIEQLEVLYPNKAKGVAK

SEQ ID NO: 4772 - protein, 172 aa, Oryza sativa
  misc_feature (11)..(11): Xaa can be any naturally occurring amino acid
  misc_feature (21)..(21): Xaa can be any naturally occurring amino acid
  misc_feature (49)..(49): Xaa can be any naturally occurring amino acid
RGKTNFLMVGXKNKAADLVSXRAAIRARCHYVNKKWLAGMLTNWSTTEXRLHKFRDLRTEQKTEGFNRLPKRDAAVLKRQLSRLETYLGGIKYMTGLPDIVIILDQQEEYTALRECITLGIPTISLIDTNCNPDLADISIPANDDAIASIRFILNKLVFAICEGRSSYIQNS

SEQ ID NO: 4773 - protein, 323 aa, Solanum brevicaule
  misc_feature (71)..(71): Xaa can be any naturally occurring amino acid
EVKVGDSIEIVRFFHCYKRGVDRVFVDHPMFLEKVWGKTASKIYGPKAGLDYLDNELRFSLLCQAALEAPXVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAK

SEQ ID NO: 4774 - protein, 323 aa, Solanum bulbocastanum
EVKVGDSIEIVRFFHCYKRGVDRVFVDHPMFLERVWGKTGSKIYGPKAGLDYLDNELRFSLLCQAALEAPRVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAK

SEQ ID NO: 4775 - protein, 51 aa, Passiflora citrifolia
  misc_feature (42)..(42): Xaa can be any naturally occurring amino acid
WEYQVGPSVGIEAGDHIWCSRYILERITEQAGVVLTLDPKPXEGDWNGAGC

SEQ ID NO: 4776 - protein, 323 aa, Solanum caesium
  misc_feature (185)..(185): Xaa can be any naturally occurring amino acid
  misc_feature (236)..(236): Xaa can be any naturally occurring amino acid
  misc_feature (321)..(321): Xaa can be any naturally occurring amino acid
EVKVGDSIEIVRFFHCYKRGVDRVFVDHPMFLEKVWGKTGSKIYGPKAGQDYLDNELRFSLLCQAALEAPRVLNLNCSTYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPXYAQELVSAVDKGVELDNVLRKTCITGIVNGMDTQEWNPATDKYTDVKYDIXTVMDAKPLLKEALQAAVGLPVDRKIPLIGFIGRLEEQKGSDILVAAIHKFIGLDVQIVVLGTGKKEFEEEIEQLEVLSPNKAKGXAK

SEQ ID NO: 4777 - protein, 389 aa, Campylobacter jejuni
MNNIVHKLKTLVLNEAFGGVLLIVCTLLALLVQNGSFSEHYREFLNLKVGFSVGEFELNKPFLLWINDGLISIFFFAIGLELKKEFLHGDFKNPKNIVLPFMAALGGILIPAMLFALVNIGDAYTLKGWAIPTATDTAFALAILMMCGKHIPSSLKIFLLSLAIFDDVGAILIIAIFYTTKLSIVAFVVAGLAILAMLILNLLGITRKSFYFICSVILWISVLKSGVHATLAGIVTAFFIPMQTKNGEAFLEEIYESLKFWIAFIILPLFAFANAGVNLSNIDIGAIFSGVSIGIFLGLFVGKQVGVFLFSYLAIRFKFAALPQGSNLKQLYGVCILTGIGFTMSLFIDGLAYEVSDIFNYADNLAILIASFCSGIWGFIYLKFFTTRS

SEQ ID NO: 4778 - protein, 105 aa, Triticum aestivum
PTRQVCTKKQAGTGPEFPGYRRPTCPPERRLYPGGSYFDPLGLAADPEKKETLQLAEIKHARLAMVAFLGFAVQAAATGKGPLNNWATHLSDPLHTTIFDTLGSS

SEQ ID NO: 4779 - protein, 382 aa, Campylobacter jejuni
MQMIKKMVLSETFPGILLIFFTFLALLCKNSSLSVIYTDFFHANFTVGFDHFQISKSLDLWINDGLIAIFFLCIGLELKYEILRGQLKNIRAVSLPIFGALGGMITPALIFIAINYAHDFAMKGWAIPTATDIAFAVGILMLLGNKIPTSLKLFLLSLAIFDDLGAIVIIALFYTDQLSALAIIICLFCIFALLLLNYYHITHLSLYVLVGVVLWIAMLKSGVHATLAGVIISLFIPLDTKNKKPYLHEVLKDLNPWVVYFILPLFAFANAGIDIRDMHLGSVFSPVSLGIILGLFLGKQLGVFTFCFIAIKLKLAKLPENIKYGKFYGICILTGIGFTMSLFIDGLAYKNSDIFEYADKLAILVASFLSAIVGFIYLKIVK

SEQ ID NO: 4780 - protein, 179 aa, Sulfolobus tokodaii
MYIMPLRPGRCYRHFSGPAYTRKEYIPGVPMPKITKFTMGNVNGNYDYELRLVALEKGQIRHNALEAARVLALKQLTNKTGSDQNFALIVLKYPHHVIRENKMMAFAGADRLQDGMRLSFGKPIGTAARIERLGDIIMIAKVKKEHLEIAKKAFEAAASKIPLKTKIDIVPIPKEAVVQ

SEQ ID NO: 4781 - protein, 55 aa, Passiflora coccinea
WEYQVGPSVGIDAGDHIWCSRYILERITEQAGVVLSLDPKPIEGDWNGAGCHTNY

SEQ ID NO: 4782 - protein, 632 aa, Bacillus cereus
MCGYVGCLYNTAKRYSETEKIQFENMTNLLYHRGPDDQGYFRDEHVQFGFRRLSIIDLDAGHQPLAYENERYILMFNGEIYNYIELREMLIKQGACFSTQSDTEVIVALYAQVKEECVNYLRGMYTFVIWDRQEKKLFGARDHFGIKPLYIAQQNDITFFASEKKSILHVMQDKGVNPTALQHYFTYQYGPEPETLTNDINKIEPGHYFIKEIGKELEVYRYWKPYFNASDKTKEDHIRAIRDVLYDSVKVHMRSDVPVGAFLSGGIDSSIIASIAKEINPNLLTFSVGFEHRGFSEIDVAKETAEKLGVKNYSVLVTPQEFMNEFPKIMWHMDDPLADPAAVPLYFVAKEARKHVTVVLSGEGSDELFGGYNIYREPNSLKMFSYIPTSGKTVLKALSGVLKEGFKGKSFLERGCTPIEERYYGNAKIFREEEKIKLIKSYNESVNYKDVTKPLYNEIKNYDDVSKMQYIDMYTWLRGDILLKADKMSTAHSLELRVPFLDKEVFDVASKIPTELKIANRTTKVILREAVRGIVPDHVLDRKKLGFPVPIRHWLKDEMYDWALNIIKESKTEHLIDKQYVLNLLEAHCADKGDYSRKIWTVIAFMVWHQIYIEHKYDTNLFSEECRVYNLV

SEQ ID NO: 4783 - protein, 357 aa, Dioscorea nipponica
LKQKIDRMYNGEKINSTENRSVLHIALRAARDKVIESDGKNVVPDVWHVLDKIKEFSDRIRSGSWVGATGKALTDVMAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSIPFEKNIPVLLGLLSVWNVSFLGYPARAILPYSQALEKFGPHIQQVSMESNGKGVSIDGIPLPFEAGEIDFGEPGPNGQHSFYQLIHQGRVIPCDFIGVMRSQQPIYLKGEVVSNHDEL

SEQ ID NO: 4784 - protein, 357 aa, Dioscorea quinquelobata
LKQKIDRMYNGEKINCTENRSVLHIALRAARDKVIESDGKNVVPDVWHVLDKIKEFSERIRSGSWVGATGKALTDVVAVDIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 4785 - protein, 357 aa, Dioscorea septemloba
LKQKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLGYPARAILPYSQALEKFAPHIQQVSMESNGKGVSIDGFPLPFETGEIDFGEPGTNGQHSFYQLIHQGRVIPCDFIGVMRSQQPIYLKGEVVSNHDEL

SEQ ID NO: 4786 - protein, 576 aa, Gossypium hirsutum
MITLTDFYHVMTAMVPLYVAMILAYGSVKWRKIFSPGQCSGINRFVALFAVPLLSFHFIASNDPYAMNFRFIAADTLQKVMVLGILAVWSKVSKRGCLEWTITLFSLSTLPNTLVMGTPLLKGMYGEFSGSLMVQIVVLQCIIWYTLMLFMFEYKGAKMLISEQFPDTAGSIVSIHVDSDIMSLDGRQPLETEAEIKEDGKLHVTVRKSNASRSDIFSRRSQGLSSTTPRPSNLTNAEIYSLQSSRNPTPRGSSFNHTDFYSMMAGGRNSNFGAADVYGLSASRGPTPRPSNYEDDGTGMGKPRFHYHAQGGAGAAHYPAPNPGMFSPNGSKANTKKPNDQAPQKAEDGGRDLHMFVWSSSASPVSDVFGGGGGHEYGANEQKEVRVAVSPGKAEGHRRNNEEYMEREDFSFGNRGLEREMTNNHEGDKVGDGKPKTMPPASVITRLIIIMVWRKLIRNPNTYSSLRGLTWSLISFGLFMALQPRIIACGNSVAAFAMGVRFLAGPAVMAAASIAVGLRGVLLHVAIVQAALPQGIVPFVFAKEYNLHPDILSTAVIFGMLIALPITLVYYIVLGL

SEQ ID NO: 4787 - protein, 337 aa, Prochlorococcus marinus
MALVQAAPGTVLITGTTSGVGLYATKSLVERGWRVITANRCSVRAEASASAVGLPTNSPRQLKHIQIDLGDLDSVRNGAKSLLEDLEKPLDALVCNAAVYLPRLKKPLRSPQGYEISMATNHFGHFLLIQMLLENLSKSSRPVWKGRSWGVESSRVVILGTVTANNKELGGKIPIPAPADLGNLSGFEEGFCDPISMASGKRFKPGKAYKDSKLCNMITTQELHRRFNSSPILFSSLYPGCVANTRLFRNTPKLFQWLFPWFQKLITGGFVSEALAGDRVAQVVSDPQFAISGVHWSWGNRQRKNRQQFSQELSDRVTDPVTSRKVWELSMRLVGLK

SEQ ID NO: 4788 - protein, 735 aa, Yarrowia lipolytica
MSFRQQFQQGGNPNGQMGFNNMNMSPNMNNAKIGGMDMGAQMGQMGQMGQMPQMAQMGQMGQMGGMPQMGGPMGGQMNGMNMGGMSGAGGMPNVGGMPNMAGMPNMGQGMNMGQGMNPQVGRGGPMGPQGMMGQQGMGGMQQGGQVQMGGGPQMQPPQRQPQPQQQQQQQQQQQQHHHQQQQQQVPMPQSQLIPQQGGIPVMAGGQPQKNFDFPPPGQTMMQPGLTVPPVQSHLGLVSSDDARQQETPLVNPPSAAESLAEMPTLFNGQGITDLTEIMKNKRDPKTAQELNLRRFVSKDLNESSTLPKKLKQEADKLNAKRYEISFYHSFGPIRSQEPQSIFQDGYLGYGNGWTGLNTRFVYPRDRKKHNRNTRDLVLSRQQMNQQAAEPELLVPIRLDFDLGRLRLRDTFMWNLNEKTYPVHFFVENMFEDFHFPHQYIQSVTNSITEQLQDFQPHQYPQDPRHVIGNGDATRNEDMRVVVRLDITVGQHNLIDQFEWDINDSLNSPEEFAATMCAELSLSGEFATAIAHAIHEQTQVFSKSLLLLGHTFDQRPVDDEDIRREICAPIPDGSVMRPKNSVNEYSPALFEISEAELSRLDKDKDRDSRQKRRQGRAGRRGAPSLPDFKKVVRTFRTPVYSAVLPGAVDRKVELAKQALQAEEEEEEEDSDGNVVVRPAKRQRTTGRHVPVRAAAANAAVAVAAQSQELETNYVEELADPTSFWVTLKCPHSSLRG

SEQ ID NO: 4789 - protein, 357 aa, Dioscorea tenuipes
LKQKIDRMYNGEKINCTENRSVLHIALRAARDKVIKSDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGIMRSQQPIYLKGEVVSNHDEL

SEQ ID NO: 4790 - protein, 424 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVEAANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 4791 - protein, 164 aa, Gluconobacter oxydans
MTCAYDFSLPGLSGDTIDLSAYRGRPLLIVNTASKCGFTPQYEDLQHLWSRYGRDYPEGLMIIGVPSNDFGQQEPGSSEDIKNFCHRNYGVSFPMTARQHVRGPETTPLFRWLDKQGGFLARPRWNFYKYLTDRDGNLANWFTPLAKPASNRVEEAVRKVLLDH

SEQ ID NO: 4792 - protein, 384 aa, Arabidopsis thaliana
  misc_feature (12)..(12): Xaa can be any naturally occurring amino acid
  misc_feature (117)..(117): Xaa can be any naturally occurring amino acid
MSHSAVSQGWCXVQLSIENQRSLRRSVFKQNNSISFNSKSWSSSLALNQKTTSIRDGKRYPSTTICMSVQQTSSSKVTVSPIELEDPKDPPLNLYKPKESYTAKIVSVERVVGPKAXPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 4793 - protein, 418 aa, Glycine max
MLSSNVVPSSSPVTFSKPNHHFFINASPNPKPNLLRFQAQHRTTPLKSSKLSFMPTSQIQHSIAKLGSFSRFLSHPFELSSKPRYQIVKAASEANPEGENVAPTEPNSKNLKLGLVFGLWYFQNIVFNIYNKKVLNIFPFPWLLASFQLFVGSIWMLVLWSLKLQPCPKISKPFIIALLGPALFHTIGHISACVSFSKVAVSFTHVIKSAEPVFSVMFSSVLGDKYPIQVWLSILPIVLGCSLAAVTEVSFNVQGLWCALISNVGFVLRNIYSKRSLQNFKEVDGLNLYGWITILSLLYLFPVAIFVEGSQWIPGYYKAIEAIGKASTFYTWVLVSGVFYHLYNQSSYQALDEISPLTFSVGNTMKRVVVIVSSVLVFRNPVRPLNGLGSAIAILGTFLYSQATSKKKAQKIEDEKTS

SEQ ID NO: 4794 - protein, 348 aa, Fulvimarina pelagi
MTKYKLEYIWLDGYTPVPNLRGKTQIKSFDDFPTLEQLPLWGFDGSSTQQAEGHSSDCVLKPVAVYPDPARRDGVLVMCEVMMPDGTTPHVSNKRATILDDEGAWFGFEQEYFFYKNGRPLGFPEQGYPEPQGKYYTGVGYSAVGDIARTIVEEHLDLCLAAGINHEGINAEVAKGQWEFQIFGKGSKKAADEMWMARYLLQRLTEKYCIDIEYHCKPLGDTDWNGSGMHANFSTKYMREVGGKEYFESLMGAFEQNLEDHIAVYGPDNHMRLTGKHETAPWNKFSYGVADRGASVRVPHSFVNNGYKGYLEDRRPNSQGDPYQIASQILKTIAEVEERTEGGISVAA

SEQ ID NO: 4795 - protein, 491 aa, Arabidopsis thaliana
MSDLQANKDETTVDRQSSSSVDLDGPSPLRKMISVASIAAGIQFGWALQLSLLTPYVQLLGVPHKWPSFIWLCGPVSGLLVQPSVGYFSDRCTSRFGRRRPFIATGALLVAVSVVLIGYAADFGHSMGDKIDKPVKMRAVVIFALGFWILDVANNTLQGPCRAFLGDLAAGDAQKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWVLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLAITFSIPFALASIISSSSGAGQRLSLGVLNMAIVIPQMIVSFGVGPIDALFGDGNLPGFVVGAIAAAVSSIVAFTVLP

SEQ ID NO: 4796 - protein, 112 aa, Fulvimarina pelagi
MKKVEAIIKPFKLDEVKEALQEVGLQGITVTEAKGFGRQKGHTELYRGAEYVVDFLPKVKVELVLGDDVVATAVEAIRKAAQTGRIGDGKIFVSNIEEAIRIRTGEAGTDAI

SEQ ID NO: 4797 - protein, 322 aa, Arabidopsis thaliana
MASRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 4798 - protein, 957 aa, Escherichia coli
  misc_feature (165)..(165): Xaa can be any naturally occurring amino acid
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVXKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFNVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 4799 - protein, 1367 aa, Ustilago maydis
MAPVRRLARASSSASVSSSPANLPTPTLSGPQLQSTSNAEPRISVHQTPTAAPRVLQHPSTSPSKPHGSNSFDAPIILSDTETDNGTAGIVQHTGSSDDDMTAPHRTAGVDNGKAQRLSLLFPAITDNHQDESRSSTTLDRSYATSLNSEVNLISDGSLSSLSSIDSDSDVTDDSDNKSIAAAISSLRSTPRQTHNKTPALLSKRGTEATPEATASSSSSSSTPSRRSARIVSSGSSIQKALQRRDDLDAKLLASPLRRKPDSPEAPPPPRRAVGRPRKSVQPVPAQSSAARLSTSPAVLPSSVQNLASPSSTRRSARLSLPFPMAPNSEYPASKDASQSPRREAELGPRPELRPGKHSRKFAEASDKSKPVITLQPFSDSVTFSASVGSAISNGPVGNSPAVTSDAQSIPTLPVERSRGRPRKSQPGLPTFPQTPAALTAEREQPALVTRLRKRNLSTAGMTAKSESLAVDEQQEDSDFPPRKRGRPARSSTSATDRTAGEPLSTASGQTLHGRTPLRIDVIDLLDDDLSELSDASDMSLNSSQPHQSASQSIQSGESHRQRPPQASTLPSKKLKRASKQNKDGKIYHYTGLYAGEADAVASTSSLYPDASQSTLLPYPIHFGAKLLTEERDFCLPYPIHQTMDQLRDRVNAKRKPPRYQQINKNKYVTRAKLQGEVPLCNCKPGSGCGHDCINRMLMFICDPKTCPSASNCTNISLGRRPHVKTAVAYYGRRGFGLKTLEAIKRDDFIDEYRGEVINLSEAAKRVTEEYKATGNYYLLDYDSAAGELLDGGRKGNITRFANHSCDPNCRIEKFIICGTDEALSAEFQIGLFANRDIAAGEELTYNYGWAAFQPRDITGAPTAQVPTEQCLCGAANCSGILGGKKAPVSKSAADAVAANTRKKTGKGRGKRKSKGKVSKSTQSSRIHLTSMAPLLSASRLSAAAIPSSALSSVEAARNLRKREDAQTRRNAISKITIKRRERSGRSAGDASSSTSASVTDSSVEPVTETWTKQISVPGGKNGQQIPRSRAAKAVHATKSRQAPRDPISSFSQVIDLTGEHATPSPIEAISPKEASSTSTSVQFTGPTDADQAALGGDVLSSSASRVFPQLPLPKRINIKKPGGGFGAMAARGTKDRRWLTAEAPSSDNDDSSSIRCDSAEYPSDILKEDDEAQLQDSSGKVPGKKRRGRHKLQLSAEEMARRAVERRARNAFLARKRRASKRGIVVMDPSHHPLKKISIQCTAAPENTYIPDLPSSLVTLGMTIADARRARNAFLARVRRAIKRGFPKDAAIKMAAKPLPGDPERDTPVMKAQRAYMEQLEREAADEVTDSSQNGHGSSGSVSASNSSVAAEDDDWEDEPRWAAAL

SEQ ID NO: 4800 - protein, 196 aa, Ralstonia solanacearum
MSRRAEVTRNTSETQIRVALDLDGTGKQTLNTGVPFLDHMLDQIARHGMVDLDVTATGDTHIDDHHTVEDVGITLGQAVAKAIGDKKGIVRYGHSYVPLDEALSRVVIDFSGRPGLEFHVPFTRARVGSFDVDLSIEFFRGFVNHAGVTLHIDNLRGVNAHHQIETVFKAFGRALRMAVEIDPRAAGTIPSTKGAL

SEQ ID NO: 4801 - protein, 483 aa, Mycobacterium leprae
MSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 4802 - protein, 309 aa, Clostridium acetobutylicum
MGKIYKNLIETIGRTPLVELSNYKEKNKIEGNILGKVEYFNPSGSIKDRIAYSMIKNAEEQGLINKDTVIIEPTSGNTGVGLAFIAAAKGYKLILTMPETMSVERRKLLTAYGAEIVLTSGVEGMTGAIKKANELASENPNSFIPQQFKNPSNPAIHEVTTGIEIWEDTDGKVDAVVAGVGTGGTITGIAKTLREKNKDIKIIAVEPATSPVLSGGKAGPHKIQGIGAGFVPDVYEAELIDEIIQVKNEDAFASAKELAREEGILAGISSGAALFAAKEVASRPEFKGKNVVVILPDSGQRYLSMSVFD

SEQ ID NO: 4803 - protein, 380 aa, Clostridium acetobutylicum
MSKKEIIAMILAGGQGSRLGILTRRTAKPAVPFGGKYRIIDFTLSNCSNSGIDTVGVLTQYKPLALNSHIGIGSPWDLDRTSGGVSVLPPYMKETGGNWYKGTANAIYQNRHFIENYDPEYVVILSGDHIYKMNYLEMLDFHKKKNADATIAVFEVPLNEASRFGIMNTDEDDRINEFEEKPKKPKNNLASMGIYIFNWRFLKRFLEEDARDESSNNDFGKNIIPNMLNKKRKLYAYRFNGYWKDVGTIQSLWEANMDLLDDNNSLNIYDPKWKIYSVNPTMPPQYIACNSDVKRSLVVEGCIVLGKVYNSVLFPGVYIGRDTIITNSVIMPNVIVGNNVIIKKSIIGSNARVDDNVIVGTNDNISVVGAGSKVKESIIQ

SEQ ID NO: 4804 - protein, 372 aa, Clostridium acetobutylicum
MLNNYMSILSLNENDNDIKSLTKARPLASIPIAGRYRIIDFILSNLVNSGVKNIGILTQCKSRSLLDHLGSGKPWDLDRKLNGLFIFNFSGITSTLSDIEMLKSNMEYLYRSTQEKVILSSSAVICNIDFQRAAEFHEKSGKDITLIYKRTNNGKRKFLNCSVLNMDKNNNVISIGKNTGLDDVQNISLGMFIMNKKLLINILNNCIRTGFSLSLKQCIRKHMNNFTVNAYEFNGYAEYIDSVKSYYKVNMDMLNLDINREVFFKNGLIYTKVKDEAPTKYFNDSEVCNSLIANGSLIHGQIENSIIGRRVTISKGARIKNCVIMQNCTIKENVDLTNVIVDKNVIIDENTVLKGGKEFPLVIEKKSIYSEV

SEQ ID NO: 4805 - protein, 190 aa, Aspergillus oryzae
MGKSQSKLSPSQLDELQKATHFDKKELQQWYKGFLKDCPSGTLTKEEFQKIYRQFFPFGDPSSFANYVFRVFDSDNSGMIDFKEFICALSVTSRGKMEDKLDWAFQLYDIDGDGKITYDEMLAIVEAIYKMVGSMVKLPEDEDTPEKRVRKIFRMMDKDENGSLDMEEFKEGSKRDETIVSALSLYDGLV

SEQ ID NO: 4806 - protein, 323 aa, Solanum calileguae
EVKVGDSIEIVGFFHCYKRGVDRVFVDHPMFLEKVWGKTGSKIYGPKAGQDYLDNELRFSLFCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAADKGVELDNVLRKTCITGIVNGMDTQEWNPATDKYTDVKYDITTVMDAKPLLKEALQAAVGLPVDRKIPLIGFIGRLEEQKGSDILVSAIHKFIELDVQIVVLGTGKKKFELEIEQLEVLYPNKAKGVAK

SEQ ID NO: 4807 - protein, 648 aa, Oryza sativa
MQAKESKKSRDRGRDRVKWNEENLNDIESTKPKKKKKKKKKKKKNKKKKKKKKKKKKKKKKKKRWPSNKAQHIMSDTSHIKKINTGRNNFRNANVPLCVRGSKICIQHPQFLHIVITPLSGHGHTKIGVIRGVYLQKEQDKPGHSRYSRRRPPPAAPVAAVAVAADDDELGGGRTPEQPPRGTVRPAGTPSASAMAAHPFPLPFLPQCTSILCDADTDNLWLASGNAQSSAAVRSRLLAAEREEAKAVLSLFLRQKGLRSILAARIANKADGFIEHLVSKLHITYRSRYAEGRELSTPEIRDALIPYLEALSKEHGDGLVEVVENFPDPFAMEREALSSSMVLTPTSSNKHKAIARVSAPTSGGALPELVLYLLDLGMDHEEIKNVVRKFPAFAYYNVDRKIKPLVALLLELGVPRSNIPGIIKKRPQLCGISLSDNLKPMMTYLENVGINKDKWSKVLSRFPALLTYSRQKVETTVSFLTELGVPKENIGKILTRCPHIMSYSVNDNLRPTAEYFQSIGADAASLIQKSPQAFGLNIEAKLKPITEFFLERDFTMEEIGTMANRFGIIHTLSMEDNLLPKYEYFLTMGYPRNELVKFPQYFGYSLEQRIKPRYARMIDCGVRLILNQLLSVSDSRFEDILRKRMDGI

SEQ ID NO: 4808 - protein, 952 aa, Mycobacterium leprae
MSVPNSSNKQTCFTARHIGPNSEDVATMLAVIGVESLDDLAAKAVPSDILDNVTDTGVAPGLDRLPPPATESETLAELGALARANTVAVSMIGQGYYDTLTPAVLSRNILENPAWYTPYTPYQPEISQGRLEALLNFQTLVSDLTGLEIANASMLDEGTAAAEAMTLMYRAARSTASRVVVDVDVFAQTVAVFATRAKPLGIDIVVADLREGLPDGEFFGVITQLPGASGRITDWTALIAQAHSRGALVAVGADLLALTLITPPGEIGADVAFGTTQRFGVPMGFGGPHAGYLALHTKHARQLPGRLVGVSVDSDGTPAYRLALQTREQHIRRDKATSNICTAQVLLAVMAAMYASYHGAEGLTGIARRVHAQARALAAGLSAAGVEVVHQAFFDTVLARVPGRTVQIQGAAKERGINVWLVDGDHVSVACDEATTDEHITAVLAAFAATPARASFAGPDIATRTSAFLTHPTFTKYRTETSMMRYLRALADKDIALDRSMIPLGSCTMKLNAAAEMESITWQEFTRQHPFAPVSDTPGLRRLISDLESWLVQITGYDAVSLQPNAGSQGEYAGLLAIHDYHVSRGEPHRNVCLIPSSAHGTNAASAALVGMRVVVVGCHDNGDVDLDDLRIKLSEHANRLSVLMITYPSTHGVYEHDIAEICAAVHDAGGQVYVDGANLNALVGLARPGKFGGDVSHLNLHKTFCIPHGGGGPGVGPVAVRSHLVSFLPGHPFAPELPQGQPVSSAPYGSASLLPITWAYIRMMGADGLRTASLTAIASANYIARRLDKYFPVLYTGENGMVAHECILDLRPITKSVGVTVDDVAKRLADYGFHAPTMSFPVPGTLMVEPTESESLAEIDAFCEAMIAIRGEIARVGAGEWSVEDNPLRGAPHTAECLLASDWDHPYTREEAAYPLGKAFRPKVWPPVRRIDGVYGDRNLVCSCLPVEAFV

SEQ ID NO: 4809 - protein, 379 aa, Nicotiana tabacum
MAIDCMITNVKSPILRILEDEKKPLIFDASQMKREYNIPTQFVWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSISPNFNAFVVNIGDTFMALSNGRYKSCLHRAVVNNKTPRKSLAFFLCPKKDKVVSPPTELVDTNNPRIYPDFTWPTLLEFTQKHYRADMNTLQTFSNWLQQKTAQV

SEQ ID NO: 4810 - protein, 192 aa, Xylella fastidiosa
MNMLNVLRFPVLALALAFVSSGVLADVGSLLDLDYRPLAGKETVNLQRLYGGKVLLVVNTASKCGFTPQYEGLEALHQKLSPLGFAVLGFPSNDFKGQEPGDEQQIQEFCTLTYGVKFPMFQKVHVKGNEVTPLYQRLTQTTGVAPGWNFHKYLIARDGHVVAQFDSRTRPDDPILLEAIKRELAKSVQVVH

SEQ ID NO: 4811 - protein, 987 aa, Unknown
  Vibrio sp. Ex25
MLLATASIGRKLLLSFIAMAMLVMLSALIGVSGFSLVAKTERNVVDSAIPAMIEARQVSELSTRIISSVQLLSNARNEQERKESGRVLFEQLESLLTHIKELGSESFDSQLLEDLENNVQNVIDNLAELGVSVERKLWLAKEIDTRVEEMRLLSEELEQLTRTQVQNTSTIAVANVTHIYDLLESNKKSQVYQALDALVEVDLDLTERLHELHLLAFKMLNQIEEARTLTNIERIQQVQSDFESNLKIMKRRVLAVEDPTRSKQMSQLLTELGKRQVVFTILMQQYENNEQSQQLMQKTLELFSELNGTVNKLVDDSNKTTTVAVDELTSTLKFAQWSLTVISIVGLIVLVLILWRVVYLSVVKRLAEYSAALLSVAQGNLAVELEVKGKDELAHMGQAIITARNTAQALKVVAEGEAQAKRELEEHKEHLEELVEQRTSQLKQANRRLNEEVLNHAKARKQAEQASRAKSAFLATMSHEIRTPMNGVLGTARLLIDSGLNPIQKRYAEIINRSGKTLLAILNDVLDYSKIEAGHLEIRHMGFDLHQMVEDTFQLMNSRAQEKRLLFSYHIESDVSRYWKGDVTRISQVLNNLVGNAIKFTDEGEIDIYVSLNPEDESQVLFEVSDTGIGIAKKDQRTLFDAFTQAEGGMSQTGGTGLGLAISKRIIEAMGGILEVDSEEGHGSRFWFSIPLEESEPVETGAVATARCKVKAKVLLVEDNEVNRVVAEGFLESMGHQVVMAENGSQAEQLISTQDFDIALVDINLPDCDGTELIQRLKQIECNKPANKALAATPMIAVSAHVFAEEVERYLAAGFDGYLPKPLAKEALAALIQDVLDGKPLLLPQNADCTPFDQTSPQEQAIQSKVVQVPKTEESDVVIINPSVIESDMKILGREKMLHIINLFRTTSADVLSKLQASAGGNDSKEVKNLAHKLKGSAGSLGLTALMNSCQAIEAAPQPLDTYMATKDQLASQVSESIQALDELMAK

SEQ ID NO: 4812 - protein, 470 aa, Pennisetum glaucum
MAVFSRTCLDSRFQVKKKQFFRNFMTITLFGAVGTMISFFTISLGAIAIFSRMNIGTLDVGDFLAIGAIFSATDSVCTLQVLNQDETPLLYSLVFGEGVVNDATSVVLFNALQNFDLNHIDVAVVLKFLGNFFYLFVSSTLLGVFAGLLSAYIIKKLYIGRHSTDREVALMMLMAYLSYMLAELLDLSGILTVFFCGIVMSHYTWHNVTESSRVTTKHAFAFATVSFIAETFLFLYVGMDALDIEKWEFASDSPGKSIGISSILLGLVLAGRAAFVFPLSFLSNLTKKTALEKITWRQQIVIWWAGLMRGAVSIALAYNKFTRSGHTQLHGNAIMITSTITVVLFSTMVFGMMTKPLIRFLLPASSNTVTSEPSSPKSLHSPVLTSMQGSDLEVATANIVRPSSLRMLLSKPTHTVHYYWRKFDDALMRPMFGGRGFVPFYPDHPPTRSMRTVTGKKPKIGHQEMKTCFW

SEQ ID NO: 4813 - protein, 367 aa, Nicotiana tabacum
MHDETQNEKTTSLVFDALFLQNNSNIPQQFIWPEGERPCPEPPPPLHVPPIDLNDYLSGDPLAVSNATRLVNQACRKHGFFLVVNHGIDSKLINEAHKNMDFFFEKPLVEKERAKRKLGDYCGYASSFTSRFSCNLPWKETLSFRYSAEVPSSQHIVQSYILNVMGQDYTHFGNVYQKYCEEMSKLSLKVMELLGESLGVGRAYFREFFEGNDSIMRLNYYPPCKKPDLTLGTGPTCDPTSLTILHQDNVGGLEVFVDEKWYSIPPNTNAFVVNIGDTFMVMSNGTYKSCLHRAVVNSRKPRKSLAFFLCPKKDKIVSPPKELITRNVPRKFPDFTWPVFLEFTQKHYRADKKTLDAFVHWLLHKGY

SEQ ID NO: 4814 - protein, 496 aa, Pseudoalteromonas tunicata
MADQKPQLSFWQIWNMCFGFLGIQFGFALQNGNVSRIFQTLGASIDDIPILWIAAPLTGLIVQPIIGYMSDKTWGKLGRRRPYFLWGAILTTLALVIMPNSPTLWIAAGMLWIMDASINVTMEPFRALVGDNLPKKQRATGFAMQSFFIGIGAVVASALPWMMTNWFEISNVAPEGQIPDSVKFSFYFGAAVLFIAVGWTIIKTKEYSPQELAHFEQAEQDSPVHASVKPTIFTQGLVRNGAIALAILASVFVFELEKELYLAGIGLALFTAMQLLAKKMGQSAKTDNGFYHVMGDLFTMPEAMKQLAWVQFFSWFALFAMWIYTTSAVTSYHYGSSDATSQLFNDGADWVGILFAAYNGFAALAAVVIPVCVKRMGLKATHMLNLGLGALGLMSFLIINDPQLLLLSMVGIGFAWASILSLPYALLSSQVPSAKMGVYMGIFNFFIVIPQLLAASILGVLVKNLFQGQAIYALLLGGLSFLIAAACMLRVKYQNQ

SEQ ID NO: 4815 - protein, 323 aa, Solanum crispum
  misc_feature (84)..(84): Xaa can be any naturally occurring amino acid
EVKVGDSIEIVRFFHCYKRGVDRVFVDHPMFLEKVWGKTASKIYGPKAGQDYLDNELRFSLLCQAALEAPRVLNLNCSKYFSGXYGEDVFFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAK

SEQ ID NO: 4816 - protein, 112 aa, Unknown
  Mesorhizobium sp. BNC1
MKFVMAIIKPFKLEAVREALTELGIQGLTVTEVKGYGRQKGHTEIYRGAEYAVSFLPKVKIEVAVDSDIADQAVQAIAGAAKTGQIGDGKIFVYSIEKAVRIRTGETDADAL

SEQ ID NO: 4817 - protein, 299 aa, Pseudomonas fluorescens
MSERKALLILHGKQALNEEVRAAVEARRAAGWDLQVRLTWEAGDAQRLVQEALAAGHTRLIAGGGDGTLRDIAEALANADAPASLVLLPLGTANDFARAAGVPLTPAAALDLLDVPARAIDLGEVGGQMFLNMATGGFGSQVTANTSEDLKKVLGGAAYLFTGLSRFAELSAAYGELQGPGFHWHGELLALGIGNGRQAGGGHELCPGALADDGLLDISILPAPQELVGTLKNLLAGGLGIDNLFVRARLPWVEIKASRGLDINLDGEPLQGDTLRFTARPGALRVHLPEDSPLLGGAR

SEQ ID NO: 4818 - protein, 206 aa, Unknown
  Polaromonas sp. JS666
MTTPSTAPTPAPRKAEVSRNTAETQITVKLNLDGTGKASLSTGIGFFDHMLDQIARHGLIDLDIQAKGDLHIDGHHTVEDVGITFGQAVAQAVGDKKGLRRYGHAYVPLDEALSRVVIDFSGRPGLEMHVPFKSGMIGTFDSQLAYEFFQGFANHAFVTLHIDNLRGDNAHHQAETVFKAFARALRMALEIDPRSAGVIPSTKGSL

SEQ ID NO: 4819 - protein, 592 aa, Medicago sativa
MNHLPRIFGYRNKSTTEMNSKKKKQPKLQRRNAVKNFNYDAQPSSSSPESSESASSSASILCTRSMDFHDRKSFRVEGVDGEFDIICRSLGLNGPEDFSIPAAAWEAMKFRSSSDVLPRLNVSEFDETKTSGEIDQVGVVDCDDRVLVRDSPAESSGGEVNVSIRDSPAKSSGCCTGGEIRVPVRGFDETSNCSTGSGGIKGIRPPMLKPPPGVRVSVVDDTCSTWDILRDFAPEGEGKEREEQEEEEEKVDEVEEKEEVGELELKVEEEENGDIIGEFSRSCSFTTSQEDDSSSTTTDTRSNSISPNVRLKPVITPGSWQKGELLGRGSFGTVYEGISEDGFFFAVKQVSLLDQGSQGKQSVVQLEHEIALLSQFEHENIVRYIGTEMDESNLYIFIEFVTKGSLLSLYRRYKLRDSQVSAYTRQILHGLKYLHDRNIVHRDIKCANILVDANGSVKVADFGLAKAIKLNDVKSCQGTAFWMAPEVVRGKVKGYGLPADIWSLGCTVLEMLTGKIPYSPMECISAMFRIGKGELPPVPDTLSRDARDFILQCLKVNPDDRPTAAQLLDHKFVQRSFSQSSGSASPHIPRRG

SEQ ID NO: 4820 - protein, 410 aa, Pseudomonas putida
MATHVAIIGNGVGGFTTAQALRAEGFEGRISLIGDEPHLPYDRPSLSKAVLDGSLERPPILAEADWYGEARIDMLTGPEVTALDVQTRTISLDDGTTLSADAIVIATGSRARTMALPGSQLPGVVTLRTYGDVQVLRDSWTSATRLLIVGGGLIGCEVATTARKLGLSVTILEAGDELLVRVLGRRIGAWLRGLLTELGVQVELGTGVVGFSGEGQLEQVMASDGRSFVADSALICVGAEPADQLARQAGLACDRGVIVDHCGATLAKGVFAVGDVASWPLRAGGRRSLETYMNAQRQAAAVAAAILGKNVSAPQLPVSWTEIAGHRMQMAGDIEGPGDFVSRGMPGSGAALLFRLQERRIQAVVAVDAPRDFALATRLVEARAAIEPARLADLSNSMRDLVRANEGDLT

SEQ ID NO: 4821 - protein, 323 aa, Solanum adscendens
EVKVGDSIEIVRFFHCYKRGVDRVFVDHPMFLEKVWGKTGSKIYGPNAGQDYLDNELRFSLLCQAALEAPRVLNLNCSKYFSGPYGENVLFIANDWHTALIPCYLKSMYQSRGIYLNAKVAFCIHNIAYQGRFAFSDFPLLNLPDEFRGSFDFIDGHEKPVKGRKINWMKAGILESHRVVTVSPYYAQELVSAVDKGVELDSVLRKTSITGIVNGMDTQEWNPATDKYTDVKYDITTVMDAKPLLKETLQAAVGLPVDRKIPLIGFIGRLEEQKGSDILVAAIHKFIRLDVQIVILGTGKKKFEQEIEQLEVLYPNKAKGVAK

SEQ ID NO: 4822 - protein, 238 aa, Gibberella zeae
MIPRQGYAPTPHSYVPNTSLSATINLDEEVKLTNTRAERDLQESLAELFSIIITLDELEKAFLKDAVPEAEYTEICERSLRQYKALLVDETIAREFGDLEEFKARWDLEAPRATERIRVGMPSTTIDRAPSAPTPAPTAAANNTSGVLILEATQEFITFLDAVKLGLLSKDQLHPLLSDVIQSVNRVTDKDFENRGKIVQWLITLNQMRATDELSEEQARELELDIQQAYQGFRRTLT

SEQ ID NO: 4823 - protein, 201 aa, Zea mays
KSDAAVYEWTALSLRLGEPVLFIDRHARQVVTAAGSHGYDKLVLATGSYPFVPPIAGAEGASRLVYRTLDDLDQIRAAADGARRGVVVGGGLLGLEAANALKSLGLEAHVVEFAPRLMPVQLDEAGGGALRARIEALGVGVHLSRATQEIKDGTQYRYRMRFAEGAPLETDLIVFSAGIRPRDGLARQAGLTVAERGGVAV

SEQ ID NO: 4824 - protein, 59 aa, Passiflora coriacea
WEYQVGPSVGIDAGDHIWCSRYILERITEQAGVVLSLDPKPIEGDWNGAGCHTNYSTKS

SEQ ID NO: 4825 - protein, 323 aa, Solanum delitescens
EVKAGDSIEIVRFFHCYKRGVDRVFVDHPMFLEKVWGKTGSKIYGPNAGQDYLDNELRFSLLCQAALEAPRVLNLNCSKYFSGPYGENVFFIANDWHTALIPCYLKSMYQARGMYLNAKVAFCIHNIAYQGRFAFSDFPLLNLPDEFRGSFDFIDGYKKPVMGRKINWMKAGILESDRVVTVSPYYAQELVSAVDKGVELDNVLRKTSITGIVNGMDTQEWNPATDKYTDVKYDITTVMDAKPLLKETLQATVGLPVDRKIPLIGFIGRLEEQKGSDILVAAIHKFIGLDVQIVVLGTGKKKFEQEIEQLEVLYPNKAKGVAK

SEQ ID NO: 4826 - protein, 537 aa, Magnaporthe grisea
MAEPDAPPATKGGDALADTPSLKRRGSSSQQSDTSQTAAEFIREQMQLEADAREALPYSIKDCTRSLGSLRQAVFSCLTCNPPPSDPKAPYDAAGVCYACSIQCHGEHTLVEIFTKRNFTCDCGTTRFSSTSPCSLRVNPETNSKGVHSEPASTSNKYNHNFRNRFCGCECDYDPFEQKGTMFQCLGLGTHETGGCGEDWWHPGCLVGLGPAWFENMEAKKSAVKADTGGASITNKPLETISEDAEASNGATSATAGTANADPPAAVEEAEDDDPPMPPGFPEEDAFESFLCYKCVDAYPWAKRYAGSQGFLPPVFSKQTTNGAAPTLESSAVSTSGLGSQKRKAEDDFEDTAEVESKRHKTEEPVPAVTSTENPSDVKPLDKPVCKINSLAAAPSDQFSLFFKEDFREHLCRCEACFPLLKPHPQLLEEEETYEPPVSEDGNGSEHGSTQGSLLEMGESALRNVDRVRAIEGVMAYNHLKDKLKMFLQPFAQSGEAVSAEHIKEIFAKMRGDDEAIKEAAEGAKKSSDNRREQSGY

SEQ ID NO: 4827 - protein, 160 aa, Guillardia theta
MHAVLGGLPLLLPCTSAFLPSTPSSLLSSRSLTLKSAAARHASPLPRPSLAARPSPRFAAALRMAHGKCRAEYIWIGGRGGCGDDYRSKTRVLDKRPTSVSELPLWNYDGSSTGQAPGGDSEIYLQPAFMCADPMRGGDNILVLCEMIDPKNNPFPTGAL

SEQ ID NO: 4828 - protein, 112 aa, Rhodospirillum rubrum
MKKIEAIIKPFKLDEVKEALHEIGLQGITVTEAKGFGRQKGHTELYRGAEYVVDFLPKVKIELVIEDALVERAIEAIQQAAQTGRIGDGKIFVYAIEEAIRIRTGERGGDAI

SEQ ID NO: 4829 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 4830 - protein, 73 aa, Passiflora crassifolia
NGEVMPGQWEYQVGPSVGIDAGDHIWCSRYILERITEQAGVVLTLDPKPIEGDWNGAGCHTNYSTKSMREDGG

SEQ ID NO: 4831 - protein, 187 aa, Corynebacterium diphtheriae
MPANPYGNDVKEVLITEDQLQNRIQELADLVSEKYRDEKEDLVLICVLKGAVFFLTDFARKLSIPCQIEFMSVSSYGNSASSSGVVRILKDLDRDVAGCNVVIVEDIIDSGLTLKWLIKNLSGRKPKSLEIVTLLRKPEAVKTTIDCLDIGFDLPNEFVIGYGLDFAEKYRDLPFVASLNENVYTEQ

SEQ ID NO: 4832 - protein, 610 aa, Zea mays
MAALATSQLVATRAGLGVPDASTFRRGAAQGLRGARASAAADTLSMRTSARAAPRLQLHQQQQQARRGARFPSLVVCASAGMNVVFVGAEMAPWSKTGGLGDVLGGLPPAMAANGHRVMVVSPRYDQYKDAWDTSVVSEIKMGDRYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 4833 - protein, 523 aa, Gluconobacter oxydans
MLQDDLKTQMRAYMEYLRDAVVLEATLGTDDRSNEVRGLLEDIASLSPKVTFSDKGHGTRIPSFVIRRPGTDVQVCFAGLPMGHEFTSLVLALLQVSGHPPKIEADVVAQIRALDGDYHFETYFSQSCQNCPDVVQALNAMSVLNPKIHHTAIDGADFQDEVERLGIRSVPQVYLNGEPFASGRMEVADILAKLDTASVARSAEKLNDMAPFDVLVLGAGPAGDAAAIYAARKGLRTGLVAERFGGQVMDTAGIENFISVPETDGPKLSAALEAHVRQYDVQIIASQLAAKLIPAAETGGLHQIVLESGAVLRSKTVIIATGARWRHLGVPGEDEYRTKGVAYCPHCDGPFYKGRPVVVTGGGNSGVEAAIDLAGIVSHVTLLQRGAHLKADKVLQDRLLSLPNVTVLTNALTTKIEGDGKEVTGLTYSDGDGGLHQIKTDGVFVQIGLLPNTEWLKGTLKLSPYGEIVIDDHCGTSVPGVFAAGDATTVPYKQIVIAMGEGAKASLSAFDYLIRLPVAAKAN

SEQ ID NO: 4834 - protein, 75 aa, Passiflora crenata
GTNGEVMPGQWEYQVGPSVGIDAGDHIWCSRYVLERITEQAGVVLSLDPKPIEGDWNGAGCHTNYSTKSMREDGG

SEQ ID NO: 4835 - protein, 324 aa, Gluconobacter oxydans
MTTRPHIAVIGAGAWGTALACATAATGADVTLWMRNPVPPRTRTLPRLPDITLPENVTITGDFPRTANVVLLVTPVQTARDVSTRLQTVLDPAVPVVTCCKGLEQATSLLPLDVLAETMPGRPTGVLSGPNFAIEVAKGLPAAATLACADLALAQKLTALLNTSSFRLYASDDAAGVQLAGAAKNVIAIGAGITIGAGLGENARAALITRAVAEIGRLAEATGGRASTLAGLAGMGDLILTCTGRGSRNYSVGLELGEGRPLADILASRTTVAEGVLTAPAMLALARKHNVRVPIIETVTRLLNDGVSIEEARHLLLDRPPTRE

SEQ ID NO: 4836 - protein, 161 aa, Xanthomonas campestris
MTTLSTYQFTDLDGQPQSLAEYAGKVVLVVNVASKCGFTPQYAGLQALWQRYRDRGLVVIGFPCDQFGHQEPGDAADIRQFCSLDYAVDFPLAAKVEVNGSGAHPLWQWLKHEKRGVLGSEAIKWNFTKFLIGRDGSVLERYAPTTKPEALAADIERALGA

SEQ ID NO: 4837 - protein, 401 aa, Acidobacteria bacterium
MATQTKDYYGALGVKKNASAEEIRKAFRKLARKYHPDVNPGDKKAEDKFKEISEANEVLSDPKKRKIYDQLGFYSDNIDPAAAEAYARNGATGAGGFGGYDPRAAQGGQDIPFDFSGFDFSQEAGEPSGGGGFRDIFSSLFGGGRGGHEERPRPQAGTDLEYQVNVPFWDAIRGTTVKLNIQRREVCSNCHGEGEIGGTHTCPQCHGKGKIETGGGPMKFNVTCPTCHGTGKARTQCPVCHGEGAITRNEPLEFKIKAGTRDGQRIRLAGRGNAGTMGGASGDLYIIVKAGEHPVFRREGDDVYVTVPVSAVEAALGTKIEVPTIDGRALLKIPPGTNSGQKLRLREKGVPNAADGTKRGDEIVEVKLIVPKVSDERSKEILRELQKLNPEDPREELWRQV

SEQ ID NO: 4838 - protein, 433 aa, Blastopirellula marina
MDQPAHDIFSHAVARLDKAFLHADIDQEAVQRLKHPKQVLEVTIPVRMDDGSLRIFTGYRVRHDATRGPTKGGIRFHPNVDLAEVKALAFWMTFKCAVANLPFGGGKGGVIVDPKELSRLELERLSRGYIERIADFIGPEVDVPAPDVYTNAMIMGWMMDEYSKIRRQHTPAVITGKPIPLGGSLGRDDATGRGAYHCIKELEAKRGWKPEEQRVAVQGFGNAGQAVARLLHADGYNVVAVSDSRGGIYKESGFDIPSLAHVKNESRHLKAVYCEGSLCESIAADVITNAQLLELEVDILIPAALENQITGENAPRVKADVIVEAANGPLTGEADDILNDKGTLVVPDILANAGGVTVSYFEWTQNRAGYYWPLELVQQRLHETMAREFNTVYNLANHKEIDMRTAAYVVGLNRIGEAIASQGTARYFTAQED

SEQ ID NO: 4839 - protein, 400 aa, Pinus mugo
MGTLLQTHIGSVAFALQKEGGHSASAKDSAFLGVSLVEHGKKEFSFPVIRAKKVTSRNTNVPRIRAQTVAAPVETKDAPASKKTDRKGNVIITGASSGLGLATAKALGESGKWHIIMACRDFLKAERMARSVGIPKENYSVMHLDLASLESVRQFADNFRRSGRPLDVLVCNAAIYLPTAKLPTYTAEGFELSVGTNHLGHFLLSRLLLEDLKTSDFNSKRVIIVGSITGNTNTLAGNVPPKANLGDLRGLAGGLNGVNISPMIDGGEFDGAKAYKDSKVCNMLTMQEFHRRYHEETGITFASLYPGCIATTGLFREHIPLFRLLFPPFQKYITKGFVSEEEAGKRLAQVVSNPSLTKSGVYWSWNNNSGSFENQLSEEASDPEKAKKLWEISEKLVGLA

SEQ ID NO: 4840 - protein, 480 aa, Thermosynechococcus elongatus
MSLRLFWHRRDLRLNDNLGLAAAYTRTPKVVGLFCFDPAILSASDIAAVRVAYLVGCLQALQEAYRRLGGSFLIFRGDPRQILPQVAKGLGAVAVHWHEDVEPYGRERDRAVAAALKEKGIAVETAWDQLLHPPEAIQTKQGQPYTVYSPFWRNWSSLAKPEPVSAPRHLEPLTEIEQATAGTLGAICLPTAKDLGFHWSGDLILAPGEAAAQAQLETFIDQHIQDYGEQRNYPAQPGTSLLSPALKFGVIGIRRVWTATQAAMAAARSEEAQRSIRTWQQELAWREFYQHALYWFPHLAERPHREGFATFPWLNNEAHFAAWCEGRTGYPIVDAAMRQLNETGWMHNRCRMIVASFLTKDLIINPQWGERYFMQKLIDGDLAANNGGWQWSASSGMDPKPLRIFNPASQAQKFDPEAEYIRRWLPEVRSLDTIDLVTGNISPLERHRCGYPLPIVDHRQQQQRFKQLYQEHFRSPIPQE

SEQ ID NO: 4841 - protein, 1030 aa, Streptomyces avermitilis
MTVTRRSVLIAGTAAPAAGALTGIGGAPAVASAGAPGRHTVALRDGWRFALVNPGGITDPTGAYADAADPGHDDSGWREVAVPHDWSIEQTPTTQYGTTSGTGFLPGGLGWYRTAFTLPSALAGKRISVEFDGVYMDSYVYCNGTEVGRHPYGYTGFAFDLTDLLHTDGTTENVIAVKVQNRLPSSRWYSGSGIYREARLVVTEPVHVRRWGTYVTTPDITEERAVVRVRTTVVDASGAGSEVQVVSRIVGPDGRTAARTTSTVTVADQGTQTHELTVKKPQLWDFAHPHRYTLETELRVGGKRTDTHRTTFGIRRVTVDPDEGFHLNGTHAKIRGVDLHHDQGALGAAISIDAVRRQMTIMKSMGVNAFRTSHNPPSPQMIEVCEELGIVMVVEAFDCWRTGKTRYDYGRFFDEWCEKDATEMVLAARNSPAVVLWSIGNEIPDSTSTAGLAMADRIIGAIKAADDTRPLVIGSDKYRNVPAKGSAADLMLAKLDGLGLNYNTAKSVDALHAAYPHLFLFESESSSETSTRGTYQEPEHLNTGENHTPGKRATSSYDNNLASWTMSGEYGHKKDRDRKWFAGQFLWSGIDYIGEPTPYDVFPVKASFFGAVDTAGFPKDMYHLFRSQWTSEPMVHLLPMSWNHQAGDTVEVWAYANVDTVELFLNGKSLGTRTFDTKKTTDGRTYLETTEATGDDKTVTDGPHPGSYTSPNGSAGKLHLVWKVPYEPGELKAVARRNGRAVATDVLRTAGAPHAVRLTPDRSALAADGRALCFVTAEIVDARGVVVPDAEHLLSFAVSGGSLAGVDNGREESAERYQASTRTAFHGKALAIVRSGTKAGTLKVTARSEGLRTATATVRTTPARSTATTPAAEFRPDHPAAPDSPSADASYSGRPDTLPAAMLDGDPTTGWSNAFAKSATALLPAFSGARPEDWVSVTWARARAFDRVEVSFTVDATHTRPASVEVQVGDGDRYTPVSGATVDWATGSDAPTVVTFDAARGARLRLVLTSAHPGAADGAVRISRLEVPPS

SEQ ID NO: 4842 - protein, 199 aa, Pinus mugo
FLLSRLLLEDLKKSDFKSKRVIIVGSITGNTNTLAGNIPPKANLGDLRGFSARLNGVNSSPMIDGGEFDGAKAYKDSKVCNMLTMQEFHRRYHEETGITFASLYPGCIATTGLFREHIPPFKLSFPPSQKYITKGFVSEEEAGKRLAQVVSDPSLTKSGGYWSWNNDSSSFENQLSEEASDPRKARKVWGISEKLVGLA

SEQ ID NO: 4843 - protein, 189 aa, Arabidopsis thaliana
  misc_feature (59)..(59): Xaa can be any naturally occurring amino acid
  misc_feature (156)..(156): Xaa can be any naturally occurring amino acid
MASSMLSSATMVASPAQATMVAPFNGLKSSAAFPATRKANNDITSITSNGGRVNCMQVXPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRXIIGFDNTRQVQCISFIAYKPTKLSPVNFPFAFV

SEQ ID NO: 4844 - protein, 395 aa, Oryza sativa
MSSSLLTDLVNLDLSESTDKVIAEYIWIHLILNHHQFLFMVVLLVSLSQNAGSLLSILHLKEVNHTLSGPVDDPSKLPKWNFDGSSTGQATGDDSEVILHPQAIFRDPFRKGKNILVMCDCYAPNGEPIPTNNRYNAARIFSHPDVKAEEPWYGIEQEYTLLQKHINWPLGWPLGGYPGPQGPYYCAAGADKSYGRDIVDAHYKACLFAGINISGINAEVMPGQWEFQIGPVVGVSAGDHVWVARYILERITEIAGVVVSFDPKPIPGDWNGAGAHTNYSTKSMRSNGGYEVIKKAIKKLGMRHREHIAAYGDGNERRLTGRHETADINNFVWGVANRGASVRVGRDTEKDDKGYFEDRRPASNMDPYLVTAMIAETTILWEPSHGHGHGQSNGK

SEQ ID NO: 4845 - protein, 112 aa, Unknown
  delta proteobacterium MLMS-1
MKKIEAIIKPFRLDEVKEALNQLGINGMTLTEVKGYGRQLGHTEIYRGAEYVVDFIPKVKLEIIVEAERCAAVVNCIREAANTGKIGDGKIFVTPVEEVIRVRTNERDRDAI

SEQ ID NO: 4846 - protein, 133 aa, Pseudoalteromonas tunicata
MVFRIDLKVRDYECDLQGIVNNGVYFNYLEHARHEFLHANNVDFAKLAADKINLVVIRSEIDFKASLVPGDEFYVLVTPKRTSKLKFAFEQQIFRTCDDKLVVAAVITGTSVNERGRPFVPAEIDALFPIQSS

SEQ ID NO: 4847 - protein, 270 aa, Glycine max
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 4848 - protein, 167 aa, Arabidopsis thaliana
  misc_feature (115)..(115): Xaa can be any naturally occurring amino acid
  misc_feature (134)..(134): Xaa can be any naturally occurring amino acid
  misc_feature (141)..(141): Xaa can be any naturally occurring amino acid
  misc_feature (151)..(151): Xaa can be any naturally occurring amino acid
  misc_feature (160)..(160): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGICVPVSTGNSXPGYYDGRYWTMWKLPLFGXRIRLSVXREVEESRRGXPNAFIRSSXLQNRQGQ

SEQ ID NO: 4849 - protein, 397 aa, Clostridium acetobutylicum
MCGIAGFVNFKKNLIDKKSIIEDMTNTLIKRGPNEKGYYISKNALLGHRRLIVVDPKGGSQPMIKIHNGKKYIIVYNGELYNTEDIRKELLEAGYEFSSYSDTEVLLTSYIHWKEDCVNHINGIFAFAIYSETDKKIFLARDPLGVKPLFYTIKNNNLIFGSEIKTLLANPLVEPILTKEGLTEIFALGPARNLGSGVLKDIHEIPPANFIEFTEHKFKLHEYWRLSCKPHTENASETAEHIKFLLTDAIKRQLYADVPVCTFLSGGLDSSIISAVAASEFKKHGKTLNTYSIDYKDNNLYFKNDNFVITPDSVWAEKMRKFIGSNHHKIINNNLDLASALYDAVKANDIPGMADIDSSLFLFCKGVAEKNVVSLSGERAIQMITNLVKQFINIGEL

SEQ ID NO: 4850 - protein, 417 aa, Unknown
  Vibrio sp. Ex25
MQTTIAITAGSMVLSLLILIAGQNNWFHLTEIATETVTRINFEDFLLKGILGFLLFAGGLGIKLPNLKDQKWEITVLALGATLFSTFFIGFALYGFCQLIGIQFDLVYCLLFGALISPTDPIAVLAIVKKLDAPKRISTQIEGESLFNDGFGLVIFVTLFTIAFGTEAPTVGSVTLLFIQEAIGGITYGFVLGLLFHYLISATDDHSMELLLTIGVPTAGYAFAEYIHVSGPLAMVVSGIMIGNWTRFIGFSKESEDHLDHFWELVDEFLNGVLFLLIGMSMLLFEFHKEDWIMMAISVPLVLAARYLSVFLSYIGFKRYRKYNPWSVRILTWGGLRGGLALAMALSIPSGIWVIQDKLIDVKEIILVMTYSVVVFSILIQGSTITPMIEKAKDEEKKMEENNQAITTPEHTEPVDS

SEQ ID NO: 4851 - protein, 260 aa, Roseovarius nubinhibens
MGEFIYGARNGIHIMDLTQTVPMLDAALNAIRDTAAKGGRVLFVGTKRQAAGPVAEAAEKSAQFYMNHRWLGGTLTNWQTVSQSIKRLKEIDEALEGGAEGLTKKERLGIERDQEKLQASLGGIREMGGVPDMLFVIDVKKEALAVAEANKLGIPVVAVVDTNCSPDGIDYIIPGNDDAARAISLYCDLVSRAALDGMSAQMGAAGVDLGALAEAPVEETLSDGVETGNVSDETAHNDAMSKDAPLDIKSSEEVKENAEG

SEQ ID NO: 4852 - protein, 323 aa, Solanum etuberosum
EVKVGDSIEIVRFFHCYKRGVDRVFVDHPMFLEKVWGKTGSKIYGPKAGLDYLDNELRFSLLCKAALEAPRVLNLNSSNYFSGPYGEDVLFIANDWHTALIPCYLKSMYQSRGIYLNAKVAFCIHNIAYQGRFSFSDFPRLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAK

SEQ ID NO: 4853 - protein, 213 aa, Unknown
  Mesorhizobium sp. BNC1
MFRQIAAAVSSLVLIFIGTLQSAAETGTAIFAGGCFWCVESDFDQVPGVTSTISGYSGGNTPNPTYDDYMEGGHREVVKIEYDDTRVSYDQLLDVFFHSVDPTDGGGQFCDRGHAYSTAIYVLNDAQRQAAENAKKAAEAELGRSVVTPIESAATFWPAEDYHQNYYQSQDRILSRFGYVTKADAYKGYREGCGRDARLRQVWGENALRGLAH

SEQ ID NO: 4854 - protein, 310 aa, Saccharomyces cerevisiae
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSHHHHHH

SEQ ID NO: 4855 - protein, 412 aa, Herminiimonas arsenicoxydans
MASNNKQQISVLASSTFAFTICFAVWMIFAVLGIPVKTQLGLNETEFGLLTAMPVLSGSLIRVPLGIWTDRYGGRIVFFLLMLSSVVPIYMISYATEYWHFLVLGLFVGLAGGSFSVGTPYVARWFQKERRGLAMGIFGAGNSGSALTKFVAPAIIAAYGWQMLPNVYALGMLVTALLFWFFSYTDKSHQMPAGVSFSEQMKVLKDPRVWRYCQYYSVVFGGYVGLALWMTKYYVTEYGFDMQLAALLAACFSLPGGVLRALGGWISDRFGAYQVTWSVMWVCWVCFFLLSYPQTSMVIKTVNGDLNLHIGLSPWLFTVLLFVVGVAMAIGKASVFKFISDDFTDNIGAVSGVVGLAGGLGGFVLPIMFGALVDLTGVRSSAFMLLYGTVCVALVWMHFSFKQERQPVLQAA

SEQ ID NO: 4856 - protein, 323 aa, Solanum evolvulifolium
EVKVGDTIEIVRFFHCYKRGVDRVFVDHPMFLEKVWGKTGSKIYGPKAGRDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPIKGRKINWMKAGILESHRVVTVSPYYAQELVSGVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEQEIEQLELLYPNKAKGVAK

SEQ ID NO: 4857 - protein, 129 aa, Oryza sativa
MAKFNVVQKNRREWKQDRKRQAHGDPKTGKLKQRTAPVSVSGKRQRKLLRGLSREQKEAVMAKALENNMGDVEMVSAEGSSEAAKDKSQLKFNVKKNSRVQIKRLKGKGRKKAKNAKPPTKDKVDAMVE

SEQ ID NO: 4858 - protein, 323 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHHRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVEKKFPVVQHFWFGTGFFPWVNIHHHHHH

SEQ ID NO: 4859 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 4860 - protein, 323 aa, Solanum fiebrigii
EVKVGDNIEIVRFFHCYKRGVDRVFVDHPVFLEKVWGKTGSKIYGPKAGQDYLDNELRFSLLCQAALEAPRALNLNCSTYFSGPYGEDVLFITNDWHTALIPCYLKSMYQSKGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEEEIEQLEVLYPNKAKGVAK

SEQ ID NO: 4861 - protein, 323 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHMRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVLKKFPVVQHFWFGTGFFPWVNIHHHHHH

SEQ ID NO: 4862 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 4863 - protein, 323 aa, Solanum havanense
EVKVGDSIEIVRFFHCYKRGVDRVFVDHPMFLEKVWGKTGSKIYGPKAGQDYLDNELRFSLLCQAALEAPRVLNLNCSKYFSGPYGENVLFIANDWHTALIPCYLKSMYRSRGMYLNAKVAFCIHNIAYQGRFAFSDFPLLNLPDEFRGSFDFIDGHEKPVKGRKINWMKAGILESDRVVTVSPYYAQELVSAVDKGVELDNVLRKTCITGIVNGMDTQEWNPATDKYTDVKYDITTVMDAKPLLKETLQATVGLPVDRNIPLIGFIGRLEEQKGSDILVAAIHKFIGLDVQIVVLGTGKKKFEQEIEQLEVLYPNKAKGVAK

SEQ ID NO: 4864 - protein, 200 aa, Oryza sativa
  misc_feature (13)..(13): Xaa can be any naturally occurring amino acid
DPRAAGFDETTTXEDVDKLFKVFNGGKPVNFTAESLVSEVSSSIPSSLVRKSPYLTHPIFNMYHTEHELLRYLHKLQSKDRSLCHSMIPLGSCTMKLNATVEMMPVTYPSFANMHPFAPTEQAAGYHEMFDDLGDLLCKITGFDSFSLQANAGASGEYAGLMVIRAYHRARGDYHRDVCIIPVSGHGTNPASAAMCGMKI

SEQ ID NO: 4865 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 4866 - protein, 60 aa, Passiflora edulis
VMPGQWEYQVGPSVAIDAGDHIWCSRYILERITEQAGVALSLDPKPIEGDWNGAGCHTNY

SEQ ID NO: 4867 - protein, 323 aa, Solanum herculeum
EVKVGDSIEIVRFFHCYKRGVDRVFVDHPMFLEKVWGKTGSKIYGPKAGQDYLDNELRFSLLCQAALEAPRVLNLNCNKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYCNKAKGVAK

SEQ ID NO: 4868 - protein, 289 aa, Desulfitobacterium hafniense
MTRKLPTFLSENEHGLWMTEDERENLKIDYRIKEIIVEAKSTLQHVMILDSYSFGRMLVLDGAVQTTSLDGHIYNETISHVPLSIHPNPKKVLIIGGGDCGVAKEVCKYSSVEQIDVVEIDPMVVEVCLKHLPEVSGGLADPRVNFIFDDGVNYVQNSPTKYDIVIVDSSDPIGPAEVLIEKSFYRSIFNALEEDGLMVCQSQSPIFHGEVMEQIFERVHDIFPKTKMFTAVVPTYPGGLWSFTLGSKGYVIPNEARMKELDALYVNEQIMASCFSLPEFMNKQLSKYR

SEQ ID NO: 4869 - protein, 55 aa, Passiflora edulis
WEYQVGPSVGVDAGDHIWCSRYILERITEQAGVVLSLDPKPIEGDWNGAGCHTNY

SEQ ID NO: 4870 - protein, 422 aa, Thiobacillus denitrificans
MQSQQYKAWSVVSMSTLAFTVCFMIWMMFAVIGVPIKQQLGLNETQFGILVATPVLTGSLIRVPLGMWTDKFGGRIVFFVLMLTTVIPIWLISYATEFWQFLLVGLFVGLAGGSFTVGIAYCARWFPRERQGLAMGIFGAGNTGAAVTKLLAPIIVVGYGWTMVPKVYAGLMLVTAIVFWFFTYTEPAHKVSKSVTIREQLAAFKDPKVWRYSQYYSIVFGGYVALALWMTKYYVSQYGFDLKTAAFLAAAFSIPGGVLRAVGGYFSDKYGAHTITWWVLWVSLLCLFFLSYPQSSITIHTVDGLRTFHFGLGPTAFTIVMFSLGIAFAIGKASVFKYISDDYPDNIGVISGVVGLAGGLGGFLMPIMFGALVDLTGVRSSAFMLMFGVVWVSLMWMYFTEVREMDAAARGAKRVIAADVME

SEQ ID NO: 4871 - protein, 153 aa, Arabidopsis thaliana
  misc_feature (82)..(82): Xaa can be any naturally occurring amino acid
  misc_feature (94)..(94): Xaa can be any naturally occurring amino acid
  misc_feature (108)..(108): Xaa can be any naturally occurring amino acid
MASLTPNLECRMYEAKYPEVDMAVMIQVKNIADLGVYVSLLENNNIEGMILFSELSRRRIRSVSSLIKVVRIEPDMLLRVDXEKGFVDLSKRRXSVDDILTCEERCTXSRLVHSIMRHVAETLSVIRLGCEPLVLFSTTHDHALRLSKSSGGA

SEQ ID NO: 4872 - protein, 58 aa, Passiflora edulis
WEYQVGPSVAIDAGDHIWCSRYILERITEQAGVVLSLDPKPIEGDWNGAGCHTNYSTK

SEQ ID NO: 4873 - protein, 553 aa, Saccharomyces castellii
MFPRSDKDVDQLVGNLNQLGLNKPNARFVSVTPTRANKENRSSLSPSPSPNKTKRFTADETELKNSPKKLPHDFYKKALSNDTKRIVNVCQMYFLDYYCDMFDYVISRRQRTKSVLNYLERNQNSLSTEELNNEWTAYLQQEHDVLRKRRLKPKNKDFEMITQVGQGGYGQVYLARKRDTKEVCALKILNKKLLFKLNETNHVLTERDILTTTRSDWLVKLLYAFQDTESLYLAMEFVPGGDFRTLLINTRFLRNTHARFYISEMFCAVNALHELGYTHRDLKPENFLIDSEGHIKLTDFGLAAGTISTERIQSMKIRLEEVKNLEFPAFTEKSIEDRRKMYTHLRQTEVNYANSMVGSPDYMALEVLEGKKYDFTVDYWSLGCMLFESLVGYTPFSGSSTNETYENLRHWKKTLRRPVLDNGRPAFSDRTWDIITRLIADPINRLRSFEHIKRMPYFAEVNFNTLRQSAPPFTPQLDSETDAGYFDDFTNEADMAKYADVFKRQNKLSSMVDDSAVDSKLVGFTFRHRNGQKGLSGILYNGSEHSDPFATFY

SEQ ID NO: 4874 - protein, 442 aa, Arabidopsis thaliana
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPVILGYRRDIKFFYVFYISKILTSMAVNIHGSTRISAFGILAGIKTIAGLFGTLVARFLPIALTFQVSAISFFVGLVYMRVFLKEKLNDDEDDDLHHGTYHQEDHDSINTTMLAEPILNDRPIKTQVFHKKYSSLKDMISLMKTSTIFFQALVVTFFSSFSDSGMESAFLYFLKARFGFDKKQFADLLLLITIVGSISQLFVLPRFASAIGECKLLSTGLFMEFINMAIVSISWAPWVPYLTTVFVPGALFVMPSVCGIASRQVGPGEQGKVQGCISGVRSFGKVVAPFVFSPLTALFLSKNAPFYFPGFSLLCISLSSLIGFFQSLLIKDVPTPPLNKAINKTSGEEV

SEQ ID NO: 4875 - protein, 57 aa, Passiflora edulis
WEYQVGPSVAIDAGDHIWCSRYILERITEQAGVVLSLDPKPIEGDWNGAGCHTNYST

SEQ ID NO: 4876 - protein, 573 aa, Saccharomyces castellii
MSERKMENLTGTMHQLNFNLPNQPNRGSTSQFASLDNFSTPTKYKNDKLNGSPIPPGARRYEIDDSDSKMDIDGSSYNDIDITNSPKKLPQGFQTMASNNKTQRLVSVCKMYFLDYYCDMFDYVISRRQRTKKVLEYLEQKKNENVDLNSLNNEWNGYIQREHQVLRKRRLKPKHKDFEMITQVGQGGYGQVYLPGKKDTNEVCALKILNKKLLFKLNETNHVLTERDILTTTRSQWLVKLLYAFQDTQNLYLAMEFVPGGDFRTLLINTRFLKSTHARFYISEMFLAVNALHDLGYTHRDLKPENFLIDAKGHIKLTDFGLAAGTISNDRIQSMKVRLEEVKNLEFPEFSDKSIEDRRQMYQKYRETEVNYANSMVGSPDYMALEVLEGKKYDFTVDYWSLSCMLFESLVGYTPFSGSSTNETYENLRHWKKTLRRPMLDNGRPAFSDRTWDFITRLIADPINRLRSFEHVKRMTYFESVDFNTLRDLSPPFIPQLDNETDAGYFDDFTNEADMAKYADVFKRQNKLSTMVNDADIDSKLVGFTFRHRYGKNGSSGVLYNGLEQSDPFSTFY

SEQ ID NO: 4877 - protein, 539 aa, Coccidioides immitis
MKALTATLFVGTALAAVPPQQPIQVPTEDSAWAKPLENLKDTFKTLGNDAKQAWNELASAFPDAINEYTLFSAPKKHTRRPDTHWDHIVRGSDVQSIWMEGADGQKRREVDGKLEKYDLRVKAVDPSKLGIDKVKQYSGYLDDKENDKHLFYWFFESRNDPKNDPVVLWLNGGPGCSSLTGLFLELGPASIDKNLKVVHNPYSWNSNASVIFLDQPVNVGFSYSGGSVSDTIAAGKDVYALLTLFFKQFPQYATQDFHIAGESYAGHYIPVFASEILSHKNRNINLQSVLIGNGLTDPLTQYPHYRPMACGEGGYPAVLDESTCRSMDNSLPRCLSMIESCYSSESVWLCVPASIYCNNAMIGPYQRTGQNPYDVRAKCEDGGSLCYSQLGYITEWLNQKSVMDALGVEVSSYDSCNMDINRNFLFHGDWMKPFHRVVPGLIDQIRVLIYAGDADFICNWLGNQAWTDALEWSGREKFAKAELKDLTIVDNENKGKNIGKVKSYGNFTFMRLFGGGHMVPLDQPEASLEFFNRWLGGEW

SEQ ID NO: 4878 - protein, 439 aa, Thiobacillus denitrificans
MTISKDDQARLYRYYTEPTLVTELTRKTLALVLAGGEGSRLKDLTAWRAKPAVPIGGKYRIIDFPLSNCVNSGIRRIGVLTQYKSHSLIRHLQRAWGLMRTEVGEFVEILPAQQRTHKKEWYQGTADALFQNLDIMQRHHPEYVLVLGGDHVYTMDYTQMLLYHVQTGADVTVGSVEVPVAEAAAFGVMSVDESLRITEFNEKPREPDSMPGKPGTALVSMGIYVFSKDFLYKALIEDAGATRSSHDFGKDIIPSSISRARIMAFPFRDREGKPGYWRDVGALNCYWQTNMDLCSIEPALNLYDCEWPIWTYQPQYPPAKFIFDDEGRRGEAIDSLVAGGCVLSGARVKRSVLFFATTVGCSSLVKDSVILPKVRIGRNCRISCAIIDKGTVIPDGTVIGEDPVEDAKRFHVTPEGIVLVTPRMLGQNIYARWEDEYDG

SEQ ID NO: 4879 - protein, 75 aa, Passiflora edulis
GTNGEVMPGQWEYQVGPSVGVDAGDHIWCSRYILERITEQAGVVLSLDPKPIEGDWNGAGCHTNYSTKSMREDGG

SEQ ID NO: 4880 - protein, 549 aa, Rhodospirillum rubrum
MYCYQCEQTAQGVACVTVGLCGKTAEVAALQDLLIEAAKGLSQYAYRLRQLGIALPEIDAFVLDALFTTVTNVSFDPARLEEQLREAACLRDQLRARYDAACAARHTSPETLSGPALWQPASTRAGLVGTGEAASIAHRLTAQGADLTGLQDLLLYGVKGMAAYACHARILGQTDESVAAFVHEVLTTLAEVPADAEALLGLVLRCGTVSLTVLDLLDRANTGAYGDPQPTPVLMGHRAGKAILVSGHDLKDLAVLLEQTVGLGVDIYTHGEMLPAHGYPELKKYPHLVGHYGGAWQRQRSEFAAFPGPILMTTNCIQNPTAAYRDRLFTCGLVAHPEATALSGRNFAPLIASALAAPGFAEDGPVRHHLAGFGHKAVLGVAPQIIDAVKAGAIRRFVLIGGCDGHESARSYFDDLAGSLPQDAVVLTLGCGKFRVIDHDMGTIAGLPRLLDMGQCNDAYSAIKVAQALAEAFGVGVNDLPLSLVLSWFEQKAVTVLLALLALGVRNIRLGPNLPAFITPPVLKVLVDRFGIMPVGTVAEDLAAMGLAA

SEQ ID NO: 4881 - protein, 339 aa, Solibacter usitatus
MNTRQFRYDVRVAIYDAIGGMAGCRRLAAAFYARVERDPVVRPLYPKSLHCAVDAIAMFLVQQFGGPCEYSENRATLSLYESHLRFAIGQAERDAWLRDMTAAMDDIGIGEPERAEMVLYFEQTSAYLINRPKPDRAPGVLVADDAIAALRRGDLKRVSELAGHPEYQRDRAAWVGLLGKMAASDDPRILEFALTRISADPGLAQERYGGSLLRMAAAAGCLAMVELLLRLGVDPNAVDRYGHPPLYFVGNQCRRESGPAVVRALVSGGANVNQQDRVKRCTPLHMAARRGNVAVAEALLEWGADPGIGDIAGVTPLQRALNCRKPEVAALLSASSGGR

SEQ ID NO: 4882 - protein, 392 aa, Oryza sativa
MSMSLADSWGSAPASPIGFEGYEKRLEITLSDAPVFVDPCGRGLRALSREQIDSFLDLAKCTIVSHLSNKHFDSYVLSESSLFVYPHKVVLKTCGTTKLLLSIPRILELAAELSLPVLSVKYSRGMFIFPGAQPSPHRSFLEEVSVLNSFFGGLKSGGNAYVIGDAFKPKKKWHVYYATEEPEQPMVTLEMCMTGLDAKKAEVFFKDSTDGSCSSAKEMTMFSGISEIIPEMEICDFEFDPCGYSMNGIYGPAVSTIHVTPEEGFSYASYEAMNFNPSSLVYDDLIKKVLACFCPSDFSVAVTIFGGHGFAKSWAKGAEVDSYMCDDLVEQELPGGGVLMYQSFTAVTPGAVSPRSTLDGWNSDGAEMVAKSKEMSVCWEGEKAAKKKDADA

SEQ ID NO: 4883 - protein, 235 aa, Brassica napus
MESAALSRIGLAGLAVMGQNLALNIAEKGFPISVYNRTTSKVDETLDRAAVEGNLPVSGQYSPRDFVLSLQRPRSLIILVKAGAPVDQTIAAFSEYMEPGDCIIDGGNEWYQNTERRISEAEQKGLLYLGMGVSGGEEGARNGPSLMPGGSFQAYDNIKDILGKVAAQVEDGPCVTYIGEGGSGNFVKMVHNGIEYGDMQLISEAYDVLKNVGGLSNEQLAEIFTEWNRGELESF

SEQ ID NO: 4884 - protein, 351 aa, Pseudomonas aeruginosa
MFPKNAWYVACTPDELAGKPLGRRICDEPMVFYRGEDGRVAALEDFCPHRGAPLSLGFVEDGVLVCGYHGLAMGEDGRTRAMPGQRVRGFPCIRRFPVQERHGFVWVWPGAEEQADDALIPRLEWAESPDWAYGGGLYHIHCDYRLMIDNLMDLTHETYVHASSIGQKEIDEAAPTTRVEGDEVITSRHMQNVMAPPFWRMALRGNGLADDVAVDRWQICRFTPPSHVLIEVGVAHAGHGGYQAPAERKAASIVVDFITPESATSIWYFWGMARNFQAHDQALTESIREGQGKIFGEDLEMLESQQRNLLRHPRRDLLKLNIDAGGVQARRIIERLLADERQAAAPNRAQA

SEQ ID NO: 4885 - protein, 177 aa, Desulfotalea psychrophila
MHQFENIEVMISQEEVAGIVSRLGKEVSEEYKGISEDLVVIGLLRGSFVFMADLVRAIETPLVADFMAVSSYGDGTVSTRDVKVVMDLNTSIEGRDVLVVEDIVDTGNTFSKVLTMLENRSPRSLKVCSFLSKPSRREIEVPVDFCGKEIPDEFVIGYGLDYAQKYRNLPYVGILKV

SEQ ID NO: 4886 - protein, 221 aa, Kluyveromyces lactis
MTYPERKAFVSRITNETKIQIAISLNGGPISIENSILQREESDAAKQVTGSQIIDIQTGVGFLDHMIHALAKHSGWSLIVECIGDLHIDDHHTTEDCGIALGQAFKEALGHVRGVKRFGSGYAPLDEALSRAVVDLSNRPYAVIELGLKREKIGDLSCEMIPHFLESFAEAARITLHVDCLRGFNDHHRSESAFKALAIAIKEAISSNGTNDVPSTKGVLM

SEQ ID NO: 4887 - protein, 345 aa, Cryptococcus neoformans
MSTPAYLAKLESIPKEKFLFGPSPISYLPNLTAVLGGKVKLYAKREDCNSGLAYGGNKVRKLEYLVADAKAKGCNTLVSVGGVQSNHTRAVTAVAVASGLKAVTVQEKWVPIDPPLYSETGNILLSRLMGGDVRLNQETFDIRHKKATEDAFKDVEAKGGKPYYIPAGASDHPLGGLGFTNWVVELAKQEKELGVFFDVVIVCSVTGSSHAGTVVGAVAEGRKRKIIGIDASGKPEATRNQVLKIARNTAALLDERLEIKEEDVILDDRFHAGIYGIPDDETIAAMKLAAQTDAFITDPVYEGKSMAGMIRLVKEGAIKEGSNVLYIHLGGQPALNAYSSYFPHA

SEQ ID NO: 4888 - protein, 450 aa, Lactobacillus fermentum
METLSFDSSALKKFVHPNELGEMQAMVTAADSELRNGTGAGADFRDWLHLPTDYDKDEFARIEAAAKKIQADSEVLVVIGIGGSYLGARMAVDFLHHSFYQAQTAADRKQPLVLFAGNSLSSSYIADLIDVIGDRDFSVNVISKSGTTTEPSIAFRVFRQLLEDKYGVDGANARIYATTDRQRGALKTEADAEGWGTFVIPDGVGGRFSVLTAVGLLPIAVSGADIDQLMAGAAKAEATYVNPDLTQNEAYQYAAYRNILYRKGYTTELLENYEPNMTMLAEWWKQLAGESEGKDQKGIYPSSANFTTDLHSLGQYIQEGRRNLMETVVKLAEPNHNVKVPSAKSDFDGLKYLEGKEIDWVNTQAYRAVVAAHTTGGVPVMTVNIAKEDEFTLGYLIYFFEVAIAISGYLNGINPFNQPGVEAYKTNMFGLLGKPGFEEIGEQLKKEMDD

SEQ ID NO: 4889 - protein, 363 aa, Unknown
  Actinoplanes sp. SE50/110
MSTGVRAVLLAGGEGRRMGALGAGRLKPLVPFGGAARLIDFSLANARDSGLDQVLLLSQYQERQLMDDLRRTWWQPGFRVHFGPYDRAYTDGIPVEYEPPTGPPERGTADALIRKAPYLFGPDVTEVLVQHADHVYRFDYRPMIAEHRASGAALTVSYQRIDRRYVHLFGMVEFDDRNRLVSFVEKPAEPTSDLVFAAFCVFDAAVLHRYLELLDGTDWQHDISRDVIPAMLAAGEHIRGCPVPGYWADIGTVERYHEAHLSLVGTPPSLAVDAMPWTVAPRTARALVTSADGVRHSVVPADLVNHGTVERSVLFPAARIGPGATVRDSVLLPGAVVPAGAEIDGAVVLEDGTVQQVTTGARR

SEQ ID NO: 4890 - protein, 244 aa, Aspergillus nidulans
MPLPARTASLSRNTNETKIQVSLSLDGGVLPPYEPSSHFPVPTDPLEAEAAKKGIVPNKDAAHATQFTPTQQITISTGIGFLDHMLHALAKHSGWSLAIRAKGDLYIDDHHTTEDTFLALGTAFTTALGARQSLARFGRGDAPLDEALSWAVIDLSSRPWAVINIGFKREKIGDLSTEMITHGLQSFAQAAGVTLHIGCTYGDNDHHRAESAFKALAVAIRAACARRVEGEVGAGDVVSTKGVL

SEQ ID NO: 4891 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNIDQSDGNFLDDDQMADGFVLTCVAYPQSDVTIETHKEEELTG

SEQ ID NO: 4892 - protein, 269 aa, Alteromonadales bacterium
MNKKILITGATDGIGFETAKMLLAQGHTVLLHGRNAQKLNKVHTLLNNDYPQASTQTYVADLSEMAQVLNLAKQITADHKHLDVLINNAGVFKLDNPETADGLDARFAVNTLAPYLLTTLLLPLFDTQGRIVNVSSAAQATVNLDALIGQSFLSDNAAYAQSKLAITMWSRHMGLKLKGNGPLVVSVNPKSLLGSKMVKDAYGLNGGDLKLGADIFCRAALSDEFSNSTGLYFDNDAECFSAPHADALNDAKNQQLIDALDLKLLQLAI

SEQ ID NO: 4893 - protein, 566 aa, Bifidobacterium longum
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLETLTNAREARTWLLEELTANGAIAEGDEAQKAEAIKKHFVAVSTNLEKVEEFGIDPNNAFGFWNWVGGRYSVDSAVGTSLAVVFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 4894 - protein, 323 aa, Solanum inelegans
EVKVGDSIEIVRFFHCYKRGVDRVFVDHPMFLEKVWGKTGSKIYGPKAGKDYLDNELRFSLLCQAALEAPRVLNLNCSKYFSGPYGENVLFIANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHKFIGLDVQIVVLGTGKKKFEQEIEQLEVLYPNKAKGVAK

SEQ ID NO: 4895 - protein, 459 aa, Yersinia pseudotuberculosis
MADAPLSTAAPPSISRRNLAILITDILLFILLLNVLPFDANANRGLAILAFIGILWLTEALHVTITALLVPLIAVGTGLMDVNTGLRSFANPIIFLFFGGFALATALHIQGLDKLIANRLLLAAKGQLMVAVLMLFGATALVSMWISNTATTAMMLPLALGVIGNLNLERERNTYVFILLGIAYSASIGGLGTLVGSPPNAIAAAQLGLDFVGWMKYGTPAMIILMPLMVATLYVILRPNLKHHFDIELEQQPWTTARRITIGIFGMTVIGWIFSSQLSQMLGGVKQFDTLVALSAVVLIGISGVASWRQIQQNTGWGVLLLFGGGLTLSVILRDSGASAVMAQGIVSIFGAYHWFIIILAVATFIIFLTELTSNTASAALLVPVFATVSEALGMPPLLLTMIIGIGASCAFMLPVATPPNAIVYGTGFIRQPEMVKVGFWLNIICIIVVSLLAWYLWY

SEQ ID NO: 4896 - protein, 123 aa, Triticum aestivum
  misc_feature (113)..(113): Xaa can be any naturally occurring amino acid
MAGSAIGFEGYEKRLEITFSEAPVFTDPNGRGLRALSRAQIDSVLDLAKCTIVSELSNEKFDSYVLSESSLFVYPYKVVIKTCGTTKLLLAIPRVLELAEELSLPLAAVKVLXRGTFIFPEAQ

SEQ ID NO: 4897 - protein, 463 aa, Roseovarius nubinhibens
MKHFPIFVALEGRRVVLSGGGDAALAKLRLLLKTEAAIHVYAKTPAPEIVTWADEARLTLHRRTLAAGDCEGATLFYAADEDATEDARTAALATAEGALVNIVDNLSDSQFITPAIVDRDPVTVAIGTEARPRSSPAPLSRSRGAAARPSRPSGAHRQAFRHAVDVLPMGRRRRDYWADYYFRQGPRALEQGGPDAVRRTLASLLDDYKTREDRAGHVAFVGAGPGDPELLTLKARRALDEADVVIHDRLVTPEILELARREAVLVDAGKEGFGPSMTQDEINRLIVAHAESGAQVVRLKGGDPTVFGRLDEEIDAVTEAGITYHVVPGITAASASVAAIGQSLTSRGRNSSVRFLTGHDTRGFADHDWAALARPGEVAAIYMGKKSARFIQGRLIMHGADRATPVTVIENATRPDQRVLSTTLDALPADLTAAGLTGPALTFYGLAPRAAQAALTQTKQEFA

SEQ ID NO: 4898 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSSEDVCTGTTGHNEVVRVQYDPKECSFESLLDVFWNRHDPTTLNRQGGDVGTQYRSGIYYYTDEQERIAREAVEKQQKILNKRIVTEILPATKFYRAENYHQQYLAKGGRMGLRQSAEKGCKDPIRCYG

SEQ ID NO: 4899 - protein, 323 aa, Solanum ipomoeoides
EVKVGDSIEIVRFFHCYKRGVDRVFVDHPMFLEKVWGKTASKIYGPKAGLDYLDNELRFSLLCQAALEAPRVLNLNCSKYFSGPYGEDVFFIANDWHTALIPCYLKSMYQSRGIYLNAKVAFCIHNIAYQGRFAFSDFPLLNLPDEFRGSFDFIDGYEKPIKGRKINWMKAGILESHRVVTVSPYYAQELVSGVDKGVELDNVLRKTCITGIVNGMDTQEWNPATDKYTDVKYDITTVMDAKALLKEALQAAVGLPVDRKIPLIGFIGRLEEQKGSDILAAAIHKFIGLDVQIVVLGTGKKKFEQEIEQLEVLYPNKAKGVAK

SEQ ID NO: 4900 - protein, 323 aa, Solanum juglandifolium
EVKVGDSIEIVRFFHCYKRGVDRVFVDHPMFLEKVWGKTGSKIYGPKAGLDYLDNELRFSLLCQAALEAPRVLNLNSSNYFSGPYGEDVLFIANDWHTALIPCYLKSMYQSRGIYLNAKVAFCIHNIAYQGRFSFSDFPLLNLPDKFRGSFDFIDGYEKPVKGRKINWMKAGILESHRVVTVSPYYAQELVSAVDKGVELDSVLRKTCVTGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAK

SEQ ID NO: 4901 - protein, 431 aa, Bacteroides fragilis
MMYLLPKQWNSKWLNQPGIQNVVVSHKALIEAELEQQKKEIIGKLEKGQVLEGTVKNITSYGVFIDLGGVDGLIHITDLSWGRVSDPKEVVELDQKLNVVILDFDDEKKRIALGLKQLTPHPWDALDPNLQVGDKVKGKVVVMADYGAFIEIAPGVEGLIHVSEMSWSQHLRSAQDFMKVGDEVEAVVLTLDREERKMSLGIKQLKQDPWETIEEKYPVGSKHTAKVRNFTNFGVFVEIEEGVDGLIHISDLSWTKKVKHPSEFTQIGADIEVQVLEIDKENRRLSLGHKQLEENPWDVFETVFTVGSVHEGTIIEMLDKGAVVALPYGVEGFATPKHLVKEDGSQAQMDEKLEFKVIEFNKDAKRIILSHSRIFEDVAKAEERAEKKAASNAKKSSKREETPAIQNQAASTTLGDIDALAALKEQLEGKK

SEQ ID NO: 4902 - protein, 244 aa, Buchnera aphidicola
MEIVSMRDMLKAGVHFGHQTRYWNPKMKPFIFGSRNKVHIINLEKTLPMFNFALSELKKISLKKGKILFVGTKRAASKKIKETALNCNQFYVNHRWLGGMLTNWKTVRQSIKRLKDLETESQDGTFSKITKKEALIRTRELSKLENSLGGIKNMGGLPDCLFVIDAAHENIAIKEANNLGIPVFAIVDTNSNPDGVDYVIPGNDDAIRSVTLYLQAVSLSICKNQNGNSFSEMLLDSDKKMNIE

SEQ ID NO: 4903 - protein, 323 aa, Solanum lepidotum
EVKVGDSIEIVRFFHCYKRGVDRVFVDHPMFLEKVWGKTGSKIYGPKAGKDYLDNELRFSLLCQAALEAPRVLNLNCSKYFSGPYGENVLFIANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTCITGIVNGMDTQEWNPATDKYTDVKYDITTVMDAKPLLKESLQAAVGLPVDRKIPLIGFIGRLEEQKGSDILVAAIHKLIGLDVQIVVLGTGKKKFEQEIEQLEVLYPNKAKGVAK

SEQ ID NO: 4904 - protein, 295 aa, Pseudoalteromonas tunicata
MSKLLPVALVQHSNSTDLAHNFAKTQDGIRKAAAQGAKLVVLQELHRSLYFCQTEDTERFDLAETIPGPTSDSLGLLAKELNVVIVSSIFEKRATGLYHNTAVVLDSDGTIAGKYRKMHIPDDPGFYEKFYFTPGDLGFTPIQTSIGKLGVLVCWDQWFPEAARLMAMAGAEILIYPTAIGWDTTDDIDEQTRQCDAWVISQRAHAVANGVPVISCNRVGHESDPSGHSEGILFWGNSFIAGPQGEILAHASAKDDEILTAILDLKRSEDTRRIWPYLRDRRIDHYQDLLKIYRD

SEQ ID NO: 4905 - protein, 472 aa, Unknown
  Nostoc sp. PCC 7120
MQIVDKRSNKKAWASALTEPAKEFPLTQLTIISGNIPEGLRGTLYRNGPARLERGGMLAGHWFDGDGAILAVNFTDGGVHATYRYVQTVGYQVENTADKFLYGNYGMTAPGPVWNQWRKPIKNAANTSVLALPDKLLALWEGGRPYALDLQTLETWGEDNLGGLTNGLTYSAHYKQDPQTKEIFNFGISLGLNAKLNVYKSDSTGKIIQKSAYSLDGLPLIHDFVLAGKYLIFFISPVRLNMLPVLLGTSNYSDSMQWRPELGTQILVIDRESLSLVSRGETEPWYQWHFANGYVDASGAVIVDIARYKDFQTNQYLKEVATGQTHTPAPSTLSRVNLHPQSGKVAAIEQLLDRHCEFPHVPRQNVGQASRYTYMSGFRQGTDISQELLNTIACFDHKTQTFIEAYPGENCYPSEPILADNWVLTVVYDGNSHSSQVWIYDSDRLHEEPICKLELPKVIPHSFHGTWKSEKR

SEQ ID NO: 4906 - protein, 245 aa, Acidobacteria bacterium
MAETHPIMAARVTRSILLSEKTKHIEFEFLDRPKFDFIAGQFVSVREPKADGKFITRAYSIASDPRDDNTLDLCLNRVENGFMSNYLCDREVGDEVRMHGPHGHFVLHEELKDTIFISTGTGVAPFRSMGRWLFQHPERYKGREFWMIYGTRYADDIYYRDEFEQMEREHPNFHYVCTLSRGGDAWTGRKGYVQDHLREILKAHDGGKDMQVYICGLNEMVSGVRDVLKDEFGWDKKQINFERYD

SEQ ID NO: 4907 - protein, 57 aa, Passiflora edulis
WEYQVGPSVGVDAGDHIWCSRYILERITEQAGVVLSLDPKPIEGDWNGAGCHTNYST

SEQ ID NO: 4908 - protein, 323 aa, Solanum lycopersicum
EVKVGDSIEIVRFFHCYKRGVDRVFVDHPMFLEKVWGKTGSKIYGPKAGLDYLDNELRFSLLCQAALEAPRVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIELDVQIVVLGTGKKEFEQEIEQLEVLYPNKAKGVAK

SEQ ID NO: 4909 - protein, 58 aa, Passiflora edulis
WEYQVGPSVGVDAGDHIWCSRYILERITEQAGVVLSLDPKPIEGDWNGAGCHTNYSTK

SEQ ID NO: 4910 - protein, 430 aa, Pseudoalteromonas tunicata
MILINKKKYGLLAAYFVTALLSFTISAKEQTSMAATAHIEKVVLGAGCFWGAEKRYQNIPGVIDAVSGYADGNVAANYRTITQAKYKNDPNNHAEVVEVTFNSNEISLTKILESFFEGHDPTQLNRQGNDIGTQYRSTILTTSPQQLSIAQAIKTRYQTLLSQAGYGEIKTNIKPLETFFPAENYHQDYLVKNPNGYCPDHSTGVKFAPSTDEKSVRQNAALLQGKHIVIVESAGYCPYCEKLKKDVLNDYQGSIALHFRFANELDGLNIQTPTWATPTILFIEDGQEVMGRQGYLDSGQFYRLLGLFKLGKSEAFNVAFDEGTDGRFCKEYEIFKNTPDGVFIDKLSGAPLFDTKDRFNSGTGWLSFTQAVPDSVIERADNRFGMQRVELRSKTSGIHLGHVFEDGPNGARRFCINATVLEFVARKNID

SEQ ID NO: 4911 - protein, 647 aa, Xanthomonas campestris
MCGLAGLLLATPRMHGEQLEALVRPMGGALRHRGPDDAGTWCDAQAGVALAHQRLSILDLSPLGHQPMRSADSRYVLAYNGEIYNFAQLRAALAALGHRFRGHSDTEVLLAAVVEWGLDDTLARCNGMFALALWDERDHCLSLARDRVGKKPLYYGWAGDTLVFGSELKALWQHPDFDNGVDRDALTLLLRLGYIPAPACIHERTFKLMPGRVLRLDAQAVAAGAAAHRPDQAQQPFWNAREAMQRALAAPFTGTDAQAEEQLDSLLRDAVALRMVADVPVGVFLSGGTDSSIVTAMMQAQSDQPVHTFSIGFEGSHHDEAPLAREVATHLHTDHTELYVSGADALAVVPTLPDMFDEPFADASQVPTALVARLARGGVTVALSGDGGDELFFGYGRYQRALRNWRMHGLVPAPLRRLMAVAARKSGEASRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPEPMVYRGKRGFGAPVSAWLRGDLHGWADDLLAHGTLQREGVFAADTVAGLWRDFNGGERKWHTHLWTVLMFQAWQDHWRAQRAAIVRS

SEQ ID NO: 4912 - protein, 57 aa, Passiflora exura
  misc_feature (14)..(14): Xaa can be any naturally occurring amino acid
WEYQVGPSVGIDAXDHIWCSRYILERITEQAGVVLTLDPKPIEGDWNGAGCHTHYST

SEQ ID NO: 4913 - protein, 346 aa, Sordaria macrospora
EIGPYRLKDENTLVYNDGAWNEFANVLFVDNPVGTGFSYVDTNAYIHELTEMASNFITFLERWFALFPEYEHDDLYIAGESYAGQYIPYIAQAIIERNKNAGPVNHKWNLAGLLIGNGWISPKEQYEAYLQFAYEKGIVKKGTDLATRLENQQRLCQLKITESPDKIDYTECEEILQDMLQQTAGGVGASGKPQCYNMYDVRLKDDYPSCGMAWPPDLKSVTPYLRKKEVIKALNINENKSTGWTECNGQVGLNFHPKTKPSITLLPDILSSGVPILLFSGAEDLICNHLGTEALISNMEWNGGKGFELTPGTWATRRDWTFEGEPAGFWQQARNLTYVLFYNSSH

SEQ ID NO: 4914 - protein, 55 aa, Passiflora foetida
WEYQVGPSVGIDAGDHIWCSRYILERITEQAGVVLTLDPKPIEGDWNGAGCHTNY

SEQ ID NO: 4915 - protein, 304 aa, Oryza sativa
  misc_feature (201)..(201): Xaa can be any naturally occurring amino acid
MATAGDEQQQQAAAAQTAEVTEAAAKEVVSVEMPAPEGWTKKFTPQRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPXAPAGTEKEDAKPAESEAAPPAPSEGGEKKEDAKPAEPEAAAAPPSNPTEPSAPKAAAAAPVENSADKGPHQDSQPPSAAAPAKESSPVNNGQLPAGASAVKCT

SEQ ID NO: 4916 - protein, 266 aa, Plantago major
PMKNEVIFVAPSGEEISNRKQLQQYLKANPGGPALKEFDWGTGETPRRSARIGEKAKATPPPKDSESPMKRKRRSSLTKKDKEMEAGKDETEMQDAEADEKNDEKLPEGAGNNGESIAEPDQESKADGPDENIQEKNEADEPTKNVNDDTEEIKNVEKKIEENETSEIVVKPESEGPEPVEVKPESGAPEPENKQQDNQAESDLANGASAAAAGETGGPEGDSTQKDMHMEQDKDLTGDATENSNGNKAGPTFAQHHPSPTTTISC

SEQ ID NO: 4917 - protein, 633 aa, Unknown
  Mycobacterium sp. MCS
MPVCNGVQPLCSRRRRCALGHMTQTLADPREPTTDLTPQQRVDAWLADFEAALAVRDIERVVAKFATDSFWRDLVAFTWNIKTLEGRDGIADMLTARLTETDPARFRTREAPTVDGDVTTAFIEFETGVGRGVGHLRLRGDECWTLLTTMQEIKGHEERKGPSRVLGAVHGSDPDPRSWAEKRAEEDAALGRTVQPYALVIGGGQGGIALGARLRQLGVPAIVVDRHERPGDQWRKRYKSLCLHDPVWYDHLPYLPFPQNWPVFAPKDKIGDWLEFYTRVMEVPYWSKTTCLSAVFNPGSDGAPDTWTVEVDRDGERLTLRPTQLILATGMSGKPSVPTLPGQDVFRGEQHHSSAHPGPDRYVGKRAVVIGSNNSAHDICKALVENGVDTTMVQRSSTHIVKSDSLMDLGLGDLYSERALAAGMTTEKADLTFASLPYRIMHEFQTPIYDAIRERDKDFYERLTAAGFELDWGDDGSGLFMKYLRRGSGYYIDVGACDLVADGTIKLAHGQVSHLTEDTVVLADGTELPADVVVYATGYGSMNGWAADLIGQDVADKVGKVWGLGSSTTKDPGPWEGEQRNMWKPTQQENLWFHGGNLHQSRHYSLYLALQLKARFEGIPTPVYGLQEVHHLS

SEQ ID NO: 4918 - protein, 286 aa, Solanum lycopersicum
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLKQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 4919 - protein, 98 aa, Mesembryanthemum crystallinum
TKKIQQELAKPNVLERFLDNKEDISKLRKCFAGLWSLDDSEVISDAMERPELYVMKPQREGGGNNIYGNDVRDTLQRIQQGGTEEDAAAYILMQRIFP

SEQ ID NO: 4920 - protein, 318 aa, Coccidioides immitis
MSKPGDFNAVRKDIIAQMKQPGYDDGSAGPVFVRLAWHSAGTYDKQTDTGGSNGAGMRYEKEGGDPANAGLQFGRAFLEPVKKKHPWITYSDLWTLAGVTAIKEMDGPEVQWQPGRTDFVDDSKVPPRGRLPDATQGSDHLRHIFYRMGFNDQEIVALSGAHNLGRTHADRSGFEGPWVNNPIRFSNQYFRLLKNLEWKPTTLPSGVKQFTYVDPDIPEDEKEEPLMMLPTDMCLLSDPEFSKWVDRYADDKELFYEHFAQAFAKLLELGIKRDASGKIINTDNEKGGYISAPKKSDTPTGPPRSSKKGAASQVRARL

SEQ ID NO: 4921 - protein, 377 aa, Haemophilus ducreyi
MAKKDYYEVLGLQKGATEKDIKRAYKRLAAKYHPDKNQGSKDSEEKFKQITEAYEILTDDQKRAAYDQYGHAAFEQGSSNGGFNGFGGGFGGFEDIFSEMFGGGFGGGSRRQHVVRGQDLRYDIEISLEEAVKGCKKDIRLSTLAECDNCHGTGAEAGTKVENCPHCHGAGRIRRQQGFFVTEAVCPSCHGTGKKIEKPCHSCHGDGRVQKAKNLSVTIPAGVDTGNQLRLSGEGEAGENGAPAGDLYVVIHVREHNIFTRDGANLYCEVPISFSMAALGGEIEVPTLDGKLKLKIPTETQTGKLFRVRGKGVVSPRGGYAGDLICKVVVETPVQLNEEQKELLRQLEISLDGKANHRPQQAGFLDSVKNFFTHLGK

SEQ ID NO: 4922 - protein, 327 aa, Unknown
  Synechococcus sp. RS9916
MSAVVLAGSHVLITGASSGIGLEAARHLAARGHRLTLVCRDSERCASTRQQLIEAGAVPDRLEGIAADLADLASVEQACQRLLDQGQPIDALVLNAGQQRAGASEPVFSPQGIEITFAVNQLAHQLMASRLLPLLRAGKQPRLVITASDVHDPATGGGKVGQPADLGDLAGLRAGRGFVMLDGSGRFDGDKAYKDSKLCNVLLARELARQLEGAMPVIAWSPGLVIPRSREGFFRYNRQNNPVGMALFAAVARDLLRVTESVQTAGRLLAELVVDPAYASPGFAYFSNRLMRPGVHRFSAQATSPDGADLSRAAELWRLSEQLIEAC

SEQ ID NO: 4923 - protein, 141 aa, Glycine max
  misc_feature (7)..(7): Xaa can be any naturally occurring amino acid
  misc_feature (54)..(54): Xaa can be any naturally occurring amino acid
LVTSFEXDHLLRHPDCNTNNIYVTSAQDLIISDWKADSDDSLSERNAGSINVSXFLTGKCLAKIRASNTFPMYNICRDNPSRTCCCNSKKRKHGSKIIISPHKGGGGGPISPPRCFVYRQHACTSCWLVQQMAFYRMFCSP

SEQ ID NO: 4924 - protein, 46 aa, Brassica napus
SRVYDDEEEWFRSMFANSKKEDAIQNQYEFFVQRMGGPPLYSQRKG

SEQ ID NO: 4925 - protein, 622 aa, Saccharomyces cerevisiae
MSFSTINSNVNKTTGDSNNNTTENSSTADLLGMDLLQSGPRLMNAMQPNNSSDMLHINNKTNNVQQPAGNTNISSANAGAKAPANEFVRKLFRILENNEYPDIVTWTENGKSFVVLDTGKFTTHILPNHFKHSNFASFVRQLNKYDFHKVKRSPEERQRCKYGEQSWEFQHPEFRVHYGKGLDNIKRKIPAQRKVLLDESQKALLHFNSEGTNPNNPSGSLLNESTTELLLSNTVSKDAFGNLRRRVDKLQKELDMSKMESYATKVELQKLNSKYNTVIESLITFKTINENLLNNFNTLCSTLANNGIEVPIFGDNGNRNPTGNTNPATTTAIQSNNNTNNASPATSTVSLQLPNLPDQNSLTPNAQNNTVTLRKGFHVLLVEDDAVSIQLCSKFLRKYGCTVQVVSDGLSAISTLEKYRYDLVLMDIVMPNLDGATATSIVRSFDNETPIIAMTGNIMNQDLITYLQHGMNDILAKPFTRDDLHSILIRYLKDRIPLCEQQLPPRNSSPQTHSNTNTANSNPNTINEQSLAMLPQDNPSTTTPVTPGASISSAQHVQQGQQEQQHQIFHAQQQQQHHNAIANARSDVAIPNLEHEINTVPHSSMGSTPQLPQSTLQENQLS

SEQ ID NO: 4926 - protein, 450 aa, Coprinopsis cinerea
MVKPIEPEFEQALNELTNSLQPFLAANPEYTKALEIIQIPERVLQFRVVWEDDQGQPQVNNGFRVQYNSALGPYKGGLRLHPSVNLSILKFLGFEQTFKNALTGLNMGGGKGGSDFDPKGKSDSEIRRFCNAFMMELYRHIGKDTDVPAGDIGTGGREIGFLFGAYKKLRNEFVGMLTGKGLHWGGSFIRPEATGYGVIYYVEHMIARSCPEFSLNKPSTLVAVSGSGNVAQFTALKVIELGATVLSLSDSRGTLIAEEGYTKEFVQEIAKLKRGGGSLEELADTPGYTYHAGKRPWTLLPKVHIALPGATQNEVNKAEAEALVAAGVRIVAEGSNMGCTEEAVEVFEAARKAGKGVWYAPGKASNCGGVAVSGLEMAQNSQRLAWTTEEVDSRLKKIMSDCFSICYDAGAKWSGEDLQDGKILPSLLSGANVAGFIKVADAMREQGEWW

SEQ ID NO: 4927 - protein, 273 aa, Geobacillus stearothermophilus
MNRPFDIALAQMMPADGDIGANLAKMETIIHECKRKFPNVRLLLFPELYTTGYVLSEMLKEAAQTWDGSTFQHMSQLAQTFQLYLAYGYVEKDHTGNLYNSLMLIDPNGQCIGNYRKIHLTPFEKAWFSKGAEPVLVDTELGRIGLMICWDLAFPELARYLAVHGAELLLVPCAWESPFHAPFQKFAMARAIDNTVYVAACNQIGSSSSFHFFGLSSIYGPDGRKIAAANMNGREELVHAMIDQNQRQALKKHFYTMMDERRIDLYRQWIWRE

SEQ ID NO: 4928 - protein, 411 aa, Clostridium acetobutylicum
MDFENIKVSDSEVYSIIEEENARQENNIELIASENFTSKAVMEAMGSYLTNKYAEGYPGKRYYGGCYVVDKVEELARERAKKLFKAEHANVQPHSGSQANMAVYFAVLKPGDTIMGMNLTDGGHLTHGSPVNFSGKLFNIIAYGVSDETEQIDYEAFRKKALECKPKMIVSGASAYSRIIDFKKIREICDEVGAYMMVDMAHIAGLVAAGLHPSPIPYADFVTTTTHKTLRGPRGGAIFCKEKYAKDIDKSVFPGMQGGPLMHIIAGKAVCFGEALKDDFKDYAQQIVNNAKVFADELTKYGFRIVSGGTDNHLLLVDLTNKNITGKDAEHLLDSVGITANKNTIPFEKKSPFITSGIRMGTPSVTTRGFKEEEMKKVAYFINYVIEHRDEDLSEIRKQVSELCSGFPIYK

SEQ ID NO: 4929 - protein, 323 aa, Solanum mauritianum
EVKVGDSIEIVRFFHCYKRGVDRVFVDHPMFLEKVWGKTGSKIYGPKAGKDYLDNELRFSLLCQAALEVPRVLNLNCSKYFSGPYGENVLFIANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHKFIGLDVQIVVLGTGKKKFEQEIEQLEVLYPNKAKGVAK

SEQ ID NO: 4930 - protein, 103 aa, Unknown
  Petunia x hybrida
MSGRGKGGKGLGKGGAKRHRKVLRDNIQGITKPAIRRLVRRGGVKRISGLIYEETRGVLKIFLENVIRDAVTYTEHPRRKTGTAMDVVYALKRQGRTLYGFGG

SEQ ID NO: 4931 - protein, 107 aa, Vicia faba
KGMFSFLKDSAGVVDSPKLQAHAEQVFGMVRDSAIQIRQTGDVFLKDGSLGAIHIQKGVVDPHFVVVKEALLKTIKEASGDKWSEELSIAWEVAYDGLATAIKKAMS

SEQ ID NO: 4932 - protein, 323 aa, Solanum muricatum
  misc_feature (134)..(134): Xaa can be any naturally occurring amino acid
  misc_feature (207)..(207): Xaa can be any naturally occurring amino acid
  misc_feature (284)..(284): Xaa can be any naturally occurring amino acid
  misc_feature (316)..(316): Xaa can be any naturally occurring amino acid
EVKVGDSIEIVRFFHCYKRGVDRVFVDHPMFLEKVWGKTASKIYGPKAGQDYLDNELRFSLLCQAALEAPRVLNLNCSKYFSGPYGEDVFFIANDWHTALIPCYLKSMYQSRGIYLNAKVAFCIHNIAYQGRFXFSDFPLLNLPDEFRGSFDFIDGYEKPVKGRKINWMKAGMLESHRVVTVSPYYAQELVSAVDKGVELDNVLRKXGITGIVNGMDTQEWNPATDKYTDVKYDITTVMDAKPLLKEALQAAVGLPVDKKIPLIGFIGRLEEQKGSDILVAAIXKFIGLDVQIVVLGTGKKEFEQEIEQLEVLYPXKAKGVAK

SEQ ID NO: 4933 - protein, 321 aa, Unknown
  Polaromonas sp. JS666
MPRYINVALGQLGPIQRNDTRAQVVGRLCALMRQAHAVGAQLIVYPELALTTFFPRWYIEDPQEINQYFEREMPSAATQPLFSLAQELGVGFYLGYAELAQEAGAELRYNTSILVDRFGQIVAKYRKVHLPGHKEHEPWRRFQHLEKRYFTPGPGFGVTNAFGGVMGMAICNDRRWAETYRVMGLQGVEMVLIGYNTPVHNAPAPEHDDLSLFHNQLSMQAGAYQNGTWVVGVAKAGVEEGVDSIGGSCIIAPSGEVVARCLTKGDEMAIARCDLDFCAVYKRTTFNFDMHRQPHAYGLIVERKGETLAADGSPLPVPPAD

SEQ ID NO: 4934 - protein, 375 aa, Hordeum vulgare
EFPPSLPSVVQPGSSIPPAMALLTDLLNLDLSGSTEKIIAEYIWIGGSGMDLRSKARHLPGPVTHPSKLPKWNYDGSSTGQAPGEDSEVILYPQAILKDPFREGNNILVMCDCYTPRGEPIPTNKRYNAAKILSNPDVAKEEPWYGIEQEYTLLQKDINWPLGWPVGGFPGPQGPYYCGIGADKSFGRDIVDSHYKACLFGGVNISGINGEVMPGQWEFQVGPTVGISAGDQVWVARYILERITEIAGVVVTFDPKPIPGDWNGAGAHTNYSTESMRNDGGFKVIVDAVEKLKLKHKEHIAAYGEGNERRLTGKHETADINTSSWGVANRGASVRVGRETEQNGKGYFEDRRPASNMDPYVVTSMIAQTTILWKP

SEQ ID NO: 4935 - protein, 83 aa, Vicia faba
QVFGMVRDSAIQLRTTGDIVLKDGTLGAIHIQKGVVDPHFVVVKEALLKTIKEASGDKWSEELSIAWEVAYDGLATAIKKAMS

SEQ ID NO: 4936 - protein, 323 aa, Solanum nitidum
EVKVGDSIEIVRFFHCYKRGVDRVFVDHPMFLEKVWGKTDSKIYGPKAGQDYLDNELRFSLLCQAALEAPRVLNLNCSKYFSGPYGEDVFFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAK

SEQ ID NO: 4937 - protein, 378 aa, Unknown
  Polaromonas sp. JS666
MQEKTGSPVLRNARRIVVKVGSSLVTNEGRGLDADAIGLWCEQLAALVKDGREVIMVSSGAIAEGMKRLGWTARPKAIHELQAAAAVGQMGLAQVYESKLRENGIGSAQVLLTHADLADRERYLNARSTLLALLQLGVVPVINENDTVVNDEIKFGDNDTLGALVANLVEADALVILTDQKGLYTADPRKDPAARFVHEAKAGDAALEAMAGGAGSSIGKGGMITKILAAKRAAGSGASTVIAWGREPQALIRLTQGEAIGTLLVAQTQKIQARKQWMADHLQMRGSVAVDAGAVSKVRDEGKSLLPIGMTRVDGDFSRGDVIAIRDAEGAEIARGLANYSSSEARLICRKASSEFERLLGYTGEPEMVHRTNLVLTR

SEQ ID NO: 4938 - protein, 487 aa, Escherichia coli
MKPSTEWWRYLAPLAVIAIIALLPLPAGLESHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASNATLSWGDWFLGMLPLSILLVLLVPWLAYVLYPPILKSGDQVPRWAETELQAMGPLCSREKRMLGLMVGALVLWIFGGDYIDAAMVGYSVVALMLLLRIICWDDIVSNKAAWNVFFWLASLITLATGLNNTGFISWFGKLLAGSLSGYSPTIVMVALIVVFYLLRYFFASATAYTSALAPMMIAAALAMPEIPLPVFCLMVGAAIGLGSILTPYATGPSPIYYGSGYLPTVDYWRLGAIFGLIFLVLLVITGLLWMPMVLL

SEQ ID NO: 4939 - protein, 323 aa, Solanum ochrophyllum
EVKVGDSIEIVRFFHSYKRGVDRVFVDHPMFLEKVWGKTGSKIYGPKAGQDYLDNELRFSLLCQAALEAPRVLNLNSSKYFSGPYGENVLFIANDWHTALIPCYLKSMYQSRGMYLNAKVAFCIHNIAYQGRFAFSDFPLLNLPDEFRGSFDFIDGYEKPVKGRKINWMKAGILESDRVVTVSPYYAQELVSAADMGVELDNVLRKTSITGIVNGMDTQEWNPATDKYTDVKYDITTVMDAKPLLKETLQATVGLPVDRKIPLIGFIGRLEEQKGSDILVAAIHKFIGLDVQIVVLGTGKKKFEQEIEQLEVLYPNKAKGVAK

SEQ ID NO: 4940 - protein, 484 aa, Xanthomonas campestris
MLRGLTCRCRVCMSYAIVWFRRDLRLEDNPALRAALDAGHDPIPLYIDAPHEEGQWAPGAASRAWRHRSLAALDASLRARGSALLIRQGDSAQVLDAVIAQTEAVAVYWNRKYEPATQPRDAQIKRSLRERGLEVQSCNAALLFEPWTLATQQGRPYKVFTPFWRNALTQLRLPDAMPAPRSLPPLPASLDGVHVDALNLLPTPAWDQGFWEHWQPGEAGAHEMLEIFVDGALSGYRENRDRPDRVGTSQLSPHLHFGEIAPWRIASTLEAQRSARNGADIDGYIRQLGWRDFAYHLLHHFPDTTTQNLNPRFAGFDWATVDPVTLDAWQRGRTGIPIVDAGLRQLWHTGWMHNRVRMIVASLLCKHLRVHWLEGARWFWDTLVDADLANNTMGWQWVAGTGADAAPYFRVFNPVTQAEKFDPQATYITRWIPELAALPVKERFAPWLHPLSLARLAPTYPRAPIIGLAEGRDAALAAYAGTRG

SEQ ID NO: 4941 - protein, 56 aa, Passiflora foetida
WEYQVGPSVGIDAGDHIWCSRYILERITEQAGVVLTLDPKPIEGDWNGAGCHTNYR

SEQ ID NO: 4942 - protein, 323 aa, Solanum physalifolium
EVKVGDTIETVRFFHCYKRGVDRVFVDHPMFLEKVWGKTGSKIYGPKAGQDYLDNELRFSLLCQAALEAPRALNLNCSTYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEEEIEQLEVLYPNKAKGVAK

SEQ ID NO: 4943 - protein, 408 aa, Glycine max
  misc_feature (270)..(270): Xaa can be any naturally occurring amino acid
  misc_feature (281)..(281): Xaa can be any naturally occurring amino acid
  misc_feature (297)..(297): Xaa can be any naturally occurring amino acid
HFVRAEMLPSGYLIRPCEGGGSIIHIVDHMDLEPWSVPEVLRPLYESSTVLAQKTTMAALRHLRQISHEVSQSNVTGWGRRPAALRALSQRLSRGFNEALNGFTDEGWTTISNDGVDDVTILVNSSPDKLMGLNLSFANGFPSVSNAVLCAKASMLLQNVPPAILLRFLREHRSEWADNNMDAYTAAAIKVGPCSLSGSCVGNFGGQVILPLAHTIEHEEFLEVIKLEGIAHSPEDTIMPREMFLLQLCSGMDENAVGTCAELISAPIDXPFADDAPLLPXGCRIIPLESGKEASPXRTLDLASAPDVGPSGNRASNGCANSSCMRSVMTIAFEFAFESHMQEHVTSMARQYVRSIISSVQRVALALSPSHLSSHAGLRSPLGTPEAQTLAHWICNSYRFVKFTVFAY

SEQ ID NO: 4944 - protein, 57 aa, Passiflora foetida
WEYQVGPSVGIDAGDHIWCSRYILERITEQAGVVLTLDPKPIEGDWNGAGCHTNYST

SEQ ID NO: 4945 - protein, 75 aa, Passiflora foetida
GTNGEVMPGQWEYQVGPSVGIDAGDHIWCSRYILERITEQAGVVLTLDPKPIEGDWNGAGCHTNYSTKSMRDDGG

SEQ ID NO: 4946 - protein, 342 aa, Brassica napus
MATPNLECRMYEAKYPEVDMAVMIQVKSIADMGAYVSLLEYNNTEGMILFSELSRRRIRSVSSLIKVGKIEPVMVLRVDKERGYIDLSKRRVSEEDIQTCEERYNKSKLVHSIMRHVAETLSLDLEELYVNIGWPLYRKHGHAFEAFKILVTDPDSVLGSLTREVKEVGPDGQEVTKVVPAVTEEVKDALVKNIRRRMTPQPMKIRADIELKCFQFDGVVHIKEAMRKAEAAGNDDCPVKIKLVAPPLYVLTTQTLDKDQGIKILDEAIVACTEPIEEPKGKLVVKEAPRAVSEKDDKMLTEHMAKLRMANEEISGDEESGEEEEDTGMGDVDIDGGAGIIE

SEQ ID NO: 4947 - protein, 541 aa, Anabaena variabilis
MPQLAPHIFDILYQKGVEHAFGIPGDFALTLFDALADSKIAPIVMTHEPCVGFAADAYSRMRGLGLAVVTYSVGGLNMVNAVAGAYAEKSPLVILSGGPGVREQKEHDLLHHKVKTFDTQRRVYEEVTLYATKLTDPKTADAKIHHALDYATTFKRPVYLEIPRDLVYAEITESEHLPPPIKRTDPDTLTEAIAETLEMLKRSHSPVILACVEVHRFGLQEQLLALAEKLGVPVCSTMLGKSVFPERHPQYIGIYNGEAGDLNVQKIVEESDCVLMLGVFMTDINLGMFTAHLNPGFTVYATSERLAIKHHEYPNVRFEDYITTLLDSPDLPHWDSSGIYTMKPRVTPSVGKISMSGLLYELNQFIDSNTLLVTDVGDALFAADDIQTQQGTSFLCPAFYASMGFGVPGVIGAQLADPSRRAIALVGDGAFHMTGMELLTAQRLRLNPIVIVINNGSFASLQAMGHQEAAFVQIPTMDYAQLANVLGGHGFVIHTSTQLQQALQTAQNSKTFSILDVHLSPDDVSPALQRLSALFTKSLKG

SEQ ID NO: 4948 - protein, 482 aa, Neisseria meningitidis
MKGDIGVIGLAVMGQNLILNMNDCGFKVVAYNRTIGKVDEFLNGAAKGTGIIGAYSLQDLVDKLAKPRKIMMMVRAGSVVDDFIEQLLPLLEEGDIIIDGGNANYSDTTRRTHYLAGKGILFVGAGVSGGEEGARRGPSIMPGGDKRAWEAVKPIFQAIAAKTPQGEPCCDWVGRDGAGHFVKMVHNGIEYGDMQLICEAYQFMKDGLGLSYDEMHRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQTLLASKIISYAQGFMLIREAGESYGWDLDYGNTALLWREGCIIRSAFLSNIRDAYENNPDLVFLGTDPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 4949 - protein, 365 aa, Anabaena variabilis
MDNIFRFADELGPAKIIHIYEREADLKAIVVVDNIDCGPAIGGVRMATDVTTEEVFRLARAMTLKNAAADLPHGGGKSAILADPKQPLADKERLVRTFARAIRDVTEYIPGPDMGTDEQCMAWIKEEIGRAVGLPKAIGGIPLDEIGATGFGLSICAEIASKFCHLNLEGARIVIQGFGSVGKNAARFLTAKGALLIGAADSQGTLFNPLGIDVKQLIKLKNSGKSVISYPQGDKLDRDAVIDIECDIWIPAARPDIIHADNVDRLKTQLVISGANIPFTEAAERICHERNIIVVPDFIANAGGVICAAVEYDGGNQTTAFETIAKKIRYNTTLVLEQVAKTGKLPRQAAVELAQRRICLARQDI

SEQ ID NO: 4950 - protein, 445 aa, Unknown
  delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPAPLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEGAVISNSLVYNGCQVEGRVENSVLFPGVQVKPGAVVRDSVLFFDNVVGRDCHLEKVVSDVNVTVGDGVVIGVPGPPAAGGATGAGRASGAENLAGGESGGATTTVTVLGWNNQIPAGMVIGAGCTLYPSLGPEKMARQRVADGEVLR

SEQ ID NO: 4951 - protein, 241 aa, Pyrobaculum aerophilum
MGSVYIVGAGPGDPELITVKGLRLIERADVILHDRLVSRELLKAAKPGALIIDVGKSPGGVGPSQEEINKMLLSYATSYDIVVRLHGGDPLVFGRGFEECKYLVERGIPCEIVPGVTSGLAAPAKYYIPPVLRGVASSVALVTGREDPSKGTRQVDFKKLASAVDTIIIYMGASVAGDVARELIAGGLSPNTPVAVIKSAFFPDEEFIVTTLGGLSAVPNPSIIVVGEVVKRGVDLWKRRL

SEQ ID NO: 4952 - protein, 421 aa, Unknown
  delta proteobacterium MLMS-1
MSRKQDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRSYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPGAVVRDSILFHDCRVAAGATVDLAILDKRVQVGEKAVVGQGEDKTVANRANPKHLYSGISLIGKQARIPAGAVIGRNCIIAPHSRSQQVPAQLPTGESV

SEQ ID NO: 4953 - protein, 438 aa, Kluyveromyces lactis
MGQILSNPVIDKEQHSGSDVLTAFGLCAMQGWRMSMEDSHIVDLNISDDEKEHLAYYCVFDGHGGSSVAQFCGSQFSKILQKQDAFKKKSYNEALIQSFIATDEELLKDPVLANDHSGCTATTLLISKLQNVMICANSGDSRTVLSRNHIAKALSYDHKPTLKSEYSRIVTADGFVEMDRVNGNLALSRAIGDFEFKSNPDLAPHEQIVTCVPDLIEHTIDYNSDEFVILACDGIWDCLTSQDCVDLVHYGLKQGLTLEEISSKIIDVCCSPTTEGTGIGCDNMSIIIVALLKEDEDETAWHKRIVAKNYTPPNSFENQRRAVFHFYDFPENDDHVFEVTNKRESDETDYNDDRKVGADRGASSLANLEAILGSGGIQITPGENNLSYIHGTALSEVLASLSGGIRSQIEEEDEDDEEDEADEPTHADEVEESEVKKD

SEQ ID NO: 4954 - protein, 980 aa, Haemophilus ducreyi
MKRMLINATQKEELRVALVDGQRLFDLDIENPGHEQKKSNIYKGKITRVEPSLEAAFVDYGSERHGFLPLKEISREYFPADYVFNGRPNIKDIIKEGQEVIVQVNKEERGNKGAALTTFISLAGSYLVLMPNNPRAGGISRRIEGDERLELKEALDCLDVPEDVGLIVRTAGVGKSPEELQWDLKVLLHHWSAIKQSAESRPAPFLIHQESDVIVRAIRDYLRRDIGEILIDNKKIFEKAKNHIRLVRPDFINRIRLYEGEVPLFSHYQIESQIESAFQREVRLPSGGSIVIDVTEALTAIDINSSRSTRGGDIEETALNTNLEAADEIARQLRLRDLGGLIVIDFIDMTPVRHQREVENRIREATRQDRARIQFGRISRFGLLEMSRQRLSPSLSEASSHVCPRCQGTGKIRDNESIALSILRLVEEEAIKENTAQVHTIVPIQIASYLLNEKRTAISSIEKRHNVQVVVVPNQNMETPHFSVYRLRENELLPTLSYDLAKLYEMRSEDSPLYTHQIPSAEENLTTRNEPVITVESVLQSSELNIQPAPMPTSANQPSLLNRLIAKIKGLFAKTEEKVEAKPKPKTRNQRERRNRRDRSNRNDRQERKQATPNQTQEDAKPTRQERTEPKKARRQIVEEVAGVQEAQPERRVARDQQSTERRQRRDLRKKVRVEPITTEEPAIENTPIQTEVTKPLSVAKVQNNKVAEPVVTQAPEQPQPQELPTEVNEERNEQRENNRQRRLPRHLRVSNQRRRENNNPRTESPVAAMPLNAAVASPELASGKIWIKFGTPPSTEQAEAKPEEKVRFLSVDEMLEQQQTQSKASNTTTENTKEKEISAVAPLGGFVTQHSDRDLVKEKNARNQHLVQPHTQVEDEIIEKEIVEETIAKHASPLGDFVPQHSELDLVQERHERMQKQPTIEAVEPATEQQPNEKESQPTLPISSVDNCAIDRRLGTFSRVEHTQAGMTSCRCNRNSHDN

SEQ ID NO: 4955 - protein, 457 aa, Unknown
  Torenia hybrid cultivar
MAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 4956 - protein, 176 aa, Brassica napus
DSGWRALEFLGLDDDKSSVEFDRLKVDLIITDYCMPGMTGYELLKKIKESTSFREVPVVIMSSENVLTRIDRCLEEGAEDFLLKPVKLADVKRLRTYLTGDVKVSDGNKPKVPEDLSRFSSLAMVTPPPPPPPSITSVKSSSLEEIVSSSPPPSESSVSPVGSPIRPMEMRSPGLD

SEQ ID NO: 4957 - protein, 275 aa, Unknown
  delta proteobacterium MLMS-1
LFGFGGARGGSRRASGGPIPGNDLRYDLVISFMEAAHGVEKEVEISKGETCWTCEGSGARPGHPPESCSTCNGIGQVLHAQGPFRVQSACPHCRGQGRVVTEPCQDCQGQGLVKRSKKVSLKIPAGVDSGARMRLKGEGEGGRRGGPAGDLYVIIHVQPHDFFQREGYDIVCSLPLSFTQAALGCSLEVPTIYGSHKLKIPAGTQQGQHFTINEMGVAKLRGGGYGDMICEVRVVVPKRLTKKQKKLLKEFADSEEDPSDDAAKGDGFLKKFFHL

SEQ ID NO: 4958 - protein, 423 aa, Prochlorococcus marinus
MNILQNLKKSDPIISNLINSEKNRQETHLELIASENFASMAVMQAQGSVLTNKYAEGLPQKRYYGGCEFVDEIEELAIERAKQLFDADWANVQPHSGAQANAAVFLSLLNPGDTILGMDLSHGGHLTHGSPVNMSGKWFNAVHYGVDKETNKLNFNVIRDIALATKPKLIICGYSAYPRTIDFKSFRSIADEVGAFLMADIAHIAGLVASKLHPNPIPYCDVVTTTTHKTLRGPRGGLILCKDKEFGKKFDKSVFPGTQGGPLEHIIAAKAVAFGEALQPNFVNYSKQVIKNAKVLSSTLINRGIDIVSGGTDNHIVLLDLRSINMTGKVADLLVSEVNITANKNTVPFDPESPFVTSGLRLGTAALTTRGFNDEAFIEVGEIIADRLLNPDDLLIEKECKERVLSLCNSFPLYEAKLESSIK

SEQ ID NO: 4959 - protein, 598 aa, Unknown
  Klebsiella sp. LX3
MSFVTLRTGVAVALSSLIISLACPAVSAAPSLNQDIHVQKESEYPAWWKEAVFYQIYPRSFKDTNDDGIGDIRGIIEKLDYLKSLGIDAIWINPHYDSPNTDNGYDISNYRQIMKEYGTMEDFDSLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSGMRFDTVATYSKIPGFPNLTPEQQKNFAEQYTMGPNIHRYIQEMNRKVLSRYDVATAGEIFGVPLDRSSQFFDRRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQAAAPHSTSLSLSPWQAGVYKLR

SEQ ID NO: 4960 - protein, 259 aa, Brassica napus
METLLSPRALSPPLTIPTPSPLSLFRPISSQSAKLTKPESPFLKASAVGRRRLMMGGLLMSGLIVSEANLPTSAFALTPVFREYIDTFDGYSFKYPQNWIQVRGAGADIFFRDPIVLDENLSVEFSSPSSSKYKSLDDLGSPEEVGKKVLRQYLTEFMSTRLGVKRESNILTTSSRVADDGKLYYQVEVNIKSYANNNELAVMPQDRVARLEWDRRYLAVLGVENNRLYSLRLQTPEKVFQEEEKDLRRVMDSFRVEKF

SEQ ID NO: 4961 - protein, 577 aa, Unknown
  Shewanella sp. MR-7
MHESQITSSATQTVKTSRLSWFDDVLLLGIMAVLAGCGLIYEYLLSHYAGRILGALEAAIYTMIGLMIVSMGLGAFAARKIKDAFTGFVVLELTVALCGSLAILITAAVIGFGQQLPMLIASTLGLPPDQLPEGGMIGSLQKLSEYLPYVWGVLLGLMIGMEIPLIARVRQSLSDEHLLHNAGTIYGADYIGAGIGAAIWVGFMLAIDIQLAAALTASFNLLAGFVFIWRFWPKIQRAKLLLAGHFVVTGVLLLLAIQGPSWELQFNNLLYKDKVVYAKATRFQQLTFTERLRGNGLSPIYSLYINGRLQFSSIDEHIYHAFLVHPTLAASARHNKVLIIGGGDGLGLKQVLRWEPEQVTLLDLDAALVQLFKTPDTDMPKRLSQALLALNGNAFNDPRVKVIHDDAFNGVDKLIAAGDKYDAIIVDLPDPSHPDLNKLYSDYFYRKLKELMSSDGALTVQSTSPYHAQKAFISVAKTLALAGFDVKQYHHNVPSFGEWGWSIATLSGKDAQHRLGELTTLPIADDWLTLGLVKGAFEFPANFYQDAASIKPNELGSLQLYHYHQQAWSETQGLDLF

SEQ ID NO: 4962 - protein, 264 aa, Panax ginseng
  misc_feature (13)..(13): Xaa can be any naturally occurring amino acid
  misc_feature (22)..(22): Xaa can be any naturally occurring amino acid
QTPNLQSLSSDPXASTAWVQKXIKDYTPGVNFKYIAVGNEVDPNRENSRQYVNFVLPAMQNIHNAIKAAGLNQIKVSTATYSGLIGPNSSPPSLGSFDDNVKGFINPIVTFLAQNNLPLLVNIYPYFSHNEGNLPYALFTAQGVVVTDPEGNRGYNNLFDALVDVQYSALEKAGGPNVEVVVSESGWPSAGGINDASVENAQTYYQNLINHVRGGNGTPKRPGRPIETYLFAMFDEDKKAGDEVEKHFGLFTPSQQSKYQLSFD

SEQ ID NO: 4963 - protein, 498 aa, Kluyveromyces lactis
MLSRSARCSRAVLFSAKRSLASQANTGANASANQVMVSKHVQDIDPEMYDILTKERKRQKHSITLIPSENFTSKSVMDLLGSEMQNKYSEGYPGERYYGGNQFIDMAESLCQKRALELYNLDPQLWGVNVQPLSGAPANLYAYSAVMETNDRLMGLDLPHGGHLSHGYQLPSGTKISYISKYFQTMPYHVDSQTGIIDYDFLSKTSKLFRPKVIVAGASAYSRVLDYKRFKEIADACGAYLMSDMAHISGLVAAGVTRSPFEYSDIVTTTTHKSLRGPRGAMIFYRKGVRKVTKKGKEVLYDLDKRINFSVFPGHQGGPHNHTISALAVALKQAATPEFKEYQAAVVENARIFGEELVKKGFELVSGGTDTHLILINLSNLGIDGARLETLLENINIAANKNTIPGDKSALFPSGLRVGTPAMTTRGFGPQEFAQVAAYIDRAVKLAIGIKSQESPDAKDARSKLASFKELCKESDQVKQLADEVYQWVGEFPVPGEL

SEQ ID NO: 4964 - protein, 334 aa, Chlamydia muridarum
MKETIAYLGMGMWGFSLANLLANNGHRVVGWARNPSLIEQLSTQRQHPAAPHVTIPSNLSFTSSMEEALDGATMIVEGVTSAGMRPVLNQLKSITDLQIPLVITSKGIEQNTGLLLSEIALEIFGKPAAKYLGYLSGPSIASEVLRGCPCSVVISAYDPATLKQIHQAFLTPTFRVYPNSDLKGVALGGALKNVIAIACGISDGFRFGDNAKSGLVTRGLHEIRKFATIMGCRPDTLNGLAGLGDLCTTCFSAFSRNTLFGKMLAEGLTPEQAKTKIGMVVEGVYTALSAHQIATHHKIDMPITTGVYRVLYENLDIQKGIAQLLQRNTKEEYL

SEQ ID NO: 4965 - protein, 219 aa, Brassica oleracea
MAFHSEDDRSEDYLFKIVLIGDSAVGKSNLLARFARDEFYPNSKSTIGVEFQTQKIDINGKEIKAQIWDTAGQERFRAVTSAYYRGAVGALLVYDISRKQTFHSIGRWLNELHTHSDMNVVTILVGNKSDLKDIREVPTAEGKALAEAQGLFFMETSARDSSNVAAAFETVVKEIYNILSRKVMSSQELNKQDPASLSNGKKVVIPSEAQGEAKKGGCC

SEQ ID NO: 4966 - protein, 323 aa, Solanum pinnatisectum
EVKVGDSIETVRFFHCYKRGVDRVFVDHPMFLEKVWGKTGSKIYGPKAGLDYLDNELRFSLLCQAALEAPRVLNLNSSNYFSGPYGEDVLFIANDWHTALIPCYLKSMYHSRGIYLNAKVAFCIHNIAYQGRFSFSDFPLLNLPDEFRGSFDFIDGSEKPVKGRKINWMKAGILESHRVVTVSPYYAQELVSAVDKGVELDNVLRKTCITGIVNGMDTQEWNPATDKYTDAKYDITTVMDAKPLLKEALQAAVGLPVDKKIPLIGFIGRLEEQKGSDILVAAIHKFIGLDVQIVVLGTGKKEFEQEIEQLEVLYPNKAKGVAK

SEQ ID NO: 4967 - protein, 66 aa, Arabidopsis thaliana
  misc_feature (27)..(27): Xaa can be any naturally occurring amino acid
MAFSMFFYTDVVTSPAQATMDAPFTGXKSSAYLPDTRKANNDITSITSNGCRGSCMKVWPPIGKKK

SEQ ID NO: 4968 - protein, 334 aa, Neorickettsia sennetsu
MVLMDSVVIGGGAWGTAIANLLAFNTQRVTIFCRNTTVIDSINKRHINTKYLPTFPLNKNISATSRMDVLKNAELIFVAVPSQSMRELLQKVKENIKESVQIILCNKGIERESLLLMSEVVHEELPKNDIFVLSGPNFAHEVLSKKPSFSNLAGRNKTSYDKIANALSTETFFTKYITDINGTQILGAFKNVIAIICGLLVRMDAGSNTLSALMSLALEEARSFITIKNGNPDTIMEFCGIGDLVLTCFSNKSRNFRYGYRLVDGYSENALVEGKSTLESLHELARIHNINCVLTNTLYTVTQFNSYGTSSFEQDIKRELNSAFMSLLGCAKNP

SEQ ID NO: 4969 - protein, 323 aa, Solanum pubigerum
EVKVGDSIEIVRFFHCYKRGVDRVFVDHPMFLEKVWGKTASKIYGPKAGQDYLDNELRFSLLCQAALEAPRVLNLNCSKYFSGPYGEDVFFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYRNKAKGVAK

SEQ ID NO: 4970 - protein, 168 aa, Burkholderia xenovorans
MTTQTETALLAGGCFWGMQDLLRRYPGVLSTRVGYTGGDVPNATYRNHGTHAEALEVVFDPRQISYRQILEFFFQIHDPTTKNRQGNDVGTSYRSAIFYLDDEQKRVAENTVADVEASDLWPGKVVTEIAPAGPFWEAEPEHQDYLERIPNGYTCHFVRPDWKLPKRG

SEQ ID NO: 4971 - protein, 437 aa, Unknown
  Nostoc sp. PCC 7120
MRRIGEKHMVSMPTLPLEGASPAHICPFDQACSYLEAAAKELRLDQGALEILSHPRKVVTVSIPVRLDNGDIRVLAGHRVQHSDILGPYKGGTRYHPAVTLREVSALAMLMTWKCALLGIPYGGAKGGIAIDPEHYSVGELERITRRYTSELIKDIGPSVDIPAPDVGTSAREMAWMMDTYSMNVGHAVPGVVTGKPISIGGSRGREMATGRGVMIIVREALADMGRTLEGVKVVIQGFGNVGGAAAELLYQAGAKILAVSTGAGGLFASDGLDIPALKAYAAENHRSIVGFPQAVPISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 4972 - protein, 161 aa, Pseudomonas fluorescens
MTDSLLTIPCTTIKGEQKTLADFAGKAVLVVNTASKCGFTPQYKGLEELWQTYKDQGLVVLGFPCNQFGKQEPGNEGAISEFCELNYGVSFPLFKKVEVNGAGAHPLFAQLKKRAPGVLGSQGIKWNFTKFLIGQDGKLVKRFAPATKPQDLSREIEALLK

SEQ ID NO: 4973 - protein, 323 aa, Solanum riojense
EVKVGDSIEIVRFFHCYKRGVDRVFVDHPMFLERIWGKTGSKIYGPKAGQDYLDNELRFSLLCQAALEAPRVLNLNCSTYFSGPYGEDVLFITNDWHTALIPCYLKSMYQSRGIYLNAKVAFCIHNIAYQGRFAFSDFPLLNLPDEFRGSFDFIDGSEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEEEIEQLEVLYPNKAKGVAK

SEQ ID NO: 4974 - protein, 379 aa, Neorickettsia sennetsu
MPGKKKDYYEILGVSRSASTEEIRKAYKKLALQYHPDRNKGDKEAAEKFKEIGEAYSVLSNPEKKASYDQYGHSAFNGGGFGGAGGFSADFSGMDFSDIFNDLFGGGRTRRTKADFNEVIKEDGSDLRYDVSITLREAFEGKEVKISYTKLAECEQCGNTGCEGKIKPVQCSTCNGAGSIRSQQGFFTVERSCSTCNGSGMIIENPCKKCGGTGRIRKGVTTCAKIPRGISDGAKVLLRGQGEAGSRGGKPGDLYMIVHIKQDEFFTRKNNDLYCEVPIRMSLAALGGEIEVPSLEGKKFKIKLPEGSQTGDKLKLKGKGMYLLNSEYRGDMYVRLTIETPVKLTKKQREILEEFEKESLGCSPKSEKFFSKIRSMFGL

SEQ ID NO: 4975 - protein, 85 aa, Oryza sativa
YSICHEVKLTTARRGFPMEACDLIGGEGCNVQMYPKGKLSSSAAVAVSRAAAEEVHRDYLSYDEPTTVFPEEGCDDLGGEFCKGT

SEQ ID NO: 4976 - protein, 323 aa, Solanum rovirosanum
EVKVGDSIEIVRFFHCYKRGVDRVFVDHPMFLEKVWGKTGSKIYGPKAGQDYLDNELRFSLLCQAALEAPRVLNLNSSKYFSGPYGENVLFIANDWHTALIPCYLKSMYQSRGMYLNAKVAFCIHNIAYQGRFAFSDFPLLNLPDEFRGSFDFIDGHEKPVKGRKINWMKAGILESDRVVTVSPYYAQELVSAADKGVELDNVLRKTCITGIVNGMDTQEWNPATDKYTDVKYDITTVMDAKPLLKETLQATVGLPVDRKIPLIGFIGRLEEQKGSDILVAAIHKFIGLDVQIVVLGTGKKKFEQEIEQLEVLYPNKAKGVAK

SEQ ID NO: 4977 - protein, 323 aa, Solanum rugosum
EVKVGDSIEIVRFFHCYKRGVDRVFVDHPMFLEKVWGKTGSKIYGPKAGKDYLDNELRFSLLCQAALEAPRVLNLNCSKYFSGPYGENVLFIANDWHTALIPCYLKSMYQSRGIYLNAKVAFCIHNIAYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHKFIGLDVQILVLGTGKKKFEQEIEQLEVLYPNKAKGVAK

SEQ ID NO: 4978 - protein, 43 aa, Passiflora garckei
WEYQVGPSVGIDAGDHIWCSRYILERITEQAGVVLTLDPKPIE

SEQ ID NO: 4979 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 4980 - protein, 59 aa, Passiflora hahnii
WEYQVGPSVGIDAGDHIWCSRYILERITEQAGVVLTLDPKPIEGDWNGAGCHTNYSTKR

SEQ ID NO: 4981 - protein, 417 aa, Acidobacteria bacterium
MIETLGVLLAGGAGERLYPLTRDRAKPAVNFGGIYRIIDITLSNCINSGLRRVYILTQYKALSLNRHIREGWSGIVGNELGEFIEILPPMKRVSENWYMGTADAVYQNIYSIGSEQPRYVLILSGDHIYKMNYDLMMRQHKDSGADVTLATILIDPSETRHFGVVDVDNQSHVNGFVEKPKSTELRSPYDPSKVSASMGIYIFNTDVLIPVLLKDAEDPNSKHDFGHNILPKMVGEYKIYSFNFIDENKKEALYWRDVGTLDAYYDANLDLVSVAPVFNLYDKAWPIRTHQRQYPPAKFVFAEQGRMGTALDSVVSMGCIVSGGTVRNCVLSPDVRVNSFSEVDSSILFSHVNVGRHCRIRRSIIDRDVHIPEGTVIGYDTESDRQKYHVTDSGITVVTRDYSLFENPVEVDYFTSE

SEQ ID NO: 4982 - protein, 58 aa, Passiflora helleri
WEYQVGPSVGIDAGDHIWGSRYILERITEQVGVVLTLDPKPIEGDWNGAGCHTNYSTK

SEQ ID NO: 4983 - protein, 438 aa, Prochlorococcus marinus
MSTNFSVPEPTPQLVKVAESAKEASISLGQSTNKQRCEALTEMANALNDNADEILKANVQDLERSEKEGLNKSLLSRLQLTKTKLKGCIDGVLKVSNLADPIGKRQLHRELDENLILERVTVPLGVLGVIFESRPDALIQIASLAVRSGNGALLKGGSEAKDTNQSIMDSLDKGLRKSNVGSGALSLLTTRQESLGLLRLDKFVNLIIPRGSNELVQFIQENTRIPVLGHADGICHLYVDNSVDIDKAISIALDSKIQYPAACNAIETLLIHEDVAEMFLKKGLPIFSSEGVTLKGDTKSQALGVKNKADESDWSKEYLDLILSIKIVRNVNEAIEHIRKYSSRHTEAIVTEDKMVAEKFLSSVDSAGVYHNCSTRFADGFRYGFGAEVGISTQTLPPRGPVGLEGLVTYRYYLRGDGDLVKDFASGDRSFSHIDLPL

SEQ ID NO: 4984 - protein, 447 aa, Desulfitobacterium hafniense
MRKGKILIGLLAAMIISIVAVGCSSKTSQPVAFRAEIAPGTLSVDEYAKYYPKQYDTFMKTAEMSNEGSKYGGSEEFDKLTQWPFLKEIFAGYGFAIEYNEDRGHNYTIEDVTKIKRINEKSIASCWTCKSANVAGVVEEMGDAYYGANFHDLKGKMTEGITCANCHDPQTMNLVITQPPLRDTLTRLGKDPDKLTTQELRTMVCAQCHVEYYFAGDKKIVTFPWDKGLTPTDVLEYYEEKDFSDWTHAKAGVREIKAQHPEYETFMGSTHAEAGLSCADCHMPYTMNGGEKISSHWWTSPLKHMNESCLTCHREGEEALKERVFYTQDKVADMMAKVGNVTVEALEAIAEADAKGGNQDALKEARALQRKGQFLVDWVGAENSMGFHNPQLIMETLNTSMDYAYQAINKATESITGVAAPKWDVEAPKTNTETMKVLHDKENAPKS

SEQ ID NO: 4985 - protein, 199 aa, Unknown
  delta proteobacterium MLMS-1
MKQVQDHYYHRAKKEGYPARSVYKLIEAQQKFRLLRPGDRVLDLGCQPGGWSMFAAEQVGARGLVVGVDLNPGPIRPRKGAPFHFVLGDINRESVLARVREITPDYTVLLSDMAPRTTGNRWADQQQSLRLAREVLRLAGELLAAGGNFYCKVFEGEDFQELVADCRQRFAKVKIFKPKSSRAESREVFVLGLKHKQGG

SEQ ID NO: 4986 - protein, 720 aa, Deinococcus radiodurans
MPYKSLTLRPGSPFPLGATWDGKGTNFALYSENATGVELCLFDAEGHETRFPLTEQTAFVWHGYLPGIQPGQRYGYRVHGEYAPEKGLRFNPNVVLLDPYAKALDGTEQFDRGVFGYVAGGEDDSQMQEEEQRGAPLGLVVDPMFNWVGDQKPGIPFHQSVIYEAHVKGLTMTHPDVPEELRGTYAGVATPAILDYLRDLGITAIEFLPVHQHVDDPFLLDKGLTNYWGYSTLNFFAPDVRYSAEARKGNPSGAVPEFKNMVRALHDAGIEVILDVVYNHTAEGNHMGPTMSFKGIDNPTYYRLVADDQRFYFDYTGTGNSLNVRHPQTLQLIMDSLRYWVTEMHVDGFRFDLASTLARGLHEVDQLSGFFTIIHQDPIISQVKLIAEPWDVGEGGYQVGNFPVNWAEWNGIYRDDMRSFWKGEGGLASEIGYRITGSSDLYEFNGRKPYASINFVTAHDGFTLRDSVTYEQKHNEANGEGNNDGHNHNITWNCGVEGPTDDPEINRLRGQQMRNFLATLLLGQGTPMILGGDEFGRTQGGNNNAYCQDNDISWYDWEKVDEELLAFTRKLIALRKAHPSLHRRKFFAGRNIRGEDVRDIVWLRFDGAEMSDEDWNNPQTQSLGMFLAGDGLADVDAEGKPLTDDHLLLLLSSSYVDLPFKMPDLGGCGEWDLLLDTSDDGAEEKVAAGGETTLRGRSVKLYRCQVPEKELEKLAEPAEA

SEQ ID NO: 4987 - protein, 411 aa, Brassica napus
MNALAATNRNFRHASRILGLDSKIERSLMIPFREIKVECTIPKDDGTLVSFIGFRVQHDNARGPMKGGIRYHPEVDPDEVNALAQLMTWKTAVADIPYGGAKGGIGCNPRDLSLSELERLTRVFTQKIHDLIGIHTDVPAPDMGTNAQTMAWILDEYSKFHGHSPAVVTGKPIDLGGSLGREAATGRGVVYATEALLAEYGKSIQGLTFVLQGFGNVGTWAAKLIHEKGGKVVAVSDITGAVRNPEGIDINALLKHKDATGSLKDFNGGDAMDSEELLLHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 4988 - protein, 475 aa, Kluyveromyces lactis
MDDLGEQLSEGHKDDYDNGIGSVPGGSGSNGKGKSQRTSFNDFVRKLFLILESEEYTSIISWSPDGKNFIVLDTNKFTTDILPKHFKHSNFASFVRQLNKYDFHKVKRKKNEVSEGIQNAWEFNHQYFRRHDEAGLDNIRRKPSSQKKILVDENSVIVRKLGGAPGDDGAFIAGDEEGMTAKMLLKNTVNKTKFNQLKRKVEDMENQVQYLTNENHNMKLDLQKIQSKYNMALESLLSTESFNSQLISNFQILVDALSQQGLKVPVGLSFEKGNSRADNKSHQQRQISDSTGSTPNANIPGLSVNTTLQKQEPIELLPMDQHPVLRPGFHVLLVEDDSVCIQLCSKFLRKYGCSVEVVTDGLSAISTLEKQRFDLVLMDIVMPNLDGATATSIVRSFDNETPIIAMTGNIDDQDLVTYLQHGMNDILAKPFTKDDLHSMLIRYLKDRIPLSEQRQNSNNDPKAYVEEPMLKKPHI

SEQ ID NO: 4989 - protein, 694 aa, Desulfotalea psychrophila
  misc_feature (134)..(134): Xaa can be any naturally occurring amino acid
MQKTLTTCPYCGSGCTFFLEVENNTITGVSPNRVRAVNNGSLCSKGHFGTDFVHSKDRLTKPLIRKKGVLTPVSWQEAYSYTAQRLLQISEEHGAQAIAGFSSARCTNEENYLFQKMMRAALGTNSVDHCARLXHAPTVAGLTTTLGSGAMTNSIAELDTMGAGDTIFAIGTNTTECHPIIGLGMLRAVKRGARLIVADPRATTLTQHAEVWLRLQPGSDVALLNALGHLILRDGLEDRVYIDAHTENFSAYRSFVEKISLAEAESITAVALADMEKAARILGESANVATYYTMGITQHTSGVDNVMAVSNVAILTGNIGRAKTGVNPLRGQNNVQGACDMGALPDVFPGYQKVSRPEIVEKFSRAWGVELSARPGITIPSVLSGIERDEVKALYVFGENPLRSDPDINHVKHCLEQVEFLVVQDIFLTETAALADVVFPGTTFAEKDGTFSSTERRVQRVRRAVDPIGESRPDWQIISELMVALGYPSSYTHPREIFAEMRSLTPTYAGITYERLENESLQWPCPHENHPGTPVLHVGGAIRGLARFEPAQHRQPAEVPDTDYPLKLTTGRVVAHYHTGTMTRRCWGLNGVAPHELVEIHPHDALCLGIIDGDLVRVASRRGAVEARAQVTTRVIQGLVFMTFHYTESSGNMLTNSAADPITQTPELKICAVSVQKVERKAVSPHNRRKRQMV

SEQ ID NO: 4990 - protein, 569 aa, Mycobacterium leprae
MTAPKIEAVYTVGAYLLDRLAELGVTEIFGVPGDYTLEFLDHIVAHPTIRWVGNANELNAGYAADGYGRLRGISALVTTFGVGELSAANAIAGSYAEHVPVVHIVGAPPKDAQSTHRALHHSLGDGDFEHFIRISSEITCSQANLTTATACKEIDRVLSEVRKHKRPGYILLSTDVARFPTEPPAAPLPGHTDGTSPRALSLFIDAATKLIADKRMTVLADLLVHRLQVVKELETLLTADVVPYATLMWGKSLLDESSPNFLGIYAGAASTEAVRAAIEQAPVLVTAGVVFTDMVSGFFSQRIDPARTIDVGQYQSSVADKVFTPLEMGDALEALASILVRRGVSSPPVELPPGNPTADTPSPTQRLTQQILWDRLCAALTPGNVVLADQGTAFYGMVEHRLPRGVTFIGQPLWGSIGYTLPAALGAGLAHRNRRTVLLLGDGAAQLTIQELGSFYREGLSPVIVVVNNDGYTIERAIHGATAPYNNIARWRWTDIPGALGVANHSSFRAETYGELDEAFAVAAELKDQMVFVEVIVPKLDLPSLLTALTRPAQDSNRIFQLPNPGWDN

SEQ ID NO: 4991 - protein, 378 aa, Oryza sativa
MATAVASQVAVSAPAGSDRGLRSSGIQGSNNISFSNKSWVGTTLAWESKATRPRHANKVLCMSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRYDKALSREQKNKNAGKMYVQDKIEEYSDEIFKLLDGGAHIYFCGLKGMMPGIQDTLKKVAEQRGESWEQKLSQLKKNKQWHVEVY

SEQ ID NO: 4992 - protein, 355 aa, Escherichia coli
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDRETLNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 4993 - protein, 248 aa, Brassica oleracea
MGKEDLGLSLSLGFSQHNNPSSSISNNLHRFPWNQTLASTSDLRKIQVNTLPSTVDCEEEAGVSSPNSTISSTISGGKRSEREGTDEEEDAGGETSRKKLRLSKDQSAFLEETFKEHNTLNPKQKLALAKKLSMTARQVEVWFQNRRARTKLKQTEVDCEYLKRCVEKLTEENRRLQKEAMELRTLKLSPQFYGQMTPPTTLIMCPSCERVAGPSSNHHQTHRPVAINPWVPRAGQVAHGLDFEALRS

SEQ ID NO: 4994 - protein, 296 aa, Brassica oleracea
MANPSEASALRFIEKHLLDELSPVATDRWMIHESAATESSSDTSPTIFGSPAAPIEFSEFENKPEIIDLSTPRFVDLISSPFEFDSEVSLSDFDLKPSYQTGNQFEPEIKTQSNRKPPLKISVPTKTEWIQFDPQPEVTKPKQAIAEEKKHYRGVRQRPWGKFAAEIRDPNKRGSRIWLGTFDTAIEAARAYDQAAFRLRGSKAILNFPLEVGKWKTRYNADGEKKRKRDDELEDVTVVEKVLKTEQNVNGKETFPLVKSDLTELYDWDLTGFLNFPLLSPLSPRPSFNYSELTVV

SEQ ID NO: 4995 - protein, 298 aa, Brassica napus
MASLSTLYSSSPSLKQSTVKAFTSPTTRGDSFSFPHTSKPTTHLPLTLSASRADTSHSDAAAAAKKELIKDPDALWKRYLDWLYQQKDIGLYLDVSRVGFTDEFVVEMEERFKSAFKAMEELEKGSIANPDEGRMVGHYWLRNSGLAPRPALKTLIENTLDSICSFADDIVSGKIKPPSSPAGRFTQILSVGIGGSALGPQFVAEALAPDNPPLKIRFIDNTDPAGIDHQIAQLGPELASTLVIVISKSGGTPETRNGLLEVQKAFRDAGLNFAKQGVAITQENSLLDNTARIEGGLA

SEQ ID NO: 4996 - protein, 269 aa, Picea mariana
SGVPPFWAETQQGIFDAVLRGYIDFDSEPWPSISESAKDLIRKMLTSNPAERLTAHGVLCHPWICKDGVAPDQALDPAVLSRLKQFSAMNKLKKMALMVIAESLSEEEIAGLREMFEAMDTDNSGSITFDELTAGLKRYGSNMKESEIRALMDAADVDNSGTIDYAEFIAATFHLNKLEREEHLFAAFSYFDKDASGYITVDELQQACLEHNLTDVRIDEIIREVDQNNDGRIDYNEFVAMMRKGNGAIGRRTMRNSLNFSRKDNLPIG

SEQ ID NO: 4997 - protein, 217 aa, Oryza sativa
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASAPLPSQGKTISIDSAAGNTKRACCSA

SEQ ID NO: 4998 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGQPCVTYIGTDGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIISYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 4999 - protein, 768 aa, Yarrowia lipolytica
MSGNNSPINAQLFPDARDVTKDALQTFVELPECTYMKGLGSSQQAEVMACDCKPGPTACDEDSGCINRLTSIECVRCCKGCQNKRFQGKKYASVDVISTEKKGFGLRATKDIAAGEFVYEYVGEVIDEPTFKERTAIYTTQGVKHFYFMMLQKGEFIDATAKGGLGRFCNHSCAPNGHVEKWVVGKRLRMGIFASRHIQRGEEVTFDYNVDRYGAEAQACYCGEKNCVGFLGGKTQTESASKVSGTLTAALGLTSRDINAILRGKKSAEDLRPRDLTVQDVSKVMASLMMNQEAWQVNLMLQRIALCTDTSVQAAVMKMHGYQIFAQILTATWGDNPLGLDDSDRVNVTLMLLRVLQKWPRITKNKISSSQIENVVKSLTSNDNSDIATIAQELLSEWANLKMAFRIPRRKIDPDGDEHSVSRGTSEEVTKESSKSEEPNDVEVVKVNKKADNNGNGVTDSPSTRSESPFTFIPTPYSNKTAPKGPKKAVKQPASPMVPPRSLPKGWQFANDPQGKVYYYNLELNIQQWDFPKASRASSPSTPKGPKGPKGPRGNRRDERRDNSETREPLSLQSQRESDLQRIIEQARLQEVKNNSEPAPSASAKPVNAQAHRLTKLLAKVVPNQVSKYDVDRERAKKCSKDIVQILVDKELKRPEPMTEISDEKAKKIKEFVKGYMGKVVKRLEEKEGGAKDFGRGRQGNRRDSERQSDRRGRQGQSDRDHSDNHGRKRKGEENQPYEAGPMYDDESAETSTETVKKPKVDMEIDLE

SEQ ID NO: 5000 - protein, 116 aa, Paracoccidioides brasiliensis
MVVHNLQNRASFVSAISTTSTADTSTDKKTSLVVIDCYATWCGPCKVIAPKLVEFSETYPNVTFYKVDVDECPDIAQELGVRAMPTFIFFKDGQKVDEVMGAVPQAVEAAIKKHAS

SEQ ID NO: 5001 - protein, 239 aa, Xanthobacter autotrophicus
MPAGGTSPGPPAASVSLARPSTCASPRWSAEPDLAMARAPRQGIGGCASLRTDENSSRQDPMSQALFDIPLKRIDGTAATLGDFRGKVLLVVNVASKCGLTPQYAALEKLYEARHGDGLEILGFPANDFGAQEPGTESEIASFCSLTYGVTFPMFEKISVVGATRHPLYDALVAARPETTDEEGRRPSGRSASPSDVSWNFEKFVVGRDGRVIARFSPRVTPDDPRLTKALDAALEAKA

SEQ ID NO: 5002 - protein, 168 aa, Triticum monococcum
MAAASSATSVHDFTVKDSSGKDVDLSVYKGKVLLIVNVASQCGLTNSNYTELSQLYPKYKDQGFEILAFPCNQFGGQEPGTNDEIVQFACTRFKAEYPIFDKVDVNGNNVSPLYKFLKSSKGGLFGDSIKWNFSKFLVDKEGHVVDRYAPTTSPLSIEKDIKKLLGSS

SEQ ID NO: 5003 - protein, 452 aa, Unknown
  Bradyrhizobium sp. BTAi1
MMSKEQNDLITRIGPSAPAGKLMRMYWQPAALVDELTGDRPVRAVKLLGQDFVLFKDEQGRYGLLDRDCPHRGADLAFGRLEHGGLRCAFHGWLFDVEGQCLETPAEPAGSALCKNVKQRAYPVVEKGGILWAWLGNGAAPAFPDLDCFTAPEAYTFAFKGLIECNWLQALEVGIDPAHASFLHRFFEDEDTSTAYGKQFRGASADSELPMTKVLREYDRPILNVERTEYGLRIIALREIDAERTHVRVTNQLFPHAFVIPMSTEMTITQWHVPVDDETCYWYAIFTSYGAPVDKAKMRAQRLELYELPEYRSRKNKSNDYGFDPREQATATYTGMGNDINVHDQWAVESMGRIQDRTREHLGQSDKAIIQYRRLLREQIEAVATGDKPMLFLDAAEARSVQGPATMDGIGPTRGWETYWMEVDVRRRRNAPWAAPVPADIIRLAPHLSAAE

SEQ ID NO: 5004 - protein, 374 aa, Capsicum annuum
MASIINNPFTSLCCNTNKCEPNRICSLRSQQSLVFDNVNRKVGFPSVVCKAVSVQTKSPTEIEGLNIAEDVTQLIGNTPMVYLNTIVKGCVANIAAKLEIMEPCCSVKDRIGFSMISDAEEKGLISPGKTVLVEPTSGNTGIGLAFIAASRGYKLILTMPASMSLERRVILKAFGAELVLTDPAKGMKGAVSKAEEILNNTPDAYILQQFDNPANPKIHYETTGPEIWEDTKGKIDILVAGIGTGGTISGTGRYLKEKNPNIKIIGVEPTESNVLSGGKPGFIPGNLDQDVMDEVIEISSDEAVETAKQLALQEGLLVGISSGAAALAAIQVAKRPENAGKLIAVVFPSFGERYLSSILFQSIREECEKMKPEL

SEQ ID NO: 5005 - protein, 1427 aa, Unknown
  Frankia sp. EAN1pec
MPEDQIIEDQATRSEVTPSETVPSDNTLADTAAPATAAPEPVTPATAVAESAAPESVTAETAPQRPTRRRRAAGRPAGPPPEEAGPPAAAADGETAVDAADSATGAGAGAVSSTLPVSDGAAPDAAVPLVEAGAEPAPEAAPAKPARRARTTRPRRASREVSEAVPDTTATPAPSDTTSPAAGSSDTTSLDTRAPETTSSATAAPEAGADNVPGSPGQVAKGDVTASDALADTTASGEAAPAVTKPRRTRARRAATKVEPAAETGTPTGAPGSESAASASSSVGEPAVGQTPAASAPAPAAAPDSVADAATPPAVAATSQVVAATSPAPEPAIDETVDPLAEPVDELPADATADADAGTSAAGTGAAATDAPGAQPAVASSPEPVIAATVADTAAVTGAGTTGTTEATPAAGPEAVAGTETAPGPEAVGAPEPPRAERTSRRRTRAVAPTWTSGAEAPAPAPVTRQSARRPVAMITFQQPEPAVVDPWPRRRRDADDAPAEPAVTGRGGLTGAGLDDVAPADEIVDAADDAVAYDTAEFGEALETESSEQAFDGGEYSSTDADGDDAGPGGTRRRRRGRRGRGRARGEDEISETSDLAEEQVDEAEERDDRELEAEPVEREPRSSRRRSRRSPTRETFDEAEEIDSEAELVAGADSGADTDTDTESDADDGADLEDGADDSAEDGSDDDRAGGSRRRRRRRRRSGTGAETTPVPDDPPNTVVHVRETRRDDDLVRGVSGSTRLEAKRQRRREGRDSGRRRAPIVTEAEFLARRESVERRMIVRHNGDRTQIAVLEDGVLVEHFVTRASSASYAGNVYLGRVQNVLASMEAAFVDIGKGRNAVLYAGEVNYDASGLDGRPRKIEQVLKSGQSVLVQVSKDPIGHKGARLTSQVSLPGRYLVYVPDGQNAGISRKLPDTERARLKSILKKITPENGGVIVRTAAEGASEAELERDIERLVAQWEDIQRKAQKASAPSLLYGEPDLVVRVIRDIFNEDFTELVVQGSHEAATVEGYVDTVAPDLRDRVRRYVGTGDVFAEHRVDEQLAKALDRKVWLPSGGSLVIDRTEAMTVIDVNTGKFTGKGGNLEETVTKNNLEAAEEIVRQLRLRDIGGIIVIDFIDMVLESNRELVLRRLTECLGRDRTRHQVAEVTSLGLVQMTRKRVGQGLLEAYSEPCAHCNGRGVLVHLDSAHSRDAQSRDGAQPREAASSASQPAAEAPAQAAGTSTGRRARHATKPAGPALVAAAVSSAVDGAHVSSDDASGSVNGSASAESTDSSGSVGSAGVSGPAEAVALGEHPAAQAGASLLDAVAPRAARIAVTVGAGSDQGTESNGVDSNGVSGGPGANGTGSGGAEGTTVDGESRPGSGGIPVFANTDDPDSVLHSGTNGAGTPAGAEKPARARRRRASRPVSKPTDTAQPIPVPSEATST

SEQ ID NO: 5006 - protein, 616 aa, Rhodospirillum rubrum
MCGLVAILERRGPADEAAVSKALARLARRGPDGEGRAAFWDGRLLLGHRRLAIFGKGADGAQPMVDPETGSVLVFNGALYNYVELRQALQALGQRFAGESDTEVALLAWRQWGEAAFARFNGMWAMVLLDAPGDRLVVSRDRLGVKPLYLCDTGGRVTFASTIAATLAASGIAPRVDDDAVFDFLVGGLTDHRGGSFFAGIVEVPAGALWSVDRSGGIDRRRFHDWRKEGSGEAAPPSAEALRATLSDAVRLRLRADVPAVALLSGGLDSSIVTRLATAPDMPRGALAGLLTYGYRDATEADETREAGRFAATLDSALPHDILRVAPLPAAPDLDALLAAQEQPFNTPSLVAAFRLYRLIAARGVKVAITGEGADELFAGYTNRYGALLAREHLRLGRLRPLGALLGSAHCPPRLVANRLAWDLPLAIVRPLMAGRVHGRVIARSFWQDSAERFEALAAYHHQPLASRLRDDALRALLPYSLRFADRSGMASGVEVRSPFLDYRVVEAALALPVAAKIDDRGGKRILRQAFRHDLPAEIIGAGKTHGLGMAEQFQVGHLDWAALAEAPPTLAARYLDLGRLKTALAAHPSDPRLWWPLCLLRWLAWVEGGMADAPR

SEQ ID NO: 5007 - protein, 136 aa, Medicago truncatula
MARTKQTARKSTGGKAPRKPLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 5008 - protein, 269 aa, Magnaporthe grisea
MKLVVALTNNWADYGGMDVYTVNLGGKYHDDFYTVPKIKDAFKRYIRAMVTRYADSPAIMAWEIANEPRCGADSVRNLPRGPSCTPDTITAWIDEMSTFIKSIDSKHLVTWGGEGGFNIPSNSDGFYNGYDGGDFDKELSLPNVDFGVFHSYPDWWSKTIDWVDQWIRDHAASGRKAGKPVVHEEYGWLTNEARQANLGRTAPESRIEVLSRWQKIQVEEKMPDMFWQFGWSGFSYGKNHDDGFTIYLEDAEAQPLVRDHAAAMNALNN

SEQ ID NO: 5009 - protein, 359 aa, Unknown
  Mycobacterium sp. MCS
MVNPAEVDAVVLVGGQGTRLRPLTLSAPKPMLPTAGLAFLTHLLSRIAAAGIEHVILGTSYKAEVFEAEFGDGSKLGLQIEYVYESEPMGTGGAIANVAEKLRHDTAMVFNGDVLSGCDLRALLDSHVSKDADVTLHLVRVGDPRAFGCVPTDADGVVTAFLEKTQDPPTDQINAGCYVFKRSVIDRIPRDRAVSVEREVFPGLLSDGLRVCGYVDATYWRDMGTPEDFVRGSADLVRGIAPSPALEGHRGENLVHDGAAVGPGALLIGGTVVGRGAEVGAGARLDGAVIFDGVRVGAGAVIERSIIGFGARIGPRALIRDAVIGDGADIGARCELLRGARVWPGVKIPDGGIRYSTDV

SEQ ID NO: 5010 - protein, 584 aa, Arabidopsis thaliana
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 5011 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 5012 - protein, 367 aa, Geobacillus stearothermophilus
MELFKYMETYDYEQVLFCQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDQTIPQLKAKVIAGSANNQLKEPRHGDIIHEMGIVYAPDYVINAGGVINVADELYGYNRERAMKKIEQIYDNIEKVFAIAKRDNIPTYVAADRMAEERIETMRKARSQFLQNGHHILSRRRAR

SEQ ID NO: 5013 - protein, 201 aa, Prochlorococcus marinus
MSSSRQAEIKRKTNETDISIFINIDGNGISEIDTGIPFLDHMLHQISSHGLFDLKIRAIGDTHIDDHHTNEDVGIALGKAFTKALGERKGINRFGHFFAPLDEALVQVTLDCSGRPHLSYGLKLKAPRIGNYDTELVREFFIAFVNSSGITLHINQIEGRNSHHIVEACFKAFSRSMRMATEIDLRRSGTIPSSKGMLEID

SEQ ID NO: 5014 - protein, 764 aa, Oryza sativa
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTRSGSGASRPGINGLIQKPVTLAALGDELYRVLQNN

SEQ ID NO: 5015 - protein, 278 aa, Arabidopsis thaliana
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSFLRFNHYPPCPNPELALGVGRHKDGGALTVLAQDSVGGLQVSRRSDGQWIPVKPISDALIINMGNCIQVNVDFRLKTN

SEQ ID NO: 5016 - protein, 179 aa, Triticum aestivum
TYEETVVGPDGVEVTNTVPAVTPEVKDALVKNIRRRMTPQPLKIRADVEMKCFQFDGVLHIKEAMRKAEAAGNADCPVKIKLVAPPLYVLTTQTLDKDQGIAVLTNATKVCAEAIEKHKGKLVVKEAARAVSERDDKLFADTIEKLKLAGEEVDGDDDSEEEDNGMGDVDFTKAGAGTD

SEQ ID NO: 5017 - protein, 375 aa, Chromobacterium violaceum
MSKRDYYDVLGVNRDASDDDIKKAYRKLAMKYHPDRNPDSKEAEDKFKEVKEAYEILSDSQKRGAYDQFGHAGVDPQAGMGGGGQGFGGFGDFADIFSDIFGGGRGGSGGGRSNVYRGADLRYNMEITLEEAARGCEKQIRIPSHESCSTCNGTGAKPGTQPKTCATCGGHGQVRMSQGFFSIQQTCPTCHGTGKQITDPCGSCHGAGQKKTTKTLNVKIPAGVDEGDRIRLGGEGEPGQNGGPAGDLYVVTHIKQHAVFQRDGMDLHCEMPISFSTAALGGEVEIPTLDGMAKVKISPETQSGRVYRLRGKGVKAVRGAEYGDLHCHVVVETPVKLTERQKELLREFEAISQGDVATHNPRSKSFMDKLRDFFE

SEQ ID NO: 5018 - protein, 441 aa, Chlamydia muridarum
MTGKRTKEEQINRQRSHFYRDNVGVIVLCGGEGKRLSPLTCWRCKPTVSFGGRYKLIDVPISHAIASGFSKIFVIGQYLTYTLQQHLFKTYFYHGVMQDQIHLLVPERRDGSQVWYQGTADAIRQNLLYLSDSPVEYFLILSGDQLYNMDFRSIVDYAIDVQADMVIAAQPVSDKDVSRFGVLRVDDEWKLVDFYEKPQSEEILKHFRLSNAAMKKFGLDPQQGNFLGSMGIYLFRKECLFQLLLDETGDDFGKELIHRQMHRGKTVAYLYNGYWTDIGTIASYYEANMALTQRPSQNVRGFNCYDDGGMIYSKNNHLPGAIISDSKISSSLLCEGAMIESGQVSNSVIGVRGVIGQGSIFDHSIMMGSDSYVSGSVPFGVGKNCEIHKTIIDENCCIGNGVRLQNLQGHKDYDSPDGKLVVRDGIIIVPKGTKIPDNYVF

SEQ ID NO: 5019 - protein, 569 aa, Glycine max
MCGILAVLGCVDNSQTKRARIIELSRRLRHRGPDWSGIHCYEDCYLAHQRLAIVDPTSGDQPLYNEDKTVIVTVNGEIYNHKQLRQKLSSHQFRTGSDCEVIAHLYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVPFGVLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGGYLYFHKAPNKKEFHEETCRKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 5020 - protein, 803 aa, Sorghum bicolor
MPTAAAMIGGLASYAASLGQNMMDGHHQLAMMQQQQHQNHGQQQQHPPQAATSESDARGPRHDELMMESKSGSDNMEGGAGSGSGGEELQEDLSLQPARKKRYHRHTQHQIQELEAFFKEYPHPDDKQRKELSRELGLEPLQVKFWFQNKRTQMKTQQERHENMQLRAENEKLRAENARYKDALANASCPNCGGPATAVIGEMSFDEHHLRIENARLRDEVDRISTIAAKYVGKPAGSLLPNLSNISSASMAPYPPPPPLSSHHLLPGGTDMFGGLHLHGAAAGFDKGLVVELAVAAMEELVRMAQLGEPLWIPALVVDGATIETLNEEEYARGFPSGVGPKLPELRSEASRETVVVIMNHVNLIEMLMDVNQWSTLFSSIVSRAATLEVLSTGVAGNYNGALQLMTAEFQMPSPLVPTRESQFLRYCKQHTDGSWAVVDVSVEGLRASGQAGARGRRRPSGCLIQEMPNGYSRVTWVEHVEADDMMVHDLYRPLVCSGLAFGARRWAAALERQCERLASAMASGVPAGPSSGGDAVGVVTSVEGRRSMLRLAERMVTSFCGGVTASTTHQWTKLSGSGAEDVRVMTRKSVDDPGRPPGIILNAATSFWLPVPPARVFGFLRDDATRSEWDILSNGGDVQEMAHIANGRDHGNAVSLLRVNNANSNQSNMLILQECCTDATGSYVIYAPVDVVAMNVVLNGGDPDYVALLPSGFAILPDGSGAGGAPPGFAVLPDGPGAGGGGGGGGGSLLTVAFQILVDSVPTAKLSLGSVATVNSLIACTVERIKAAVAADNIGGGGAVPQ

SEQ ID NO: 5021 - protein, 417 aa, Xylella fastidiosa
MFPRDARLDMYDPELAKAIAAEVRRQEDHVELIASENYCSTLVMQVQGSQLTNKYAEGYSGKRYYGGCEYVDIAEQLAIERAKKLFGADYANVQPHSGSQANQAVYFALLQPGDTILGMSLAHGGHLTHGANVNVSGKLFNAVQYGVNAQGLIDYEAVESLALEHRPKMVVAGFSAYSQKIDWARFRAIADQVGAYLLVDMAHVAGLVAAGVYPSPLPHAHVVTSTTHKTLRGPRGGIIVAQAPQEALVKKLQSIVFPGIQGGPLMHVIAAKAVAFKEALEPAFKVYQQQVVKNAKAMAGTLMLRGYKIVSGGTENHLMLVDMIGRDVSGKDAEGALGQVHITVNKNAVPDDPRSPFVTSGLRLGTPAVTTRGYQEQDCVDLAHWIADVLDAPADVTVIAAVREKVAAQCKKYPVYR

SEQ ID NO: 5022 - protein, 237 aa, Picea mariana
MEACGEEAQVKLLGGNISPFVLRVRIALALKGIDYEFIEENMQNKSHLLLQSNPVNKKIPVLIHNGKPVCESMIIVQYIDEAWDTKAPVLMPKDPYDRAIARFWAAFVDDKLLPCLRGVFKGQGEQQQKALEESGASFLLLEEALRTSHCFSGKPYFGGDEIGFLDIALGGMLAFVKALEKVTNLVLIDQEKMPLLSTWMNRFCEADGVKDVMPDPAKLQEFISAIRVRFTSPPAAN

SEQ ID NO: 5023 - protein, 210 aa, Glycine max
CSKSVTMAPSSTLQFPILLGLLLISFLGVEGVLPPSCNRYECPNYNVKYVGKNFEIRRYNSPVWISNLAVQDPSLVGATRSGFKRLFSYIYGNNNYKKEMNMTTPVISEVSINGGNSSIVVSFYVPKVNQADPPLANGLYVQRWKTIDVAVRQFGGFVKDSNIGLQVSALNDSLTGTTWSAIVKNKYIVAQYNSPFELYNRVNEIWFFYE

SEQ ID NO: 5024 - protein, 108 aa, Unknown
  marine gamma proteobacterium HTCC2143
MSDNIVHVTDASFESDVLGADVPVLVDFWAEWCGPCKMIAPVIAEIANEYEGKLKVCKVDVDANTETAPKFGIRGIPTLMIFKNGNAEATKVGALSKTQLTEFITSAL

SEQ ID NO: 5025 - protein, 248 aa, Thiobacillus denitrificans
MSVTMRQMLEAGVHFGHQTRFWNPRMAPFIFGHRNKIHIVNLEKSLPMFQEAQKFVRQLSANKGNVLFVGTKRAARDIVREEAQRAGMPYVDQRWLGGMLTNFKTVKQSIKRLNDLEAQIAEPGRLSKKEILTVQREVDKLNRSLGGIREMGGLPDALFIIDVGYQKGAVVEAKKLGIPVIGVVDTNNSPEGVDYVIPGNDDSARAIRLYARGMADAALEGRAQVISEIVGGEEFVEVEEEEGGVAAE

SEQ ID NO: 5026 - protein, 893 aa, Moorella thermoacetica
  misc_feature (358)..(358): Xaa can be any naturally occurring amino acid
MVNLTIDGQRVTAPEGMTILEVARENGIHIPTLCHHPKLRPLGYCRLCLVDIEGAAKPMTACNTPVAEGMVIRTSTPVIEEMRKGIIEMLLSLHPEDCLTCEKAGNCQLQDCAYTYGVKHGELPVKREELPVLKENPFIVRDYNKCIVCGRCVRACQEVQVQRVVDLVGKGSAARVGATKAGAEVSLEEGGCVFCGNCVQVCPVGALTEKAGLGQGREWEFKKVRSICSYCGVGCNLTLYVKDGKVVKVRGYENPEVNNGWLCVKGRFGFDYIHNPDRITRPLIREGDREKGYFREASWEEALALVSQKLTQIKGSYGSEALGFLCSAKCTNEENYLLQKLARGVLGTNNVDHCARLXHSSTVAGLATTFGSGAMTNSIADIASADCIFVIGSNTTENHPVIALKVKEAVRRGARLIVADPRRIELVNFSYLWLRQKPGTDLALLNGLLHVIIKEELYDKEFIAQRTEGFEALKLAVEEYTPAKVSEVTGVPAGDIIEAARTYARGPSSTILYAMGITQHITGTANVMALANLAMACGQVGKEGNGVNPLRGQSNVQGACDMGGLPNVLPGYQPVTDPGVRHKFSETWGVPDLPGEPGLTLMEMMAAAQEGKLKGMYILGENPVLTDPDVSHVKEALKNLEFLVVQDIFLTETARMADVVLPGASFAEKEGTFTSTERRVQLLHKAIEPPGEARPDWLILNDLLLLMGYPRKYSSPGEIMQEIAGLTPSYAGITYERLEDKGLQWPVLSLEHPGTPVLHREKFSRGYGQFQVVHYRPPAEEPDEEYPFLFTTGRNLYHYHTVISRKSRGLEEMCPAPVVEINDNDAARLGIREGEMIEIVSRRGKVRVKALVTDRIPRGQVFMNFHFHEAAANLLTIAALDPVAKIPIIKPVL

SEQ ID NO: 5027 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHGLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMFRVEVLEKVPIMQHFLFGWLIKWEE

SEQ ID NO: 5028 - protein, 307 aa, Brassica oleracea
MANPSEVSSALWFIEKHLLDVVSPVAKDRWMIHESAAKDSSFDSSPMIFGSSSSSSAPIDCSESEIKPEVIDLSTPRFMDLISTPSEFNTGVSVSVSDFDFKPTFQTVNQFEPEFKTQIPCASDDSHSNRKPPLKISVPTKTEWIQFNPQPEVTKPVQPDAEEQRHYRGVRQRPWGKFASEIRDPNKRGSRIWLGTFDTAIEAARAYDEAAFRLRGSKAILNFPLEVGKWKSRKEADGEKKRKRDEIEDDHVAVVEKVLKTEQSVNGKEAFNLTEFCDWDVMGLLNFPLLSPLSPHPSFGYSQLTVV

SEQ ID NO: 5029 - protein, 218 aa, Brassica oleracea
MWMMISQEGQRSNPIIYHNNIHLLCEVDQKREKASVIVLKIQTKHPNPESFKTSLEPSPPLSPHSLCIRWKPYSNSSEFQANASVLLILFVSALICGLSLCAAIRCFLRPNLQTDDNEHKPDPEEDVSSTVPTPTLVYSSDLELAGAQAECAICLSEFEPGESIHVLEKCHHGFHIKCIHKWLSSRSSCPTCRTSIFSQNTLDSATSAVAPSTNEINA

SEQ ID NO: 5030 - protein, 495 aa, Debaryomyces hansenii
MSAPTGDIGLIGLAVMGQNLILNAADNGYTVVAYNRTVAKVDDFLDNEAKGKSVIGAHSIEELCANLKRPRRIILLVKAGKPVDAFIEQLLPHLEKGDIIIDGGNSHFPDSNRRYEELNGKGILFVGSGVSGGEEGARYGPSLMPGGHKDAWPHIKDIFQSIAAKSDGEPCCDWVGDAGAGHYVKMVHNGIEYGDMQLICEAYDLLKRVGKFSNKEIGDVFAKWNKGVLDSFLIEITRDILYFNDPTDNKPLLEKILDTAGQKGTGKWTAINALDLGMPVTLIGEAVFSRCLSALKDERVRASKSLAGPSVEDDESPIQDKQKFVDDLEQALYASKIISYAQGFMLIREAAKEYGWKLNNPAIALMWRGGCIIRSVFLGEITSAYRETPDLENLLFHPFFNDAIKKAQKGWRSTIGKAVEFGVPVPAFSTALSFYDGYRSAKLPANLLQAQRDYFGAHTFQVLPGEENDFLKKDQWIHVNWTGKGGNVSASTYDA

SEQ ID NO: 5031 - protein, 352 aa, Oryza sativa
MGGLSMDQAFVQAPEHRPKASVAEADGIPVIDLSPLLAAGDGDADGVDALAAEVGRASRDWGFFVVVRHGVPAEAVARAAEAQRAFFALPQERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 5032 - protein, 143 aa, Triticum aestivum
  misc_feature (3)..(4): Xaa can be any naturally occurring amino acid
  misc_feature (12)..(12): Xaa can be any naturally occurring amino acid
  misc_feature (18)..(18): Xaa can be any naturally occurring amino acid
  misc_feature (24)..(24): Xaa can be any naturally occurring amino acid
  misc_feature (33)..(35): Xaa can be any naturally occurring amino acid
  misc_feature (39)..(39): Xaa can be any naturally occurring amino acid
  misc_feature (41)..(41): Xaa can be any naturally occurring amino acid
  misc_feature (50)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (62)..(62): Xaa can be any naturally occurring amino acid
  misc_feature (69)..(70): Xaa can be any naturally occurring amino acid
  misc_feature (77)..(79): Xaa can be any naturally occurring amino acid
  misc_feature (84)..(84): Xaa can be any naturally occurring amino acid
  misc_feature (89)..(89): Xaa can be any naturally occurring amino acid
  misc_feature (95)..(95): Xaa can be any naturally occurring amino acid
  misc_feature (102)..(102): Xaa can be any naturally occurring amino acid
  misc_feature (104)..(104): Xaa can be any naturally occurring amino acid
  misc_feature (109)..(109): Xaa can be any naturally occurring amino acid
  misc_feature (118)..(118): Xaa can be any naturally occurring amino acid
  misc_feature (124)..(124): Xaa can be any naturally occurring amino acid
  misc_feature (129)..(129): Xaa can be any naturally occurring amino acid
  misc_feature (132)..(132): Xaa can be any naturally occurring amino acid
  misc_feature (134)..(134): Xaa can be any naturally occurring amino acid
CIXXLDKKKASXFFKTQXDSHVSXAKEKTKLSXXXDIIXEXEGCYFDFEXXXYXMNAXNGSXVSTIHVXXEDGFSYXXXEGMGXDASPXAYGDNXKRVLRCXGXTEFSXAVTISCGAXTATWGXKLDAXAYXFXNVVEQELPS

SEQ ID NO: 5033 - protein, 522 aa, Debaryomyces hansenii
MSTNSTSEIVDNLSGSFGDTSFFIKTANDLYMNMSWLQLIITTIVLGLSYDQIMYQIRKGSIVGPRLKVWPIIGPFLESLDPKFEEYKAKWDSGPLSCVSIFHKFVVIASSRDLARKILGSPKYVKPCVVDVAIKILRPTNWVFLDGKAHSDYRKSLNGLFSQKALELYIPVQEKYMDLYLEKFVTLDGPTEFFPQFRELLCALSLRTFCGDYITEEQISLITDNYFRITAALELVNFPIIIPYTKTWYGKKIADETMKIFESCAGMSKKHINEDNGKPGCVMDEWIYLMKDAREKHSDDPESKLLIREFSNREISEVIFTFLFASQDASSSLACWLFQVVADRPDIVAKIREEQLRVRDQDPSKPLNLELINEMTYTNNVVKESLRYRPPVLMVPYVVKQSFPVTDTYTAPKGSMIIPTLYPALHDPEVYEDPDSFIPERWENATGDMNKRNWLVFGTGPHICLGKTYVLMLFTSMLGKFVMNSDIIHYPTPLSEEIKVFATIFPKDDLILEWKRRNPLQV

SEQ ID NO: 5034 - protein, 639 aa, Candida glabrata
MELSNELIRDVRWNLRKAALEMSMMKLNGSSKWAAEALNGICEEVTVDQLGLESPMDKLGKHIEIKEPGNSKISGDIPNKNFLSFHDNKSNFYFNEKEYDKYLYVSTMFDNKEFDRCAFYLEDATNPSLKFLKLYSMYLSWDKKTQESLENVLTIEKNSVKYDNAGNRNLNIDAADDFSSFGGLKKKSIDDPHNKNDQSGVTEILNELDQYLEDVQSHKVPKNSLGYALLFYLRGILLKESNSKSMAIRAYLRSLRIYSFNYSCWSDLLECITTVEESQMLLSHFMSNFQFENLENINSQSKLESNIPFKIFQLLLFKEFQGNVDEYLTTFEDLLTLFPNFTFLQAQKALTSYQYMDYVNSEQIFEKIMEDDPYRLDDMDTFSNILYVMQKNAKLAYLAQFVSQIDRFRPETCCVIANYYSARQEHEKSIMYFRRALTLDKKTTSAWTLMGHEFVELKNSNAAIESYRRAVDIDPRDFRAWYGLGQAYEVLDMHLYSLYYFQRACILKPLDKRMWQALGSCYAKVGNHAEAIKCYERALQLTTQSEQDTALLYKLALLFEQTNGIDKCKLLMEKCVEIERITEGLVTDESVKARLWLAKFELKTNNYVKAYDLAVGVSNGTSQEMEEARSIARECRRKM

SEQ ID NO: 5035 - protein, 885 aa, Yarrowia lipolytica
MTQLQKLQTASIDTWLAVGSLAELLNESERAINAYEAALSYNPCSIPALTAIANLYRSMEHFPKAVEYYQNIISLSSDSGETHGSLGHCYLMMDDLHKAYSAYQQALYHLRDPKDPKLWYGIGILYDRYGSLEYAEEAFSQVMEMDPHFEKANEIYFRLGIIYKQQAKYSQSLDCFRYILHNPPRPLTEIDIWFQIGHVHEQQKDFQLAREAYDRVLVENPNHAKVLQQLGWLHHQQSSTFANQDVAINYLLKSLDADPLEAQSWYLLGRCYMAQQKYNKAYEAYQRAVYRDGRNPTFWCSIGVLYYQINQYRDALDAYSRAIRLNPYISEVWYDLGTLYESCNNQVNDAIDAYQKAAELDPHNPHIQERLLQLRSGQGHNGAAPAGPPRPQDVNPQSYSHHGPPGWDDAAGGAAGANAAAGGAAGGAAGTPQAPPGLGPPGLAPGGPPGGLSNASGLGSGAPPPLAASSAPLPPPNGLPAAQTAPNTAQTAAPTPPQPAAALPQLAGISEIQQRVLPQIDYAENGHGHQGGEKRPGEWEDERRFKRVDVNGAATPASGNNTPNLAPGGQANAVERDIGSSGAGSGVPGAPGAPGAPPAAPPAVANAANAAGTTPLPPPPPTVPPPAPQHVPTTQELPPVQDTPTPAAVEPKKEEPDVPVAVPISAPVSAPVAAPTAAAAAAVPPAAPPSALAQAQEPEKPDVQSDVKSDANEVSDVKPVQPVTAPVSAASTPSIAPAPGPAVASSGNSAGSTGSNANNANVANSGATANNGAPGSGSAPGSGAPAAPAASAAPAPAPAPTPAPAPSSPPPEAPLRKVVEEEDYDDDDDEPKKEDAKVETATESAAPAAAAAAAPAPSAAAAPAPAESKDDDKKNEAKEEKSEDK

SEQ ID NO: 5036 - protein, 308 aa, Unknown
  Frankia sp. EAN1pec
MQNTIDLTGRLAVVTGASSGLGLGLATRLAAAGAKVLLPVRDEAKGEAALSHIRAEAPGADVSLRELDLASLKSVEALGDTLNAEGRPIHILINNAGLMTPATRHTTADGLELQFGTNHIGHFALTGWLLPLLNAGHARVTTMTSSAARHAKLNWEDLQSDQAYAPIRAYNQSKLANLLFALELDRRSRAGGWGIVSNAAHPGTTLTGLYAAGPNLGREKSSPIEAAMKRLARWGVLVQGVDRGLLPALYAATSPDAEGGHFYGPDGFGQFTGGPAELEIYRPARDEDAATRLWDVSQRLAGVEFAAV

SEQ ID NO: 5037 - protein, 443 aa, Thermus thermophilus
MGKRMVVVGGVAGGASAAAKAKRENPELEVVVYEKSGWVSYGACGLPYVLSGEIPRLERLVARTPEEFRKQGVLVRTRHEVVDVDYELRTLTVHDHAEGRTFQDRFDHLVLATGARPSLPPIPGTEQEGVYTLRTMEDGERLLKALPQARRAAILGAGYIGLEAAEAFRKRGLQVTLLEAKDRPLPHWDPEVGALLKEELERHGVEVWTGVKVEAFRGMGRVEAVETSEGVVPADLVLLATGIRPNTELAQAMGVALGPTGAIATDERMRTNLEGVYAAGDVAESFHRVLKRPYWLPLGDVANKHGRTAGSVIAGREARFLGVVGTAIFKAFDLAVATTGLSLEGALKEGFWAKKVFIQSRDGAHYYPGSGPLWVELVYEEGTGRLLGGAVVARGHGALRIDVLAALLHREGSVEDLLALDLAYAPPFSPVWDPLLIAAQQAR

SEQ ID NO: 5038 - protein, 273 aa, Prochlorococcus marinus
MTDFLAAALQLTSTSDPELNFAAAEEQIELAARRGAELVGLPENFAFMGDDERRLELAQDLAEQCSRFLVTMARRYQVVLLGGGFPVPSGDSNHTVNRAELVGRDGQLLARYDKIHLFDVDLPEGNTYQESATTTSGRELPPVVDVPGLCRVGLSICYDVRFPELYRHLVSAGAELLMIPAAFTAFTGKDHWQVLLQARAIENTSYVLAPAQTGRHYSRRQSHGHAMVIDPWGTVLADAGVSQGAAIAPVDNSHIGRIRAQMPSLQHRQSALF

SEQ ID NO: 5039 - protein, 549 aa, Escherichia coli
  misc_feature (12)..(12): Xaa can be any naturally occurring amino acid
MEIFFTILIMTXVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 5040 - protein, 362 aa, Schizosaccharomyces pombe
DPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 5041 - protein, 478 aa, Prochlorococcus marinus
MNNPRILFWHRKDLRIYDNNALSKAFSLSNAITSTYIFDQNYSQDFNANSRAWFLGNSLQELSRNWETLGSRMIIDEGNPLTLIPKLAQLIDAKFVAWNKAIEPYEINRDLEIKNTLKKFKIEIIELWDHLLLEPSQIHTGSNKPYTVYGPFYKKLKSKLQLLTSKKNLNNIGKLKDLEIGIKESQKIDSSRLILEKFIKKVNFDGINLCPCKPGEIAAEKLLDQFINQDKIGSYASSRDFPDQNGTSFLSASLRFGTISIRKVWNSTLFTDLKNKNNHNKISIETWQKELVWREFYQHCLFHFPELEKGPYRKKWDHFPWQNNHEWFDRWSNGETGVPIIDAAMRQLNSTGWMHNRCRMIVASFLVKDLICNWQMGEEKFMKVLVDGDLAANNGGWQWSASSGMDPKPLRIFNPYTQTKKFDPICKYIKFWIPELSKVPNKDILNGEISDLEKNNYYGAIVNHNTQQRLFKDLYAHI

SEQ ID NO: 5042 - protein, 144 aa, Triticum aestivum
  misc_feature (68)..(68): Xaa can be any naturally occurring amino acid
  misc_feature (113)..(113): Xaa can be any naturally occurring amino acid
  misc_feature (123)..(123): Xaa can be any naturally occurring amino acid
  misc_feature (139)..(139): Xaa can be any naturally occurring amino acid
MAGAGRKVAVAAVQFACTDTVADNVAAAERLIREAHKKGANIVLIQELFEGHYFCQAQRMDFFGRAKXPYKENPTIMRMQKLAKELDVVIPVSFFEEAGNAHYNSVAIIDADXAPNLGLYRKXHNIPDGPWFIKEKLYXQTRVL

SEQ ID NO: 5043 - protein, 446 aa, Eubacterium acidaminophilum
MHKYIPNTEADKKSMLESIGVSSIEDLFSDIPAELKLGRELNLGEPMSELELVKHMNELADKNKSDFVCFRGAGAYDHYIPSLINHMLLRQEFFTAYTPYQPEISQGTLQMIFEFQTMLCDLTGMDVANASMYDVGTATVEAAVMAVQNKKKCKNVVVSKAVAPETRLILHTYLKQNDIEVIEVDTADGVTDMDKLTAAVGDETAGVIVQNPNFFGVFEDVEAIAGVAHDKKALLIDVVDPISLGIVKRPGDIGADIVVGDAQCFGSALNFGGPYIGFLTTKSKMARKMPGRIVGQTEDTDGKRGFVLTLQAREQHIRREKATSNICSNQGLCTLTVAIYLSTMGKSGLKEVALQCMNKAQYAYKKLTESGKFKPLYNKPFFKEFALTSDVAAADVNAKLAESNILGGYELECDYPEAKNGLLFCVTEKRTKEEIDCLAQVMEVNC

SEQ ID NO: 5044 - protein, 261 aa, Medicago truncatula
MKMLQLQPPQSYTTTNPFSVPTHSFIINTPKKSIFLRRVGPTFSLTCHHPELFHPKPFPPPQRPQSSSSSFSSSVGELPARVHVSRSVYKGKAVLVVSPVLPKFTSSDSGTFKISKEGLMLLQFVPSAGFRQYDWNRKQVFSLSVDEMGNLINLGARESCEIFHDPFMGRSDEGKVRKVLKVEPLHDGSGHMFKLSVQNQLKNIDENIFIPVTKAEFAVFNSLFSFIMPYLLGWNAFADSIKPEVNIANPRRREEDFEWNR

SEQ ID NO: 5045 - protein, 484 aa, Eubacterium acidaminophilum
MKNYNKLVFEVSKEGKKAYSLPKCDVPELDAASVIPAGYLSSEEPKLPELSEVDVIRHFTNLSQKNFGLDGGFYPLGSCTMKYNPKINEDMCRIPGLVNVHPYQPEETVQGSLEVMYNLAQSLAEISGMDEVTLQPAAGAHGEYAGLLSIKEYHKKRGDLKRTKIIVPDSAHGTNPASAYVAGLEIVEIESNSQGGVDIENLKSVLNDEVAGFMLTNPSTLGLFEVNITEITKLIHEAGGLCYYDGANLNAIMGKTRPGDMGFDVMHFNLHKTFSTPHGGGGPGAGPIGVKAHLAEFLPVPVVAKKDDKFVLDYDRPNSMGKIKNFYGNYGVCLRAYAYVKSMGASGLKEVSEAAVLNANYMMHKLKGEYKLPYDQVCKHEFVLDGLRGSELEVTTLDVAKRLLNYGYHPPTVYFPLIVHQAIMIEPTETEGRETLDEFIDALLKIAEEAKKDPQILKNAPQTTLVKRLDEVKAAKDLILKYQG

SEQ ID NO: 5046 - protein, 488 aa, Cryptococcus neoformans
MTLPEVCKQFEPYFILDDAKLVDIVKHFRKEMEEGLASYGKDMAMIPTFVTGVPDGTEEGVFLALDLGGTNLRVCLILLQGHNQFKIKQQKYKVSEELKTGQARVLFDYIAESVDNFLTEVESHEDIAIPATGEPMHLGFTFSFPVEQTAIDAGKLLTWTKGFNTKNAIGHDVVRLLQDAFDRKHMHVRCSALVNDTVGTLLSRSYQSGPALIGAIFGTGTNGAYIDKTRTISKLGKEKIEDAEEGGEHAGEFMVVNMEWGAFDNKRQCLPISLFDNKLDRESINPRKQAFEKLVSGMYLGEITRNMLLYMIDSSLLFGGHSSEIINTHYGFDTSFVSGIEGISSPEEVKKLIVKELKVDPKHVTDKCPEIVQWAVRLVSDRACKLAACAIAAVVLHTGNDKAPEGEEDKGVDVGVDGSVAEFLPMFSERVMAALKAILGEKSAARVKLGLAKDGSGVGAALTALQAKKALDRRSDRSMKFVPGERGP

SEQ ID NO: 5047 - protein, 404 aa, Mycobacterium leprae
MREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 5048 - protein, 239 aa, Roseovarius nubinhibens
MSGFVSFVGSGPGDPELLTLKAVDRLKRADAVLFDDLSAGPILDHANPDADLIGVGKRAGRLSPRQDHVSRLLVDYASEGGRIVRLKSGDSGLFGRLEEELVALRAAGIDYEIIPGVPSAIAAAAAAGIPLTRRLTARRVQFVTGHDAGGKLPDDLNITALADPSACTVVFMGKRTFPLLAETLTAAGLPGTTPAILAEAVGTPEQQVTRSTVADLAAQLGAEIGDRPALILYGPLAEM

SEQ ID NO: 5049 - protein, 542 aa, Anaplasma phagocytophilum
MQSNRFVSHGFDEVDLDKTDLADVLSELLDGGPREGEIIEGTVICKDSGYITVDAGLKSEGVVSLREFELGEGKQDIEVGSKVKLYLEKTEGKSGSVVLSREKAVRDELWQKLEQAAAENLDIEGVIFGSIKCGFTVDVGGVVAFLPASHVGLRQVKDITPLLGKKQKFRILKMDKKQGNVVVSRKAVLEESLADAKDSFLSTLEEGSIVEGKVKSITKYGVFIEIHESPTVGVVDGLLHITDISWSRVSHPSAVFSCGQTVRAKIIRIDRENRKISLGVKQLEESPWANVEERYPVGSIHKGTVTSIEDYGIFVELETGVEGLIHVSEVSWVRSHLPVNQLFMRGEEIEVKVLSIDATKNRMSLSIKRCKENPWEAFIEKHPVGSIVNTKVKSIGNLGMFVSLTDDDTNSGIEGLIRSTELSWSGSPESALKRYNIGDCLQAKILMVSANRNKIDLGVKQIEHDPFLGLLRRVGIGERIPVTVSKVLEDVGVMVDVFDGSESFNVLVEQKHIPEGKKFFPGDRVEAEVLMIGSYSLVLSLE

SEQ ID NO: 5050 - protein, 237 aa, Glycine max
MAAEGDLKLLGLSVSPFVVRVRMALHMKGLSYEYIEQDLFNKSELLLKSNPVETKVPVLIHDGKTILDSSAIVQYIDEVWAAMGPSILPVDPNERATARFWAAYVDDKLFSAYVGINKATTEVEREEKVSEMLAVLEQLEEAFAKNSNGKAFFAGDSIGYLDLAVGCHLLWLKAQHKMFGVVFLDAGKTPLLEAWAKRFAETDAAKEVVPDTGMVMEYAKKRQAYRAAVAAAAATAK

SEQ ID NO: 5051 - protein, 405 aa, Agrobacterium tumefaciens
MTGRLVIVGAGQAAFALASKLRALKDERPITIIGSEDAYPYQRPPLSKKYLLGEMSFDRLMFRPEEWYAENNVDIRLSTWVEEIDRAAKTVRMQDGSTLSYDKLALATGAAPRLLPASIGGDLEGVLTVRDKRDADRLVEEMKPGRRLLVIGGGYIGLEAAAVARKLGLEVTLIEMADRILQRVAAKETADIMRGIHQAHGVSIREKTGLVRLVGMDGRVAAAELSDGSMLDVDFVIVGIGVTPNDRLARESGLDVGNGIVVDALTRTSDADIHAVGDCNMLPWRGQHVRLESVQNAVDQAEAAAEVLAGTEAAYEAKPWFWSDQYEVKLQIAGFNLGYDETMLRPGAREGSWSVWYFRDGRFVAVDAVNDAKAYVAGKKLLDIGAEPDRAILADAAADLKLLLS

SEQ ID NO: 5052 - protein, 129 aa, Chromobacterium violaceum
MRMLHTMLRVGNLDRSIAFYQEVLGMKLLRRNDFPEGRFTLAFVGYGDEAEHTVLELTHNWDTESYDLGSGYGHIAIEVDDAYAACDMARAKGGKVTREAGPMKHGTTVIAFIEDPDGYKIEFIQKGSR

SEQ ID NO: 5053 - protein, 363 aa, Pseudomonas fluorescens
MNNIQLDQANVKKHPPGAYDATTRVAASWYVAMRSNGLRDKPKELTLFGRPYVAWRAATGQAVVMDRHCSHLGANLADGRIKDGCIQCPFHHWRYDEQGKCVHIPGHSEVVRQLEPVPRAARQPTLVTTERYGYVWVWYGSPQPLHPLPEITAADVDNGDFMHLHFAFETTTAVLRIVENFYDAQHATPVHALPISAFELKLFDDWSRWPEVESLARAGAWFGAGIDFHVNRYFGPLGMLSRALGLNMSQMNLHFDGYPGGCVMTVALDADVKYKLLQCVTPVSDGKNIMHMLISIKKVGGVLRRATDFVLFGLQTRQAAGYDVKIWNGMKPDGGGAYSKYDKLVLKYRAFYRGWVDRVASEQ

SEQ ID NO: 5054 - protein, 216 aa, Oryza sativa
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGVSVFLC

SEQ ID NO: 5055 - protein, 497 aa, Unknown
  Nostoc sp. PCC 7120
MQSYKYQQKKNLEKSYTREDWQGGYKSLRQEFDYWIDDVEGEIPTELQGTLFRNGPGLLDIKGQSIHHPFDGDGMISRISFVNGRAHYRNSFVKTEGYLAEKNAGKILHRGVFGTQKPGGWLANIFDFKLKNIANTNVIYWGEKLLALWEAAEPHRLDPKTLDTLGKEYFHGVLSAGEAFGAHPRFDPSCEQDNGAPCLVNFSIKPGLSTTITIFELNVAGEVVRKHAHHVPGFCFIHDFVITPNHCIFFQNPVSFNPIPFALGLRGAGECIQVQPNQPTRIIVIPRFPQSGQKEIKTLEVGSGFIFHHVNAFVVGEEILVDSLCYDSLPEVEPESDFRQVDFEAIAPGQLWRFYLNLKDGTVQKKLIESRCCEFPAIHPRNVGRSYRYLYMSAAHAATGNAPLQALLKIDLESGEKQIWSVAPRGFTGEPIFVPRPGSEKEDDGWVLALVYDAAHHRSDVVILDASDFTKGAIARLHLQHHVPYGLHGNFTPQVFV

SEQ ID NO: 5056 - protein, 621 aa, Mycobacterium tuberculosis
MVVRDRVRTEPPLPGTRYTQIAVLEDGIVVEHFVTSAASASLVGNIYLGIVQNVLPSMEAAFVDIGRGRNGVLYAGEVNWDAAGLGGADRKIEQALKPGDYVVVQVSKDPVGHKGARLTTQVSLAGRFLVYVPGASSTGISRKLPDTERQRLKEILREVVPSDAGVIIRTASEGVKEDDIRADVARLRERWEQIEAKAQETKEKAAGAAVALYEEPDVLVKVIRDLFNEDFVGLIVSGDEAWNTINEYVNSVAPELVSKLTKYESADGPDGQSAPDVFTVHRIDEQLAKAMDRKVWLPSGGTLVIDRTEAMTVIDVNTGKFTGAGGNLEQTVTKNNLEAAEEIVRQLRLRDIGGIVVIDFIDMVLESNRDLVLRRLTESLARDRTRHQVSEVTSLGLVQLTRKRLGTGLIEAFSTSCPNCSGRGILLHADPVDSAAATGRKSEPGARRGKRSKKSRSEESSDRSMVAKVPVHAPGEHPMFKAMAAGLSSLAGRGDEESGEPAAELAEQAGDQPPTDLDDTAQADFEDTEDTDEDEDELDADEDLEDLDDEDLDEDLDVEDSDSDDEDSDEDAADADVDEEDAAGLDGSPGEVDVPGVTELAPTRPRRRVAGRPAGPPIRLD

SEQ ID NO: 5057 - protein, 246 aa, Burkholderia vietnamiensis
MAVTMRQMLEAGVHFGHQTRFWNPKMAPFIFGHRNKIHIINLEKTLPMFTDAQKYVRQLAANRGTILFVGTKRQSRDTIAQEAQRAGMPYVNARWLGGMMTNFKTLKVSIKRLKDMEAAVEAGETEKMSKKEALLFEREIAKLQKSIGGVKDMGGIPDAIFVIDVGYHKIAVTEANKLGVPVIAVVDTNHSPEGVDYVIPGNDDSSKAVALYAQGVADAILEGRANAVNEVVQAVRGDDEYVEENA

SEQ ID NO: 5058 - protein, 1005 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGTPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 5059 - protein, 263 aa, Oryza sativa
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASRLPSSCF

SEQ ID NO: 5060 - protein, 401 aa, Arabidopsis thaliana
MALQAASLVSSAFSVRKDAKLNASSSSFKDSSLFGASITDQIKSEHRSSSLRFKREQSLRNLAIRAQTAATSSPTVTKSVDGKKTLRKGNVVVTGASSGLGLATAKALAQTGKWNVIMACRDFLKAERAAKSVGMPKDSYTVMHLDLASLDSVRQFVDNFRRTETPLDVLVCNAAVYFPTAKEPTYSAEGFELSVATNHLGHFLLARLLLDDLKKSDYPSKRLIIVGSITANTNTLAGNVPPKANLGDLRGLAGGLNGLNSSAMIDGGDFDGAKAYKDSKVCNMLTMQEFHRRFHEETGVTFASLYPGCIASTGLFREHIPLFRALFPPFQKYITKGYVSETESGKRLAQVVSDPSLTKSGVYWSWNNASASFENQLSEEASDVEKARKVWEISEKLVGLA

SEQ ID NO: 5061 - protein, 254 aa, Medicago truncatula
MTGTTRPSHHQIFDIEWEIISQSDSDDDGRLKRTAVIGSGVLSLAWAIAQLGWVAGPAVMILFSLVTAYTYCYRTGDPDSGKRKYTYMDAVRSILGGAKVTFCGIFQYLNLFGIVIGYTIAASISMTAIKKSNCFHQHGDKSPCHMSSNLYMIMFGVIQIFLSQIPDFDQIWWLSSVAAFMSFTYSLIGLALGIAKVAALAGIGIGAVSDTQKIWRISQALGNIAFAYSYAVVLLEIQDTLKSPPSEVKSMKKR

SEQ ID NO: 5062 - protein, 268 aa, Oryza sativa
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASSFWQIRTLKVLW

SEQ ID NO: 5063 - protein, 145 aa, Triticum aestivum
LGSQLSGLKAKVHAFSVCYGPKYFYDCVQGLIDELQSGLNSHDIVSIEDAKGLGYAKSTGDELRFVKDVAAATGIVLDPVYTGKVAYCMVKNMSDNPGRWEGRRVLFVHTGGLLGLYDKVDQLSSLAGGWRRMDLEEPVLHANFN

SEQ ID NO: 5064 - protein, 417 aa, Buchnera aphidicola
MFNTKIEFSKYDPELWKAIDQEKNRQENHIELIASENYTSNYVMHVQGSQLTNKYAEGYPEKRYYGGCKYVDIIEKLAINRAKKLFNADYANVQPHSGSQANFAVYTALLNPGDTILGMKLSHGGHLTHGSSVNFSGKTYNVIGYGVDKKGNIDYQEILTLAKKYKPKMIIGGFSAYSGICNWSKMRDIADEINAYFVVDIAHVAGLIAANLYPNPIDYAHVVTSTTHKTLAGPRGGLILAKNGTNTFYKKINLSVFPGAQGGPLMHVIAAKAIAFKEALEPAFKIYQKQVIKNAQVMVQSFLKKDYQIVSGNTFNHLFLLDLTSKNITGQEADIALGKCNITVNKNTIPNDLRSPFITSGIRIGTPAVTKRGFKENEMLQISDWIVHILNNIKDKNSLLGIKNEVLKLCSKYPVYI

SEQ ID NO: 5065 - protein, 417 aa, Francisella tularensis
MFSFEKNSLKNTDKEIFDAIELEVKRQHEHVELIASENYASPAVMEAQGSQLTNKYAEGYHGKRYYGGCEFVDIAEKLAIERAQQLFGVDYANVQPHSGSQANAAVYNAVLKPGDTVLGMDLGAGGHLTHGSKVNFSGKIYNSIQYGLDENGDIDYKQVAQLAKEHKPKMIIAGFSAFSGIINWQKFREIADSVDAVLMADIAHVAGLVAAGVYPNPFPYVYVATTTTHKTLRGPRGGLILCNNNPELAKKFQSAIFPGIQGGPLMHVIAAKAVAFKEALEPSFVDYQKQVLKNAKAMEKVLKQRGINIISGGTSNHLLLLDITNTGFSGKEAEAALGRANITVNKNSIPNDPRSPFVTSGLRIGSPAITTRGFKEKECELVANLLADVVFNCGDEKVENETAAKVLDLCDKFPVYK

SEQ ID NO: 5066 - protein, 322 aa, Unknown
  Synechococcus sp. RS9916
MVIASDITALVGRTPLVRLNRLPAASGCRAELVAKLESFNPTASVKDRIAGAMVQAAEEAGTISPGRTVLVEPTSGNTGIALAMVAAARGYRLILTMPDTMSTERRAMLRAYGAELQLTPGTEGIQGAIDLARELVDEIPEAYLLQQFANPANPAIHARTTAEEIWADTEGQLDVLVAGVGTGGTITGCGRLLKQRHPGLKVVAVEPAGSAVLSGQPPGPHRIQGIGAGFVPPVLDRDLIDEVMAVSDEEAMVIGRRLAREEGLLSGVSSGAAVAAALQLGQRPELEGKRIVVILASFGERYLSTPMFSSALPLPPRLDGQL

SEQ ID NO: 5067 - protein, 528 aa, Pseudomonas putida
MASVHGTTYELLRRQGIDTVFGNPGSNQLPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 5068 - protein, 179 aa, Triticum aestivum
  misc_feature (5)..(5): Xaa can be any naturally occurring amino acid
PGAQXAPHRSFSEEVDVLNRYFGHLKSGGNAYVIGDPAKPGQKWHIYYATEQPEQPMVTLEMCMTGLDKKKASVFFKTQADGHVSCAKEMTKLSGISDIIPEMEVCDFDFERRGCCLCRVAQVRLPLLRGRECAEPPSGQGRQARQPPRMAGGGGFPGGGRGAVRVIGCRCSVCGLCSD

SEQ ID NO: 5069 - protein, 180 aa, Brassica napus
YVRNVVGSIQRVALAITPRPGSMQFPTSPEALTLARWISRSYSLHTGANMFGADTQGCDGDTLLKQLWNHSDAILCCSLKTNASPVFTFANQAGLDMLETTLVALQDIMLDKTLDDSGRKALCSEFAKIMQQGYANLPAGICVSSMGRPVSYEQATVWKVLDDSESNHCLAFILGNWSFV

SEQ ID NO: 5070 - protein, 478 aa, Escherichia coli
  misc_feature (159)..(159): Xaa can be any naturally occurring amino acid
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLXCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 5071 - protein, 274 aa, Prochlorococcus marinus
MSDFLAAALQLTSTSDIDANLNSAEEQIELAAKRGADLVGLPENFAFLGEDQKKLKIASSIYEKCNSFLVTMARRYQVVLLGGGFPVPAGDGVRTLNRAELFGKDGQSLARYDKIHLFDVDLPEGNTYRESETIVSGSESPPVVDVPGLCKIGLSICYDVRFPELYRDLVNKGADLLMIPAAFTAFTGKDHWQVLLQARAIENTAYVVAPAQTGRHYGRRQSHGHAMVIDPWGTVLADAGVVQGAAIAPADKERVERIRGQMPSLKHRKTELFI

SEQ ID NO: 5072 - protein, 320 aa, Unknown
  Photobacterium sp. SKA34
MIKKIGVLTSGGDAPGMNAAVRGVVRAALTEGLEVYGIYDGYQGLYNNCIEKLDRQSVSDVINKGGTFLGSARFPEFREVEVREKAIENLKLYGIDALVVIGGDGSYMGAKKLTEMGYPCIGLPGTIDNDVAGTDYTIGYMTAMNTVIDAIDRLRDTSSSHQRISIVEVMGRHCGDLTLMSAIAGGCEYIITPETGLDKEKLLQHIREGIAKGKKHAIIAITELMTDVNELAKFIEAETGRETRATVLGHIQRGGQPTAFDRVLASRMGAYAVDLLQKGEGGRCVGIQCEQLVHHDIIDAIENMRRPVRNDLYELAEKLF

SEQ ID NO: 5073 - protein, 616 aa, Oryza sativa
MASSKETYRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKNLERMEVEERQAQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 5074 - protein, 461 aa, Anabaena variabilis
MATYENILQAIGQTPLVRLNRVTANVQSPIYAKVEYLNPGGSTKDRIALSMIENAEKTGQIQPGGTIIEATAGNTGVGLALIAAVKKYRCIFVMPDKMSQDKINLLKAYGAEVVVTPTSVPPDSPESYNGVAERLAKEIPGAYRPNQFENPNNPLAHYLTTGPEIWADSQGKIDVFVAGMGTGGTISGVAKYLKEQNPNIIIVGADPEGSILSGDSPKSYKVEGIGEDFIPKTFNRQLVDEMIRVSDKESFNMARRLAREEGLLVGGSCGTVVAAALKYAARLSQPKYIVVLLPDTGRNYINKIYSDVWMQENGFWEGKTVKTIKVGEILQQKTDFPSLVAVSPSDTLSQATNLLQKLNISQLPVIDNHHVVGSLNEASLMKFLYDGINFSNQQVLAVMGKPLPILDENVDVSEAYRVLLSGTTGIIITRNNIPAGLITRADLIRYWISQNQEKSKVNNGI

SEQ ID NO: 5075 - protein, 376 aa, Prochlorococcus marinus
MADFYDLLGVSRDADADTLKRAYRQQARKYHPDVNKEAGAEDKFKEIGKAYEVLSDSQKRARYDQFGEAGIGGAAGMPDMGDMGGFADLFDTFFNGFGGASSAGGSRPQRRGPQQGDDLRYDLTIDFDKAIFGQEKEITVPHLETCDVCRGTGAKKGTGPVTCSTCSGAGQVRRATRTPFGSFTQVAECPTCGGTGQVIKDPCNACGGKGVKQVRKKLKINIPAGVDSGTRLRVSGEGNAGLKGGPSGDLYVFLKVKNHPNLKRDGLTILSEVNISYLQAILGDTIEIETVDGPTKLQIPAGTQPNSILNLENKGVPKLGNPVARGNHQVSVKIKLPTKLSDSERNLLEELAGHYSALGPQHHYHKSGLFSKLFGK

SEQ ID NO: 5076 - protein, 381 aa, Pichia angusta
MTAMDRLDHVSNQLAAKRQKKNPEGKPFRITVVGSGNWGSTIAKVVAENAKELPEEFHQIVKMWVFEEEVDGRKLTEIINTDHENVKYLPDVKLPDNIVAIPDIVDACADADIIIFNIPHQFLPKILAQLKGKVNPKARAISCLKGLEVTKDGCKLLSNYITEELGIYCGALSGANLAPEVARQKWSETTVAYRIPQDFRGEGKDVDQSVIRNLFHRPYFHVRVIDDVAGVSLSGALKNVIAMAAGFVEGLGWGDNAKSAVMRIGLVEMIKFAHMFFEDCQSTTFTHESAGVADIITTCAGGRNVRVGRYMAEHKVSGFEAEKVLLNGQSCQGLHTTREVYELLAAKNVIDEFPLFKATYQIIYEGLPMEKLPELLEASED

SEQ ID NO: 5077 - protein, 489 aa, Photorhabdus luminescens
MTAELLVNITPSETRVAYIDGGILQEIHIEREAKRGIVGNIYKGRVSRVLPGMQAAFVDIGLEKAAFLHASDIVPHTECIAGEEQKNFHVKDIAELVRQGQDLMVQVVKDPLGTKGARLTTDITLPSRYLVFMPGASHVGVSQRIESEEERNRLKNIVADYCDEHGGFIIRTAAEGVGDEELAQDAAFLKRLWSKVMERKKRNVTKNKLYGELALAHRILRDFAGAALDRIRVDSRLTFTQLQEFIREYIPKMTARLELYNGNQPIFDLFDVENEIQRALDRKVELKSGGYLIIDQTEAMTTIDINTGAFVGHRNLEETIFNTNIEATQAIARQLRLRNLGGIIIIDFIDMNSEEHRRRVLASLEQVLSKDRVKTTINGFSQLGLVEMTRKRTRESIEHILCGDCPTCKGRGTVKSVETVCYEIMREIVRVHRAVDADRFLIYASPAVSEALKGEESHALAEVEIFVGKQVKVQTEQLYSQEQFDVVMM

SEQ ID NO: 5078 - protein, 411 aa, Kluyveromyces thermotolerans
MFSISRITRTSSFTTQFRALYRFKHSARKLQSIPFSIYKKMSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 5079 - protein, 946 aa, Xanthobacter autotrophicus
MSLVHEIDYGTPASKSEKLVSLTIDGMSVTVPEGTSIMRAAMELGNQIPKLCATDMLESFGSCRLCLIEIEGRNGTPASCTTPVAEGIVVKTQTERLKQIRKGVMELYISDHPLDCLTCSANGDCELQDMAGVVGLRDVRYGYEGENHTKLGKDESNPYFTYEQSKCIVCNRCVRACEEVQGTFALTISGRGFGSRVSPGMDEPFLTSECVSCGACVQACPTATLNEKAMYDIGTPEHSVVTTCAYCGVGCTFKAEMRGDELVRMVPYKDGKANRGHSCVKGRFAYGYATHQDRILKPMIRSSIHEPWKEVTYEEAIAYAASEFKRIQEKYGKRAVGGITSSRCTNEETYLVQKLIRGGFGNNNVDTCARVCHSPTGYGLSQTYGTSAGTQDFDSVEETDVVLIIGANPTDGHPVFGSRLKKRLREGAKLIVVDPRRTDIVRSPHIEAAYHLPLKPGTNVAIVTALAHVVVTEGLVNEQFVRERCDWDEFQDWAAFVADERHSPEAVEKYTGVDPALVRGAARLYATGGNGSIYYGLGVTEHSQGSTTVMAIANLAMATGNVGRNGVGVNPLRGQNNVQGSCDMGSFPHELPGYRHVSDDATRSTFEALWGVPLDDEPGLRIPNMFDAAVDGTFKGLYVQGEDILQSDPDTKHVSAGLAGLECLIVQDLFLNETANYAHVFLPGCSFLEKDGTFTNAERRIQRIRKVMAPKNGYADWEVTQLLANALGFPMNYTHPSQIMDEIAALTPTFAGVNYAKLDELGSVQWPCNDSAPEGTPIMHIGGFVRGKGKFVLTEYVPTDEKTGPRFPLLLTTGRILSQYNVGAQTRRTANVAWHPEDVLEIHAHDAENRGIRDGDFVKLDSRAGSTSLRAVISDRVAPGVVYTTFHHPVTQANVVTTDYSDWATNCPEYKVTAVQVSPSNGPTQWQEDYENLSRTSRRIAAEAAE

SEQ ID NO: 5080 - protein, 660 aa, Arabidopsis thaliana
MQRSCRTRRRVSVNKFNGRNSFYKVSLSLVFLLWVLLFFSTLLISHGDGAKDEPLNDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQVSKRLEWMEKKCLTVFTVCLGFGIIAVIAVVIGMGTGLAEKTGSGAWLLLLISSTFIMFVLSL

SEQ ID NO: 5081 - protein, 353 aa, Stevia rebaudiana
MALLNDLINLNLTDSTEKIIAEYIWIGGSGMDLRSKARTLPKPESDPKKLPKWNYDGSSTGQAPGEDSEVILYPQAIFKDPFRGGNNILVICDAYTPAGEPIPTNKRHAAAKIFSHPEVEKEVPWYGIEQEYTLLQKDVNWPLGWPKGGFPGPQGPYYCGIGADKAFGRDVVDAHYKACLYAGLILAALNGEVMPGQWEFQVGPSVGISAGDEIWAARYILERITEIAGIVVSFDPKPIPGDWNGAGAHTNYSTKSMREEGGYEIIKKAIEKLGLKHKEHIAAYGEGNERRLTGHHETANINTFKWGVANRGASIRVGRDTEKEGKGYFEDRRPASNMDPYVVTSMIAETTLL

SEQ ID NO: 5082 - protein, 254 aa, Brassica napus
MPAPVASSPVISAASLSIPLRSLSKAAHPLFKPVSPFPKTARSTISVYKPPMNNLFNRLGYGSRSQQDPSSAAIAQGPDDDVPSPGQQFAQFGAGCFWGLELAYQRVPGVTKTEVGYSHGFVHNPIYEDVCTGMTGHNEVVRVQYDPKECSFENLLDVFWNRHDPTTLNRQGNDVGTQYRSGIYYYTDEQEKFARESLEKQEKILNKKIVTEILPAKKFYRAEEYHQQYLAKGGSMGRRQSAEKGCNDPIRCYG

SEQ ID NO: 5083 - protein, 154 aa, Aspergillus nidulans
MGRGSKSDNSGTIDRDEFLSLPQVSTNPLATRMIAIFDEDGGGDVDFQEFVSGLSAFSSKGNKEEKLRFAFKVYDIDRDGYISNGELFIVLKMMVGNNLKDVQLQQIVDKTIMEADKDHDGKISFEEFTDMVESTDVNLSMTLNADVIDSRPII

SEQ ID NO: 5084 - protein, 169 aa, Rhizobium leguminosarum
MTEERAVLAGGCFWGMQDLIRRYKGVISTRVGYSGGDVPNATYRNHGTHAEAIEIIFDPARISYREILEFFFQIHDPSTRNRQGNDVGLSYRSAIFYVTPEQERVAKDTIADVDASGLWPGKVVTEVVPVSDFWEAEPEHQDYLERIPNGYTCHFVRPGWKLPVRQKIA

SEQ ID NO: 5085 - protein, 221 aa, Brassica oleracea
MAFHSEDDKSEDYLFKIVLIGDSAVGKSNLLARFARDEFYPNSKSTIGVEFQTQKMDINGKEIKAQIWDTAGQERFRAVTSAYYRGAVGALLVYDISRQQTFQSIGRWLNELHTHSDMNVVTILVGNKSDLKGIREVPTSEGKALAEAQGLFFMETSALDSSNVAAAFETVVKEIYNILSRKVMSSQELNKQDPASLSNGKKVVIPSEEQGESKKGGCCST

SEQ ID NO: 5086 - protein, 528 aa, Pseudomonas putida
MASVHGTTYELLRRQGIDTVFGNPGSNALPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 5087 - protein, 345 aa, Brassica oleracea
MKKEMIEEVVIVGGLVMVQFVYAGNSLLMSYLMSLGLGPFTIVIFSTFATFLILSPFAILFERKQWPKELSARLIGKLVLISFAGVTLFQSLFLEGIRLTSPAMATAMPNLAPGLIFFIAWIVRLEKMNMKCVYSKLKILGTLLCVFGALTMSLMHSASIIQDEKDNASIFVFDRDRVVGCIYLLGAVFVLSTNVVLQASTLAEFPAPISLSAITALIGVLITMLVQLLQNQSGKVLTRSLISIGNLVGFSLLGGMVSGACVSFNGWAMKKRGPVMVSMFSPFATVISVGFSVLTLGESICLGSVGGMALMFMGLYLVLWAKGKEGFSQIESFECEFDAKKPLLS

SEQ ID NO: 5088 - protein, 87 aa, Thiobacillus denitrificans
MAKEEVIEMEGVVNEVLPQTRFRVTLDNGFEITAYASGKMRKHRIRILAGDKVTVEMSPYDLTKGRINFRHKDAHQAPRPTVARRYN

SEQ ID NO: 5089 - protein, 112 aa, Thiobacillus denitrificans
MKKIEAIIKPFKLDEVREALSEIGVTGLTVTEVKGFGRQKGHTELYRGAEYVVDFLPKVKLEVVVADNLVERVTEAVVNAARTGKIGDGKIFVTAVEQVVRIRTGESGEAAV

SEQ ID NO: 5090 - protein, 580 aa, Ostreococcus tauri
MSDARTRSRGTVDIDGETLKRADRGRRGRESGDRRSETNAVAAAGEDGGERDADALRVLLATDDAHTRGMVHKMLRELGVEVVMATNGKEVLEVLRGRPKGVAAAAEDVSVDMILLDVLMPALDGEVELVEVCKSNEALRGVPIVIMSTVDERKACGTRYEHSGAAGFLTKPVNRTELKESLSHTRMLKSHESGSAENDGSGNDPNVGSAKSSLTKLTNGEKAAGGSGDGGSGGGGSGQGQNDSGSDNVRLYNEGNEKSRRREAEAMDRWASREGGSGDCGSGGSGQGTGSGSGSHEGSGSGQRDSNENEKFRGLSVQLIKAHGGATTMLELSLPEHSSEHVVVRRSNSRSAFKGFQTYLKSEKKESSVQMMSLDLTQQQHQSFYEASSMMPPADFARFYGPIMPAGMPPPPMDLPLPPPPYIDMNQFTAAAFTSASIRPDMMDSTANPFWSVLQTAADHTQQTSSSQAAEHRAAAIRRFLKKRKERNFDKKVRYASRQQLAASRPRLRGQFVRNAEETTTENGSNGSDGKKSNEFNASAAKGEVQGREEQYVDRHGSNTGTSNEGSKEGSRSSSRDGSK

SEQ ID NO: 5091 - protein, 962 aa, Unknown
  Shewanella sp. ANA-3
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTIRTDIEALFDVILGAGHGLDVAALDAQIVAQGSQSIPASLVRQDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 5092 - protein, 597 aa, Glycine max
MTGVEAMEKNEKSVTDEEPKINYRGWKVMPFIIGNETFEKLGTIGTLANLLVYLTTVFNLSSLAATNIVNIFNGSASLSTLLGAFLCDTYFGRYKTLGFSTMASFLGLLVIQLTAWIKKMHPPHCGRDSITCIGPTTGQMGFLLAGFGLLIVGAAGIRPCNLAFGVDQFNPNTESGKKGINSFFNWYFFTFTFAQMVSLSLIVYIQSNVSWAIGLGIPAALMLISCTLYYTGSNYYVKVKATGPAPLTSLAQAVVVAIKKRRLNLSEYPLDSSLFAYVSPQSINSKLLHTSQFRFLDKAAIITPQDGINPDGSASDPWSLCSMQQVEELKCLLRVIPIWFAGIFFYIAIVQQNTMLVFQALQSDRRILSTNFKILAASYTIFQMLSLTIWLPIYDRILVPSLQRVTKKEGGITVLQRIGFGMFLSILCTMVSGVVEERRRTLALTNPIGLEPRKGAISSMSGLWLVPQLTLAGLSDAFAIVGQVEFFYKQFPENMKSLAASLFFCGLAGSSYLSSLLISIIHRATAKSSTGNWLPQDLNKGRLDRLYYIITALEVVNFGYFILCAKWYKYKGTGSSSSGDLQLDQVSKPSERTVNTV

SEQ ID NO: 5093 - protein, 272 aa, Juglans nigra
EDERPKVAYNQFSTEIPIISLAGIDEVHGRRTEICQKIVEACEDWGIFQVVDHGVDASLISDMTRLARDFFAMPPEEKLRFDMSGGKKGGFIVSSHLQGEAVQDWREIVTYFSYPIRTRDYSRWPDKPEGWRKVTEEYSDKLMGLACKLLEVLSEAMGLEKEALTKACVDMDQKVVVNYYPKCPQPDLTLGLKRHTDPGTITLLLQDQVGGLQATRDGGKTWITVQPVEGAFVVNLGDHGHFLSNGRFKNADHQAVVNSNYSRLSIATFQNP

SEQ ID NO: 5094 - protein, 715 aa, Escherichia coli
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLSIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 5095 - protein, 312 aa, Clostridium perfringens
MDKEIKELDLIIIGAGPAGLTSAIYASRAKLSTLVLEDNLVGGQVRSTYTVENYPGFTEITGNDLADRIQAQAEACGAIIDEFDFIENVSLKDDEKIIETGDYIYKPKAVIIATGATPKKLPIPSESKYLGKGVHYCAVCDGAVYQDEVVAVVGGGNAALEEALYLSNIVKKVIVIRRYDYFRAEAKTLEAASNKENIEIMYNWDLVDVLGGEFVEAARIKNTKTGEEKEIAINGVFGYIGTEPKTSMFREYINVKENGYIEGDENMRTNVKGVYVAGDVREKMFRQITTAVSDGTIAALHAEKYISEIKER

SEQ ID NO: 5096 - protein, 1034 aa, Bacillus megaterium
MLKTGKKFHYTAPANGYPEWNNNPEIFQLNRSKAHALLMPYQTVEEALKNDRKSSVYYQSLNGSWYFHFAENADGRVKNFFAPEFSYKKWDSISVPSHWQLQGYDYPQYTNVTYPWVENENLEPPFAPTKYNLSVSTSVLLHLNQNGKISPCTSASKGVESAFYVWINGEFVGYSEDSFTPAEFDITSYLQEGENTIAVEVYRWSDASWLEDQDFWRMSGIFRDVYLYSTPQVHIYDFSVRSSLDNNYEDGELSVSADILGCFEHDTQDLTFEVMLYDANGQEVLQRPLQTNLSVSDQRTVSLRTHIKSPAKWSAESPNLYTLVLSLKNAAGSIIETESCKVGFRTFELKNGLMTINGKRIVLRGVNRHEFDSVKGRAGITREDMIHDILLMKQHNIKPVRTSHYPNDSVWYELCNEYGLYVIDETNLETHGTWTYLQEGEQKAVPGSKPEWKENVLDRCRSMYERDKNHPSIIIWSLGNESFGGENFQHMYTFFKEKDSTRLVHYEGIFHHRDYDASDIESTMYVKPADVERYALMNPKKPYILCEYSHAMGNSCGNLYKYWELFDQYPILQGGFIWDWKDQALQATAEDGTSYLAYGGDFGDTPNDGNFCGNGLIFADGTASPKIAEVKKCYQPVKWTAVDATKGKFAVQNKHLFTNLNAYDFVWTVEKNGELVEKHASLLNVAPDGTDELTLSYPLYEQENEADEFVLTLSLRLSKDTAWASAGYEVAYEQFVLPAKAAMPSVKAAHPALTVNQNEQTLTVTGTNFTAIFDKRKGQFISYNYERTELLASGFRPNFWRAVTDNDLGNKLHERCQTWRQASLEQHVKKVIVQPQVDFVIISVELALDNSLASCYVTYTLYNDGKMKIEQSLAPSETMPEIPEIGMLFTMNAAFDSLTWYGRGPHENYWDRKTGAKLALHKGSVKEQVTPYLRPQECGNKTDVRWATITNDQGRGFLIKGLPTVELNALPYSPFELEAYDHFYKLPASDSVTVRVNYKQMGVGGDDSWQAKTHPDYTLYANRSYTNTFTLKPL

SEQ ID NO: 5097 - protein, 532 aa, Ostreococcus tauri
IDGLPGRGAEKVTSAGDLLLCVSRDQQELVGYRFKGMSACVKRDERGVVVGGEGARRAARSFWSYFDEAWTTRLSDGEDAIVKDFMLEMHDGDFIVMASATPLDGASVAAGGAVRETEEGAPIGTRAGGGRRGTETQETSSGIQGAPSMQRITFHLVRTATGEKLDAFSFRDDFMHLPRNGAVSMRGDTLAVLSMKHQRVVFLKVHAEGRFEEVSSIGEYITEGDKEAVREQESVERAWAASHEESTKIIERANALPRSGRSMLTGLTQRLVTFLYHEARESSNVDALRLLHRNFERYVSLVMLRVRILDANLLLIKFGTPEYALARRGDNVIGPTMYAVFDITKGAFTQTAMSMNASNSVVEEDLNAPPRGETLWARFAGSQGEALAQCNTCTSSIEEEDEDGLNTVAARLFRAQDYPPQFRSLSPYFDKRLFSYDERTITAIDRLQPHVDFGVKFVSQRRGSRRRISFKLMVNDTVANSGRSKRRVQYVFHPVYPFAMSISIAYMQPTLVNFHVRSAPGDEMHEEIVQNP

SEQ ID NO: 5098 - protein, 407 aa, Zea mays
MAAPTTSRRGPGGARNMDDENLTFETSPGVEVVSSFDQMGIKDDLLRGIYGYGFEKPSAIQQRAVLPIINGRDVIAQAQSGTGKTSMISLTVCQIVDTAVREVQALILSPTRELASQTERVMLAIGDHLNVQVHACIGGKSIGEDIRRLENGVHVVSGTPGRVCDMIKRRTLRTRAIKLLVLDEADEMLSRGFKDQIYDVYRYLPPELQVVLISATLPHEILEMTSKFMTEPVRILVKRDELTLEGIKQFFVAVEKEEWKFDTLCDLYDTLTITQAVIFCNTKRKVDWLTEKMRSNNFTVSAMHGDMPQQERDAIMGEFRSGATRVLITTDVWARGLDVQQVSLVINYDLPNNRELYIHRIGRSGRFGRKGVAINFVRKDDIRILRDIEQYYSTQIDEMPMNVADLI

SEQ ID NO: 5099 - protein, 131 aa, Triticum aestivum
  misc_feature (113)..(113): Xaa can be any naturally occurring amino acid
MASTSSLELGKIVPPAGFLLHRCTAVLSAPVLRGRSASGRCGLAVSVSSSNGAAGLSPLSDSEKKGPVVMEIPLEDIRRPLMQTRANDPDKVQELMDSIRVIGLQVPIDVLEXDGVYYGFSGCHRYEAHSA

SEQ ID NO: 5100 - protein, 586 aa, Gluconobacter oxydans
MCGIAGLSCLPGHHPDQDALERMSQAIFHRGPDGEGRLDLGGAALRHRRLSIVDIAGGAQPFRLGAAALIANGEIYNDPAIRRRFPKTCFQTHSDCEPPLHLWLHDGAGYTHELRGMYAIAIVENEHGRHEMVLSRDPFGIKPLYIAAYEGGIAFASEPQALLAGGFGRRSVRDGARNELMQLQFTTGQDIIFDGIRRLLPGETLRIVDGRIVESRRRHVLHEARDTVPARLSDEQALARLDTALLDSVSAHLRADVPLGLFLSGGIDSSVILAAAHRLGLPHPRTWTARFDAGKADESADAAALAASVGAEHHVLTVTEDMVWRDLPSIVACMDDPAADYAVIPTWFLAREARKDVTVILSGEGGDELFAGYGRYRRVMKPWWKGGRAPYRSGTFGKRFAEHGRQWRRGIAMTELALGVSGLEGAQALDIAEWLPNDLLLKLDRCLMAHSVEGRTPLLDPVVAKAIWPLPEHFKVRDGYGKWLLRRWLQDALPQARPFAPKQGFTVPVGPWIEKQAHRLGPLVARQPCIRAMMPAADVERLFARASQRGVARQAWTLLFFALWHRHHIEGVPVDGDTFETLARAS

SEQ ID NO: 5101 - protein, 586 aa, Ashbya gossypii
MGREGVPLIASLNASNEVMLLVGTGGSGRVVSRLRGLLNTGAQCIVVQPSNSKLVAQLYREFAGEPLLRILDRAFALEDLTTLGRYEASNVVDRVFLTPGHSADEILQAHAVYRQCIKLRIPINTSQRPELSTFSLPSTYRDPKGSGLQVAVTTDGRGCVLANRIRREIVSKLPANISEVVSNMGRLRDCITTRDHAELLQTVDLESELETMGILPDEDQWASHRFNKLVQELRMKESDQRLKRLRWLSQIMEYYPLSELADVSVDKLLDEQTGAACSGTTATTGAASVTGATEDTAAEPAEGVASDSSGARDLARSAAGSIALVGSGPGSLSMLTLGALSEIKSADLVLADKLVPQEVMNTIPAGTETFIARKFPGNAERAQEELAEKALAALREGKRVVRLKQGDPYIFGRGGEEYLLFKRHGFEPRVVPGISSALAATTVAHIPATQRDVAEQVLICTGTGRRGVLPPAPEFVAARTTIFLMALHRVGDLVQALLEQQWDPQVPAAIVERASCPDQRVTRTTLASVPEVVEQIGSRPPGLLIVGHAVTSLKGLGSEQAGALHYSVEEGYGDDIPTLLETLVPV

SEQ ID NO: 5102 - protein, 833 aa, Oryza sativa
  misc_feature (695)..(695): Xaa can be any naturally occurring amino acid
  misc_feature (726)..(726): Xaa can be any naturally occurring amino acid
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKFXMAAHTRNISSLGLEGQTIYQRRGAKFSSKHXQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 5103 - protein, 343 aa, Candida glabrata
MPAPTQPAPSYSKCYALKEIIYGFWATKVTYTPDKYPDLTGKTAVVTGCNTGVGKEAAKLLYQKNCNVIGVCRTESKGLEAAESIKQEIGNSKGSISVVSGCDFLDFTTVPQAGKRIQEILAGKPLNIIIHNAGLMSSSNAGTSKQGLEAMFQTNVMGPQLLQHYLDPVFLKEDDTSLKRIVWVSSGAHLLGPSQYGIFWENPGFDGVAIEKRPAATTLYGATKAANILQAKAWATRNKEMVDKIGCVSVSCYPGNLRTDLQRDWHPWTRATVGRLFYPAEYGAYTELYSVLSPSLTTSDQGKYICPFDQVHEPREDVKEGLQNGTDLALWDWIESEIKEYIS

SEQ ID NO: 5104 - protein, 687 aa, Ashbya gossypii
MSVRVPVVDPTYQNVYSGKHYAMATFLYDLAIFFFNIAFTIFFRKIHVRGTSNLPPQGRPAIVVCAPHANQFVDPTLVMTQVKKLPGQHSRRPCFVMAAASFKKPLVGMLGRWTAGISVDRAADHLRVCEENMVLYCPDYDKDPLRYKVRPRDGARAIRDVRAVFTENGLLGLPGNLGSAQIAALEAPDAIRVQRPSGHSSAVRTLLERGTDFLYAPKLDNGTLFQDVFNHLHTKGLVGIFPEGGSHDRPSLLPIKAGVAIMALRAVAADPEMEISIVPCGLYYFHRHMFRSRAVLEFGAPIIVDGAMGQKYLQDPKTTVSELLDQVVNALYSVTVNTDDYDILMLVQATRRLYQAAWGNKRVPLAAVVEMNRKLSIGYTKHKEHPRIKHLMLAIRDYDAQLYSLGLKDHQVDELRNPNEKAVYIIFLFLTRLFHVLVFALLSLPGALLFSPIFITCHFYSQKKAREGLKRSLVKIKGDDLLATWKLVVAFCMTPALYAVYAALLTYLTFSHFHPLIFANKIGTFMCYYVLLLATTYASFVIGEIGMDVFKSLPPLFISLIYPSQKLQELREIRKNLSAEVYAMGPAFFPDLDRSDKSERDSAVNSAPAQLMEPALGPESPLLQRCATTTQLAFRNTVSASGIIEAQANDVPGKGRVVTEDSCWSSSSYYGHEAASSFKTPAQDDRK

SEQ ID NO: 5105 - protein, 220 aa, Unknown
  Vibrio sp. S14
QLNMALMLFLAPSSDELDHVLGEQPYYDIDDVRLTFSPKDFIQVNRDVNVKMVEQAINWLDIQPQDRVLDLFCGLGNFSLPLARRAKAVVGVEGVDEMVARATANAAANGLDNATFYQANLDEDVTKLVWAQEQFDKILLDPARAGAAGVMQHIVNLAPSKVVYVSCNPATLARDSQMLLQQGYKLARLGMMDMFPHTGHLESMTLFVKTNHHKKNSNVM

SEQ ID NO: 5106 - protein, 398 aa, Kluyveromyces lactis
MSFNRDDDSKLKFKTSKKLKVSATFESMNLKPDLLRGIYFYGFEYPSSIQSRAISQIISGKDVIAQAQSGTGKTATFTIGLLQAIDSKSKELQALVLSPTRELASQSESVISNLGDYLNVTAHACTGGKALQQDIKKVSKNCQVVSGTPGRVLDMIKRQVLNVRNCKILVLDEADELLGETLGFKQQIYDIFTKLPPTIQVVVVSATMSKDILEITKKFMSDPVKILVKRDEISLDVIKQYYVDVEKEEWKFDTLCDLYDSLTITQCVIFCNTRKKVDWLSRKLTQTNFSVSSMHGDMKQEERDQVMNDFRSGKARVLISTDVWARGIDVQQISLVINYDIPDNLENYIHRIGRSGRFGRKGVAINFITKEERPKLKEIESHYRIKIKPTPANLEELS

SEQ ID NO: 5107 - protein, 334 aa, Chlamydophila caviae
MKEKIAYLGMGIWGFCLASLLANKGYHVVGWARNAELIAQLQTEKRHPQVPDVPIHPNLSFTTDMAEAVENASMIVEGVSSAGIRPVSEQLKTITNLNVPFVITSKGIEQHTGLLLSEIVVEIFGNDASQYLGYLSGPSIAREVLKGCPCSVVISAYNPDTLKKIHNAFLTPTFRVYPNSDLKGVALGGALKNIIAIACGISDGFRFGDNAKSGLVTRGLHEIRKFATIMNCRPDTLNGLAGLGDLCTTCFSSLSRNTKFGKLIAQGMTVAQAKAEIGMVVEGVYTALSAYQIAKHHKIDMPITTGIYRVLYENLDIQEGIAALLQRNTKEEYL

SEQ ID NO: 5108 - protein, 323 aa, Photorhabdus luminescens
MSNEIKRIGVLTSGGDAPGMNAAIRGVVRAGLTEGLEVFGIYDGYLGLYENRMKKLDRFSVSDMINRGGTFLGSARFPEFRDEKVRTVAIENMRKNGLDALVVIGGDGSYLGAKKLTEAGFPCIGLPGTIDNDVAGTDYTIGYFTALETVVEAIDRLRDTSTSHKRISIVEVMGRYCGDLTLSAAIAGGCEFIVLPEVSFSCDELVAEIKAGIDKGKRHAIVAITEHVCDVYELAKHIEKETHHETRATVLGHVQRGGSPVAYDRILASRMGAYSIQLLLEGYGGRCVGIQNEKLVHHDIIDAVQNMKRVFKQDWLETAKKLY

SEQ ID NO: 5109 - protein, 222 aa, Saccharomyces cerevisiae
QFNPYGDNGGTILGIAGEDFAVLAGDTRNITDYSINSRYEPKVFDCGDNIVMSANGFAADGDALVKRFKNSVKWYHFDHNDKKLSINSAARNIQHLLYGKRFFPYYVHTIIAGLDEDGKGAVYSFDPVGSYEREQCRAGGAAASLIMPFLDNQVNFKNQYEPGTNGKVKKPLKYLSVEEVIKLVRDSFTSATERHIQVGDGLEILIVTKDGVRKEFYELKRD

SEQ ID NO: 5110 - protein, 468 aa, Unknown
  marine gamma proteobacterium HTCC2143
MTKKINAGITTLSQLKDWVLLAGPIAGLLVYYFLLQAGLESDAAITAGITLLCVLWWVFEPVPIPVTSLIPLAMLQIFGVLSKNEVAEAYGSPLILLLLGGFIISKAMERSGAHRRIALGMINLFGGNSSRQLVFGFMATSAVLSMWISNTATTLMLLPVALAVLEKAEDRRLAAPLMLGIAYAASIGGIGTPIGTPPNLVFMQVYEEQAGKSVGFTEWMTWGVPVVLLMVPVTGLWLTRSLTYRGGFHLPEVGKWRVDERRVLMIFALTALAWITRKEPFGGWTELLGVNANDASVALTAVILMFVVPNGRGEKLLDWPTAASIPWGVLLLFGGGICLAKGFVASGLSTMVGDALAVLANLPLILMMLALCLGVTFLTEATSNTASTVLLMPVLAAAALAAAVDPRLLMVPAAISASCAFMLPVATAPNSIIYGSGCVTTQQMAREGFVLNILGALVISGVCYLLLI

SEQ ID NO: 5111 - protein, 66 aa, Glycine max
MVQFFSAVSILILVAVAASMVVLPLMLPPLPPPPLILLFFPVGIMAALMLLAFVPSEVPMATNLIL

SEQ ID NO: 5112 - protein, 274 aa, Brassica oleracea
MMMRKEDLGLSLSLGLSQDHTPLQSQNPNSSISNNLHRFPWNQTFASTSDLGKIDVNSLPRTVDCEEEPGVSSPNSTISSTISGGKRSEREGISEHDEITPDRGYSRGNSDEEEDGGETSRKKLRLSKDQSAFLEGTFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSNHQHNHRPVPVNPWVACAGQVTHGLNFEALRPRS

SEQ ID NO: 5113 - protein, 587 aa, Cryptococcus neoformans
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSTPADITYLGISKGRQHWLSGEGERFRPPVLNSIRSSVMEEARETGVNEGMAAVVTT

SEQ ID NO: 5114 - protein, 353 aa, Unknown
  Polaromonas sp. JS666
MKIVVIGAGAWGTALAVNTAGAVEAAGSDAPRHQVTLWARDAALVKAMQAERANTRYLPGVALPGNLLLQGGGETSLAEAVSGQDLIILATPVSAARGLLQSLQQASVPVVWLSKGFEAPVAAVPHSAPSLASFGLMVHEIRAQVATDLRAGILSGPSFALEVARGQPTALVAASEHAEVRDALVAAFHGTSLRIYASDDIVGVEVGGAVKNVLAIATGLCDGLQLGLNARAALITRGLAEMTRLGVTLGARAETFTGLSGLGDLVLTATGDLSRNRKVGLQLAQGKTLAEAVKSLGHVAEGVYCARTVVQRAAGLGVDMPIAQSVVALLDGKLRPAEAVAALMGRGPTTELA

SEQ ID NO: 5115 - protein, 295 aa, Treponema denticola
MSKIIIALLQLTPGNSLVENMYIGIAACRKAKNMGADIALFPEMWSIGYEIPKSVNELKSKAISKNDAFIHSFSDLAKELQMAIGITFLEKYEPLPRNSICLFDRFGKELYTYAKVHTCIFGDEKNLMPGNDFYVSELDTERGCVKIGSMICYDREFPESARILMLKGAEILLVPNACPMEINRISQLRARAFENMVGIATVNYPKGKPDCNGHSTAFDGIAYKIDEPYSRDTLIIEAGEEEGIYIATFNIEELRKYRSREVHGNAYRQPTKYEILLSEEKQEPFIRKDYRKSAN

SEQ ID NO: 5116 - protein, 954 aa, Vibrio vulnificus
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDSLPQTEAFGALLQYPSTTGEVRDLTDVITQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEVGIRTIARRTHHMTAILAAGLTKSGYELAHNAFFDTITINTGDNTQALYAKAQAADINLRLLDGQIGISFDETTTVADIDALFAIFDVKESVNALSTDIAGNEFAAIPEACRRTSRFLTHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 5117 - protein, 509 aa, Rhizobium leguminosarum
MKIVLINPPHTAIGSRIPDDHLPPLGLLSVGGPLIDDGHIVGLIDAEFGPMTIAEIVSRVAASGPDLVLIGHSGSTSAHPTARAIAEAVKHSDRAIRIVYGGVFPTYHWREVLAETEAFDILVRGEGEETMRRLAGTLTAGRPLATVPGIAYRNGDGEILATQPAQAFADLDAYRVGWELIDHRHYSYWGGKRAVVMQFSRGCPHLCNYCGQRGFWTRWRHRSPELFAREIARLYREEGVELINLADENPTSSRKAWLAFLEAMIIENVPVQIVGSTRADDIVRDADILHLYRKAGVVRWLIGMENTDEATLTLIKKGGAKATDREAIRLLRQHDILSMATWVVGFEEETLSHLLRGFRQLLSYDPDQIQALYVTPHRWTPFFRIARDRQVIETDIRKWDYKHQVLKMRHLNPIVLVACVKLIEVAVQARPKALLRILFHRDREQRHSMRWYTQMGRRVWFHEILEFLFRRRHLKDGPTLENFWGAPQDSEEESMLRPQRYVKSLDAAE

SEQ ID NO: 5118 - protein, 320 aa, Buchnera aphidicola
MIKKIGVLTSGGDAPGMNAAIRGVVRTALSEKLEVFGIYDGYLGLYENRMTLLDRYSVSDMINRGGTFLGSARFPGFYKNEIRTIAVNNLNKRNIDALVVIGGDGSYIGAQKLTKMGIPCISIPGTIDNDVAGTDYTIGYFTALETVVEAIDRLRDTSSSHQRISIVEVMGRYCGDLTLAAAIAGGCEFIVLPEIHYKKEELVSEIQAGIEKGKKHAIVAITEYICDVEKLAKYIEKKTNRETRATILGHIQRGGAPVVYDRILASRMGAYAVELLIEGYKGKCVGIQNEKMVFNDITDALKNMKRVFKKDWLITAKKLY

SEQ ID NO: 5119 - protein, 483 aa, Hyphomonas neptunium
MRQFPAFFNLEGARIVVFGGGEEAARKLRLFNDSGADAVLVGGFEDVALAAEFARRAETVARADMARALDGARLVIIAEEDAGHRARALAAVRARNIPVNVVDQPEDCDFTVPSILDRGEIVAAIGSGGAAPVLAKSIRAKLEALLPQRVGDLAALARSLRGFVAEAIPEKTARRRYWERAFAGPAAEAAYAGDLERAEALLRQQARLTGRARGVVHIVGAGPGDPELLTLKALRLIQEADVVYYDRLVSPEIISLIRRDATRVPVGKSKGDHSVPQTEIHARLVASAQEGLRVVRLKGGDPFIFGRGGEELEAVRAEGIEVHVVPGISSALGCAASAGVPLTHRDHAQTLTFVTGHAKEGGVPDLDWPALARPAQTVVVFMGVDTAPVIAEKLVAAGRAPETPVAVIENGTRADELRVFGTLAELPFLVEEEGIRGPALLIIGEVAGLPAEQGRIASIVTEASGFAWFGADARRPDFKESAA

SEQ ID NO: 5120 - protein, 431 aa, Vibrio vulnificus
MNSHYQNHSLENFFSTNLSATDDAVFAGIQAEFTRQNEQIELIASENIVSKAVMQAQGTCLTNKYAEGYPGRRYYGGCEHVDTVEAIAIERAKKLFNCEYANVQPHSGAQANGAVKLALLQPGDTIMGMSLDAGGHLTHGARPALSGKWFNAVQYGVDKETLEINYDDVRALAVEHKPKMIIAGGSAIPRVIDFAKFREIADEVGAILMVDMAHIAGLIATGAHPSPLPHAHVVTTTTHKTLRGPRGGMILTNHEEIIKKINSAVFPGLQGGPLMHVIAAKAVAFGEALGPEFKTYIDSVIDNAKVLAEVLQTRGCDIVTGGTDTHLMLVDLRPKGLKGNKAEEALERAGITCNKNGIPFDTEKPMITSGVRLGTPAGTSRGFGAEEFKLIGHWIGDVLDGLVENPEGNAEVEQRVRKEVKALCSRFPLYQ

SEQ ID NO: 5121 - protein, 305 aa, Clostridium tetani
MKIYNNLIELIGKTPLVNLNKFEKKNGLDSNIIAKVEYFNPSGSVKDRAALSMIEEAERTNLINKDTVIIEPTSGNTGIGLALICAIKGYRLILTMPETMSIERRNILKAYGAEVVLTPGNKGMNGSIQKAEELAKEMGNVFIPQQFNNPSNSAIHKITTAKEIINDLDGKVDIFIAGVGTGGTVTGVGEGLKEYNKNIKIVAVEPENSPILSGGKPGPHKIQGIGAGFIPEILDMNIIDEIFKAPNEESIEIMKKIVKLEGLFVGISSGAALYAAKEIGKREENKGKNIVVLLPDTGMRYLSSY

SEQ ID NO: 5122 - protein, 538 aa, Arabidopsis thaliana
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAVGTIISCTIISLGVTQFFKKLDIGTFDMGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 5123 - protein, 559 aa, Buchnera aphidicola
MNESFAQLFEESLKEIKTRPGSIIRGTIVSIEKDIVLVDAGLKSESAIPVEQFKNAQGLLDVKVGDQIDVALDAIEDGFGETLLSREKAKRHEAWLILEQAHEKSETVIGIINGKVKGGFTVELNEIRAFLPGSLVDVRPVRDTIHLEGKELEFKVIKLDQKRNNVVVSRRAVIESENSAERDQLLESLQEGIEIKGIVKNLTDYGAFVDLGGVDGLLHITDMAWKRVKHPSEIVNVGDEINVKILKFDKERTRVSLGLKQLGEDPWIAISNRYPEGIKLSGRVTNLTDYGCFVEIEEGVEGLVHVSEMDWTNKNIHPSKVVAVNNIVDVIVLDIDEERRRISLGLKQCKINPWQEFSETHKKGIHVSGKIKSITDFGIFIGLKGGIDGLVHLSDISWKISGEEAVKNYKKGDEISAVVLQVDAERERISLGIKQLEEDPFNVYVSNHKKGAIITGIIKDFDKKTVTVKLSDGVEGNIKFSDSSRVNSEEIIKKLKIDDTILVKISNFDRKNRIINLTFHILDENNNKKDLKNKINVKSNDESFSNVMAEAFKAAQNTE

SEQ ID NO: 5124 - protein, 610 aa, Campylobacter jejuni
MKKNILRLGIVVLVLLIAGVLWLNNDINQKKEDEANKNAIAANADFSLLSDDDPNFEKWGKVFPEQLKMYLTVEKEEPKATEFGGNLAYSKLIRFPQLTILWAGYPFSLDFNEERGHFWVQVDQMKTARNNKDFLNAHGLAAFKGQPAACMNCHSGWTPWLIKNVAKGDFTAFNSTNYWTMIKNIPAVDGIVENSPEHAGPHGGKRMGVTCADCHNPNDMSLRLTRPAAINALVSRGYEKDPVQGVKATREEMRTLVCSQCHVEYYFKPTGEKVKVMGETIVDDSSKKWWNGTQKNYDEYEFWRDGNKVKEIETDGIVLTFPWSEWKKGQPFRIEMLDDYYDKVRGVFGADFTHKLTGAQIIKIQHPESELYSGGVHAANGVSCVDCHMPYVREGAKKVTQHNITSPLRDINSACKSCHKQSEDYLKAQVLDIQNSVAHDQRTAEYAIVSLIMDTKKLRDELGNMEKFQSDGKADAKKISEELKEVLELHRKAQMRADFVNAENSTGFHNPREASRMLLQAVDMARMGQTKLVEIAAANGIKDFKTSNLGFEDIQKFNPGELYYKVDVNNHKAGERYYADEKDVNGNPPKELLEHDKELAPYNYQVIDKK

SEQ ID NO: 5125 - protein, 623 aa, Oryza sativa
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 5126 - protein, 273 aa, Unknown
  Synechococcus sp. RS9916
MSDFLAAAVQLTSTSDLERNLAAAEEQIELAARRGSELVGLPENFAFMGDDAARLEQAPALADQCSRFLVTMARRYQLVVLGGGYPVPSGDGATTFNRAELVGRDGQLLARYDKIHLFDVDLPDGVPYRESTTVTPGRELPPVVDVPGLCRVGLSICYDVRFPELYRHLVGSGAEVLMIPAAFTAYTGKDHWQVLLQARAIENTAYVVAPAQTGMHDGRRQTHGHAMVIDPWGTVMADAGVSSGAAIAPVDTTHLQRIRRQMPSLQHRQPALF

SEQ ID NO: 5127 - protein, 559 aa, Ostreococcus tauri
MSVASTSAAAKGRTLVWFRKALRVHDNPALSRGTLHATACQPVFVLDPWFCQPSRVGANRMRFLLQSLRDLDAQLRARGSSLLVLHGEPRVVLPRACKKWRVDSVTWEHDIEPYAKIRDAAVRGALERAGVECHAASGHTLYDVDEMLEKCKGAPPTTYQGFFKIVDKMGAPNAPIDAMEKMPGSFASSDEETKALVQGVADAYGIPTLEDLGYEPLGDDEGFPGVGGETEGLRRLRLMLARKEWIGQFEKPSTNPTTRFHGLSQSGKTKPKSPFEIAAGRSKDGDASTSGAEALMIPSTTALSPYMKFGCVSPRVFYHELTAVYKELEGKHSKPPTSLMGQLMWREFYYLVAAGTKNFDKMEGNAICRQIPWKKDRELFAAWENAQTGFPWIDAAMTQLRREGWLHHLARHAVACFLTRGDLFIHWEWGRDAFDRDLVDADWALNNGNWMWLSCSAFFYQYFRVYSPIAFAKKYDKDGQYVRHYLPVLKNMPSKYVYEPWLAPLDVQKKAGCVVGVDYPAPIVDHSAASKRCVDDIATAYAAHKDANAVAGKKRKASD

SEQ ID NO: 5128 - protein, 548 aa, Ostreococcus tauri
TRVFASKRYEPENAEADERASVEMAVRGVELVRTRGFLLFEPSEVRIDVAARDGYFGTLMPFVHAAERTCGDPGKPKPAPVDVRMVDLGTESDHEWEQIGLEDLGVAPASDRRVDWSAGIRADWDISEGGAVETWSQFTAVGLDRFEAEHGRADPEAGVTVSRLSPYLRFGMISPRTVYHDLVKKDGKNISKTFWHRLYRRELAYWQLHHWPDLPKTSVRSHYENRAWLSGDEADEALRRWQRGETGFPVVDCGMRRLWRTGWMHQTERMITATFLVDYLGVHWTRGADWFMRTLVDADEAINSMMWQNAGKSGLDQWDFFEGTLAPDGSARAHDPHGDAIARWIPELAALPRGYLRHRPWEASKATLAECDVELGSTYPRRMIVDLDRARQRMLDDVTTIRHAELVRAGGLVKPGSMEDLVVAPRAAVVRGAADLARVSTRKEFKRSLKALKASIAGIDLPSNPSSKPHGKSRANASRPKVSAASRPKSGPRSGRLPAPDRDAVRASRREAKRLDAAFRGRVFHHLPVDDLDDRDAAPPRVGRRPAR

SEQ ID NO: 5129 - protein, 374 aa, Francisella tularensis
MQQKCYYEILNVSKTASGVEIKRAYRKLAMEYHPDRNPGDKEAEIKFKEISEAYEILSDDSKRSRYDQFGHAGVNQQSGFGGTGGFGGFEDIFDTFFGGGTSRGSNRSRASRGSDLEYTLEITLEEAFFGVEKEITIPRMESCDSCDGTGSKSRSKTTCHACHGQGTIRRQQGFFAFEQTCPVCNGTGYSITDPCDACYGNGKVKKQKTLKVKIPEGVDNGDRIRLQGEGDSGSNGAMNGDLYVQIIIKEHKIFERRDINLYCEMPISFTKACLGGDIKVPTLDGEVVLKVVPETQTGKVFRLREKGMKSLRGHRRGDLLCKVVVETPVNLSAEQKELLEKFADSLGEDYQSKHAPKSKTWFDNVKDYAKKFFE

SEQ ID NO: 5130 - protein, 478 aa, Rhizobium etli
MSPKTEQLSVFPAFFRVEGQKTAVFGNGDELSAKVRLLLNTRARIVAYADRPEADYHAFLIANRIETVRAGFAAEQVEGAALVFAATGNEADDRDIVDAARAARIPANAVDQPDYCDFFTPALVNRAPVAVAIGTEGRGPVLAQMIRAQVDQILSPSLGRLAALATSFRKSVEQFVPRGVSRRFWRRFFSGPVADAVANGNPAQARHAADRLLGSMDKVAGHVWLVGAGPGAEDLLTLRAQRVMMEAEVIVYDALVPQAIVDMGRRDAERLSVGKRKGCHSKSQEEINELLVELGRQGKRVVRLKSGDPLVYGRAGEEMAALRAAGITYEVVPGITSAFAPAADFELPLTLRRVASSLVFTTGHDLTGDVLPDWASLAVSGATIAVYMGRTVAASVAERLMQAGIPAETTVAVIENASRADRRLLHGTLADLPDLQHRDELTGPVMVIIGDAVAGRQFRTVRAAGARRTPGSREFARS

SEQ ID NO: 5131 - protein, 363 aa, Prochlorococcus marinus
MIENSSETIKEISDDKEIENSTVKENTSETPKIEDLSFESKDIPSADSSSSRRNSDLDSAGFTQEDFASLLGKYDYNFKPGDLVNGTVFALEPKGAMIDIGAKTAAFMPMQEVSINRVEGLSDVLQPSESREFFIMSEENEDGQLALSIRRIEYQRAWERVRQLQKEDATIYSEVFATNRGGALVRVEGLRGFIPGSHISARKIKEDLEGEYLPLKFLEVDEERNRLVLSHRRALVEKKMNRLEVGEVVVGSVKGIKPYGAFIDIGGVSGLLHISEISHEHIETPHNVLNVTDQMKVMIIDLDSERGRISLSTKALEPEPGDMLTDPQKVFDKAEEMAAKYKQMLLEQTDENDEQTADIPESE

SEQ ID NO: 5132 - protein, 334 aa, Hordeum vulgare
MASQGVASMFTLALLLGAFASIPPSVESIGVCYGMSANNLPAASTVVSMFKSNGIKSMRLYAPNQAALQAVGGTGINVVVGAPNDVLSNLAASPAAAASWVKSNIQAYPKVSFRYVCVGNEVAGGATRNLVPAMKNVHGALVAAGLGHIKVTTSVSQAILGVFSPPSAGSFTGEAAAFMGPVVQFLARTNAPLMANIYPYLAWAYNPSAMDMGYALFNASGTVVRDGAYGYQNLFDTTVDAFYTAMGKHGGSSVKLVVSESGWPSGGGTAATPANARFYNQHLINHVGRGTPRHPGAIETYIFAMFNENQKDSGVEQNWGLFYPNMQHVYPINF

SEQ ID NO: 5133 - protein, 876 aa, Dunaliella tertiolecta
MLTNGHGVHQNGHQNGTGATLPGAVPSFAHTVLGAPYEPPLSPEDPDWTLHVPTADLDAKDKGTADAWIPRDPRILRLTGRHPLNCEPPMHDLMAAGFITPPSIHYVRNHGPAPRIRWEEHRLQINGLVERPMTLTMDEIVAMPSVTIPVTMVCAGNRRKEENMHKKSIGFNWGPCAVSTSYWTGVKLSDLLKHVGAKGPKEGGKHVCFVGPQGELPAGDGTYGTSMPMGKAMDPANDVLIAYKQNGRWLNVDHGFPVRTIIPGYIGGRTIKWLCTIKVQEQESSNHYHYMDNRVLPSHVDQELANKEGWWYKPEYIINDLNINSAIARPWHDEVVMLKDSNQPYTVKGYAYAGGGHKIIRCEISLDGGKSWRLANIRRFAEPNEYGKHWCWVHWDIEVSVFDFFVFKEMLLRAWDETQNTQPALLTWNVMGMMNNCHFRVLLHPFKDQRGEIGVRFQHPAPVEVGELGNIGWREEDNLRQQALEAAGITTKEGPLPPIKELAAVPKAAAAAPKPPPGSAKEFTMEEVAEHTSPESAWFVHEGKVYDATPFLEDHPGGPDSILIATGADATEDFNAIHSKKAKNMLKDYYIGELVASKGAAAEPKAENGAGTRSLITLNPREKVPLKLAERIEVSHNTRIFRFALPSPKHILGLPTGRHLFVYAQIHGEVVARAYTPISCDDDVGRLDLLIKVYGPNVHPAFPQGGKMSQHLDSPKIGDEIMVKGPVGHFTYEGKGKYVNGKNKGVAKQMSMLAGGTGITPILQVLEAVLKDKEDPTCMSLIYANNSFDDILVKDRLDAYAKENPNRFKVWYVLARPPENWPFTKGHVTEALMRERFFDASPQTLGMMCGPPGLLNFVAVPGFEKMGYSKENQVSF

SEQ ID NO: 5134 - protein, 539 aa, Streptococcus pyogenes
MKFTEFNLSQDIQSAVVTAGFEKASPIQEMTIPLALEGKDVIGQAQTGTGKTAAFGLPTLNKIRTNENIIQALVIAPTRELAVQSQEELFRFGREKGVKVRSVYGGSSIEKQIKALKSGAHIVVGTPGRLLDLIKRKALILDHVETLILDEADEMLNMGFLEDIEAIISRVPADRQTLLFSATMPAPIKQIGVKFMKDPEHVQIKNKELTNVNVDQYYVRVKEQEKFDTMTRLMDVNQPELSIVFGRTKRRVDEITRGLKLRGFRAEGIHGDLDQNKRLRVIRDFKNDQIDILVATDVAARGLDISGVTHVYNYDITQDPESYVHRIGRTGRAGKSGESITFVSPNEMGYLSMIENLTKKQMKPLRPATAEEAFQAKKKVALKKIERDFADETIRSNFDKFKGDAVQLAAEFTPEELALYILSLTVQDPDSLPEVEIAREKPLPFKYVGGGHGNKNGKGGRGRDNRNRGDRRGGYRGDRNRDERDGDRRRQKRDKRDGHDGSGNRDFKRKSKRNSKDFFNKEKKSSAKNTGFVIRHKGE

SEQ ID NO: 5135 - protein, 182 aa, Desulfotalea psychrophila
MNTLKNQTLPLRIIMKRDFYQFSATNLQGQKIAMKEYRGKVMLVVNTASKCALSSQLRGLEILYKKYAPLGFVVLGFPCNQFTPQESRDAQNIAEEYLLNYGASFPLFTKTEVVGKGAHPLFSYLENRLEGIMGPDIKWNFTKFLIDHRGDPVKRFAPITAPAIIAPDIEILLSAQSTAGEQ

SEQ ID NO: 5136 - protein, 434 aa, Crocosphaera watsonii
MIVNSSQSLLLKETAEKTSQAARKLGGLSTGDRNQAIEAIATALENASADIIKANEIDCEIAEKEGISRPLYNRLKLGKTKLEATIKGVRDVINLSDPVGHISIHRELDEGLILKRLSCPLGVLGIIFEARPEALIQITSLAIKSGNGVILKGGKEALNSCKTLVKIIREALSKTKVSPDTVQLLTTREEIRNLLELDEYIDLIIPRGSNEFVRFIQQNTNIPVLGHADGICHLYVDKEAELDTAIAVAVDAKTQYPAACNAIETLLIHQDIAREFLPKIAQGLTSHEVQLKGDQLTQTYLDIEAATEEDWKTEYSDLILSIKVVDSLEAAINHINTYGSKHTDAIITEDKNSAEIFMNQVDAAGVYHNCSTRFADGFRYGFGAEVGISTQKMPPRGPVGLEGLVTYKYQVIGNGHIAATYAGENAKPFTHKDV

SEQ ID NO: 5137 - protein, 591 aa, Oryza sativa
MCGILAVLGAADWLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASAKPTPYHANANANGNSNGKANGNCAMAANGTNGVGLVVANGTANGKMEA

SEQ ID NO: 5138 - protein, 620 aa, Aspergillus fumigatus
MTLAQNHYVIQLPVTPITIGAVNPRDIAQQWLTNLEIQLGTSPVPELKLKLSELFHEDSWWRDMLALDWDFHTIHTVSEIEQYISRNQPRARLTSFRLQHDGRFQPKIETPVEGLRWISSMFFFESRVGRGTGVLRLTQDEAGVWKAYSLYTSLQELRGFEESVGVRRPKGTIESMPGNTSKENWLERRRGQLEFKNEEPTALLVGQAGLNMAARLQALGISCLVVDRNERIGDNWRKRYRTLVTHDPVEFTHMAYLPFPRNWPQFTPKDKLADWFEAYASIMELNVWLKTNVKSAEYDDSTAQWTVTVVRVDTGSERVLHPRHIVWCTGHSGEPKIPTFPNQAHFKGTIYHGSQHHDASDYDVKGKKVVVVGTGNSGHDIAQNFYENGADVTMLQRRGTYVITAAKGVLMQHEGLHEENGPSTEEADIISESLPYPVKFALDVHFTKRAYEAEKDILNGLKAAGFELDFGVDGAGISRAYMTRGGGYYIDVGCSQLIADGKIKIKRSPEGIAGFNDRGLLLRDGSALDADIVVLATGYDNMRTTVRKILGNRVADRCKDVWDLDEEGEVNAMWRPSGHPGFWFMGGNLALCRIYSKFLALQIKAIEVGLASQDTVHAKL

SEQ ID NO: 5139 - protein, 88 aa, Oryza sativa
MSGRRASGRITDDEINELISKLQSLLPESSRRRGATSRSPATKLLKEMCSYIKSLHREVDDLSERLSELMATMDSNSPQADIIRSLLR

SEQ ID NO: 5140 - protein, 389 aa, Dechloromonas aromatica
MADTQTKLSKTFSNFFASEKTSGILLILCTILSLSIANSLAGPAYQGFWHAIVAGLSIEHWVNDALMAVFFLFVGLELERELYNGELSNFRNALLPIFAAIGGIGVPALIHYTLNVGTPTQAGTGIPMATDIAFALGVLALLGSRVPASLKVFLTALAVMDDLGAIIVIAMFYTQQFSLVYLLSALAVFGLLLVLNRIFRVMSLLPYLLGGALMWFLMLKSGVHATIAGVLLAFAIPFSAKADDEKSPSHRLEHFLHKPVAFIILPIFALANTGIVIGSEWQHELLTPNSLGIIGGLVFGKPLGIALLSFVTVAIGVCRLPDDLKWTHIVGAGILGGIGFTMSIFITNLAFTNNASIINASKMAILMASVAAGGLGFLWLSFFQQNDNQ

SEQ ID NO: 5141 - protein, 246 aa, Triticum aestivum
MVSADVARNIVGIIGNVISFGLFLSPVPTFWRICKAKNVEEFKPDPYLATLMNCLLWFFYGLPIVHPNSTLVLTINGIGLVIEGAYIIIFIIYAAKNTRWKMLGVLAIQAAFMAAVVAGVLVGAHTHEKRSMIVGILCVIFGSIMYASPLTIMGKVIRTKSVEYMPFFLSLVNFLNGLCWTGYALIKFDIYITIPNALGTIFGLIQLILYGYYYRSTPKKGKNVELPTVLTKNAVTSGNVSVTIEK

SEQ ID NO: 5142 - protein, 316 aa, Francisella tularensis
MANHHKLIILGSGPAGYTAAIYAARANLKPVIITGMQPGGQLTTTTDVDNWPGEPDGIIGPELMEKLQKQAERFDTQIVYDTINAVDLQNKPFKLVGEVEQYTCDTLIIATGATAKYLGLESEEKFMGKGVSACATCDGFFYKNKDVAVVGGGNTAVEEALFLSNIAKSVTLIHRRDTLRSEKILIDKLMEKAQHGNINIIWNTTLEEVLGDDMGVNALRIKNIKTNEESQIDVAGVFIAIGHTPNTSIFAGQLEMENGYIKVKSGLAGDATQTNIKGVFAAGDVADHVYKQAVTSAGTGCMAALDAEKYLDNLDQ

SEQ ID NO: 5143 - protein, 134 aa, Mycobacterium tuberculosis
MEGMDQMPKSFYDAVGGAKTFDAIVSRFYAQVAEDEVLRRVYPEDDLAGAEERLRMFLEQYWGGPRTYSEQRGHPRLRMRHAPFRISLIERDAWLRCMHTAVASIDSETLDDEHRRELLDYLEMAAHSLVNSPF

SEQ ID NO: 5144 - protein, 319 aa, Buchnera aphidicola
MELKNHKKIIILGSGPAGYTAAIYSSRANLNPLLITGINKGGQLMNTNEIENWPGDFKKITGPELMNRMHEHSLKFKTEIVYDNIISVEFKKKPFFLLGEYNKYTCDAVIIATGANPRYLGLSSENKFKGKGISTCAVCDGFFYKNKEIAVVGGGNTAIEETLYLSNFVKKIYLIHRRNNFKAEKILIDRLLKIVKTKKVILHLNSTIEDILGNNKGVTHLLIKNKNLKEKKKLKIAVSGLFVAIGYIPNTDIFTDQLKMKDGYIKIKKGTHGNYTQTNIPGVFAAGDVIDHVYRQAITSSASGCMAALDSERYLNSLS

SEQ ID NO: 5145 - protein, 546 aa, Mycobacterium tuberculosis
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTTDVVPNHTSSAHPWFQAALADLPGSPARDRYFFRDGRGPDGSLPPNNWESVFGGPAWTRVREPDGNPGQWYLHLFDTEQPDLNWDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 5146 - protein, 72 aa, Buchnera aphidicola
MTKEDNIEMQGIVIDTLPNTMFRVELENKHVITAHISGKMRKNYIRILTGDKVTIELTPYDLTKGRIIFRSR

SEQ ID NO: 5147 - protein, 230 aa, Glycine max
MAGGDDLKLLGAWPSPFVTRVKLTLALKDLSYEDVEEDLYKKSELLLKSNPVHKKIPVLIHNGAPVCESMIILQYIDEVFAGSGPSLLPADPYECAIARFWMAYVDDKLVAPWRQWLRGKTEEEKSEGKKQAFAAVEILEGALRECSKGGGFFGGDGLGLVDVALGGVLSWMKVIEVLSGDKIFDAAKTPLLAAWVERFSELDAAKVALPDVGRLLEFAKAREAAAAPSN

SEQ ID NO: 5148 - protein, 124 aa, Unknown
  Synechococcus sp. PCC 7002
MASLYEKLGGAAAVDLAVEKFYGKVLADERVNRFFVNTDMAKQKQHQKDFMTYAFGGTDRFPGRSMRAAHQDLVENAGLTDVHFDAIAENLVLTLQELNVSQDLIDEVVTIVGSVQHRNDVLNR

SEQ ID NO: 5149 - protein, 244 aa, Unknown
  Oncidium Gower Ramsey
FDGDGMLHAVRFRDGRASYACRFTETERLRQERALGRAIFPKAIGELHGHSGIARLLLFYARGAFGLLDPSRGVGNANAGLIFFNNRLLAMSEDDLPYHVRVTKSGDLETIGRYDFDGQLESSMIAHPKIDPETGEMFVLSYDVIKKPFLKYFSFSASGEKSAEVAIKLDEPTMTHDFAITENFVVVPNQQVVFKLQEMIGGGSPVVYDKEKTARFGLLPKRAVDGSEIIWVDVPDCFCFHLWN

SEQ ID NO: 5150 - protein, 112 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWDSLVFEFELEHGFGPWTEP

SEQ ID NO: 5151 - protein, 272 aa, Mesorhizobium loti
MSGTSKNNGGNATLEQALARLNFKPRPLEPGHVWLAGAGPGDPGCLTLEVLAALAEADALVYDALVSPDVVAVAANAELFFAGKRGGQPSMKQDDITALLVRLARQGRRVIRLKGGDPYIFGRGGEEALALARENIPFRVLPGLTSGLSALAATGIPATMRGINKAVILATGHAAGTDDDIDWAAIARTGQPVVVYMGMANLPLIAAALLDGGLSPSTPAAVIVAATTPQERTVVATLATIAEEAAAAGLTSPALIVVGGIVAMRAALTRQA

SEQ ID NO: 5152 - protein, 246 aa, Unknown
  Oncidium Gower Ramsey
FDGDGMVHAVHLRNGRASYACRFTETERLKQERAVGRAIFPKAIGELHGHSGIARLLLFYARGLLGLIDHSRGTGVANAGLIYFNNRLLAMSEDDLPYHVRIKPNGDLETAGRYDFDGQLTTTMIAHPKLDPETREFFALSYDVIKKPYLKYFRFSPCGEKSPDVEIPLPQPTMMHDFAITKNFVIIPDQQVVFKLQEMICGGSPVVYDKEKIARFGVLPKYAIDASEMQWIDVPDCFCFHLWNAW

SEQ ID NO: 5153 - protein, 362 aa, Arabidopsis thaliana
MAMSAIGFEGYEKRLEVTFFEPGLFLDTQGKGLRALAKSQIDEILQPAECTIVSSLSNDQLDSYVLSESSLFIFPYKIVIKTCGTTKLLLSIEPLLRLAGELSLDVKAVRYTRGSFLCPGGQPFPHRNFSEEVSVLDGHFAKLGLSSVAYLMGNDDETKKWHVYSASSANSNNKNNVYTLEMCMTGLDKDKASVFYKNESSSAGSMTDNSGIRKILPQSQICDFEFEPCGYSMNSIEGDAISTIHVTPEDGFSYASFEAVGYDFTTMDLSHLVSKVLTCFKPKQFSVAVHSTVAQKSYDSGLSVDLDDYGCKESTMESLGEERGTVMYQRFEKLGRYCGSPRSTLKCEWSSNSSCNSEDEKE

SEQ ID NO: 5154 - protein, 316 aa, Unknown
  Synechococcus sp. WH 7805
MAIAPNITTLVGRTPMVRLNRLPQAWGCTADIVAKLESFNPTASVKDRIAGAMVEAAENDGTIAAERTVLVEPTSGNTGIALAMVAAARGYRLILTMPDTMSTERRAMLRAYGAELQLTPGEQGMQGAIERARELVQEIPGAYLLQQFDNPANPAVHAASTAEEIWADTDGALDGLVAGVGTGGTITGCARVLKSRLPKLRVVAVEPAASPVLGGGVAGPHRLQGIGAGFIPPVLDMDLIDEVIAVSDDEAMEVGRRLAREEGLLCGVSSGAVVAAALQIGQRPVMEGRRIVVILASFGERYLSTPMFSAAGDPDA

SEQ ID NO: 5155 - protein, 242 aa, Unknown
  Oncidium Gower Ramsey
FDGDGMIHAVRFRRGRTSYACRFTETERLRQERLLGRAVFPKAIGELHGHSGIARLLLFYARGAFGLLDPSRGVGNANAGLVFFNNRLLAMSEDDLPYHVRVTKTGDLETIGRYDFNGQLKSSMIAHPKLDPKTGEMFVLSYDIIKKPFLKYFSFSASGEKSADVAIHLDGPTMTHDFAVTENFVVVPNQQVVFKLQEMIAGGSPVVYDKEKTARFGLLPKRAVDGSEIVWVDVPDCFCFHL

SEQ ID NO: 5156 - protein, 72 aa, Hyphomonas neptunium
MSKEELIEFEGTVVELLPNATFRVKLENDHEIIAHTAGKMRKNRIRVLTGDKVMVEMTPYDLTKGRITYRFK

SEQ ID NO: 5157 - protein, 340 aa, Candida glabrata
MHSHHSHSGDYVAHGVDPLDDIVAQAVAMRFHTYCLTEHMPRVNSKYLYPEERQEDMSPDPNIGELGLKVLKEKFLSYLEHSRSIRAKYSGGDCKTKFLVGCELECCDVEHIEYSKYLLRTYGDDLKFTVGSIHHIRGIPIDFDPHSWNEAFDSCDKNIVKFLSSYFDMQHAMITELQPIIIGHFDLYKLLLPDEMFVHPATGDCSDDPQVDFVPITSISLVKTFPILREKIIRNLKAIDSYGGAIEINTAGFRKGLCEPYPGPEICELAKQYCGSRFVLSDDAHAVSHVGTCYKQALDYITNTIKIEALYHLEETSDGSVKLVKEDMASVSENSFWKQF

SEQ ID NO: 5158 - protein, 161 aa, Brassica napus
MGEIVFTEKQEALVKESWEILKQDIPKYSLHFFSQILEIAPAAKDMFSFLRDTDEVPHNNPKLKAHAVKVFKMTCETAIQLREKGKVVVADTTLQYLGSVHLKSGVLDPHFEVVKEALVRTLKEGLGEKYNEEVEGAWSKAYDHLALAIKAEMKQEDSQKP

SEQ ID NO: 5159 - protein, 756 aa, Rubrobacter xylanophilus
MARSTKKNMEKVRKGWDPSLWAGLKPFGIGEERPNNYAEILRAVWENKDEALYAWRILSRGVCDGCALGVAGLHDWTMDGVHLCNIRLRLLRLNTMPALDTRLLADLASLKQKKSAELKELGRLPYPMIRRRGERGFTRISWERALDEIAGRIRATSPRRTGYYMTSRGEPNENYYVAQKAVRAMGTNSIDNAARICHSPSTVSLKATIGAGATTCSYSDWIGTDLLVFIGSNPANNQPVTTKYMYYAKKAGTKIAVINSYREPGMERYWIPSNLESALFGTKISDRTFLVNVGGDVAFLNGTLKHMIENGWLDRGFIERHTAGFKQMRAALEEQSWEDLERLSGASREEMREFARMVGEASTAVFVWSMGITQHEFGEDNVRAIINLGLTKGFVGRDNCGLMPIRGHSGVQGGAEMGAYSTAFPGGLPVNPENARKLGELYGFEVPSEPGLTTPRMIDAAHDGELDVLVSLGGNFLEVLPDPDYVREALARVPLRVHVDIVLSNQMLIDPADTVILLPAATRYEIPGGVTQTSTERRIMYSPEIPGRRIGEARPEWEIFMELAKRVRPELADKLHFDGTQEIREEIARVVPMYDGIQHLRKSGDQVQYGGPHLCAGWKFDTPDGKAHFSAIALPETGIPEGMFVVTTRRGKQFNSMIHEEKDALTGAVREAVLMSEEDARGLGLANGERVVLRSEAGEFEGRVHIAPIKPRTLQVHWPEGNVLIDRRHRSAVADIPDYNALVRVERAGEREPAAV

SEQ ID NO: 5160 - protein, 295 aa, Bacillus halodurans
MYGLIVNKASGNGKGQRTWKKVEYELQIRNTPYLVRFTSGSGHATTIVKELLTEGVKTIIAVGGDGTINEVANGLVNHRVPLGIIPAGSGNDFARCLNIPMHYEKALHRIFENKQKKVDLLHLGQRHCLTVTGIGFDGKIAKTVNEAIYKNWFNQFGFGGLSYVLSMLEVLKDYRPTNIQITVDGKELFFSGVWLVAVANSPNYGGGIRICPEASYDDGLLNICVVHGMSKWQLLRLFPKAYKGKHVVMEQHVTLLTGKDVYVQSDTPVLVQSDGEPIMESPVRLQIKKGALSVV

SEQ ID NO: 5161 - protein, 377 aa, Desulfitobacterium hafniense
MKRDYYEVLGVSKSADEQEIKKAYRKLARQYHPDVNPGDKDAEEKFKEATEAYDVLSDTEKRARYDQMGHSAFDPNQQGFGGFGGDFGGFGDIFDMFFGGGGGGGQRRQGPTRGNDLRYDLTITFEEAAFGTEKEIQVPRQETCTECHGSGSAPGTHPTTCSQCHGTGQVKATQRTPFGAIQTARTCPACNGSGQFISSPCKECSGKGTTRKVKTIKVTVPPGSEDGLNLRFSGNGEAGLRGGPSGDLYVVLNVKAHKFFEREGNDVYCEIPITFVQAALGSELDVPTLDGKVKMKIPEGTQTATVFRLRGHGIPYRRGNGRGDQHVRVVVATPTKLTDRQKELLREFGEVTSDQQQMGKKSFFEKVKENIRDAIDL

SEQ ID NO: 5162 - protein, 579 aa, Unknown
  Synechococcus sp. WH 5701
MTVATAAPPRLSLQSAEIGADTTTIRSLDWERSRFDIEFGLRNGTTYNSFLVRGERTALIDTSHLKFADTWLPLLEEQIDPLAIDHLIVSHTEPDHSGLIGHLLERNPEIEIVASKVAIQFLADQVHRPFRSRAVKSGEELDLGVNPSSGVQHRFEFLSAPNLHWPDTIFSFDHGTGILFTCDAFGLHYCGDDIFDVDPGAIAPDFRFYYDCLMGPNARSVLQALKRMDALPPIRMIATGHGPLLRDHLGLWTGDYRDWSSQRSAGETYAAVCYVSQYGFCDRLSQAIARGIGKAEAQVQLVDLRATDAQELAALVGEASAVVVPTWPAKADPELQQSIGTLLAALKPKQWVAVYDAYGGNDQPIDSVAAQLRSVGQKEAFEPLRIRQVPDGNDYQRCEEAGTDLGQLLTRARTIAAMKSLDGDLDKALGRLSGGLYIVTARQGERSSAMVASWVSQASFDPPGLSIAVAKDRAIEALMQVGDRFVLNVLREDNHQELLRHFLKRFPPGADRFSGVSTLDGVSAGGPVLGDALAFLGCRVVQRMEGPDHWIIYAEVEEGTVADSEATTAVHHRKVGNHY

SEQ ID NO: 5163 - protein, 402 aa, Unknown
  Sulfitobacter sp. EE-36
MGHVVVIGAGQAGSSCVAKLRNSGFEGKITLIGAETVPPYQRPPLSKAYLLGDMALERLYLRPESFYADHGIDLMLGTTVDSIDPAAQTVRVNGGDMAYDDLVLTTGSFPRRLPAHIGGDLAGVHVVRDLSDVDTMGPRFTKGARVLIVGGGYIGLEAASVAAKLGLQVTLVEMGDRILQRVAAPQTSDFIRALHEAHGVTIREGVGLERLTGDTHVTGAELSDGTTLDVDFVIVGVGIGAATALADAAGIVNDNGIMTDSHGRTSAPHVWAAGDCASFPYRGGRIRLESVPNAIDQAELVAENIMGADKEYVAKPWFWSDQYDVKLQIAGLNMGYDRVITRHADADSVAFWYYRGDELLAVDAMNDPRGFMIGRRLIEAGKSPAPALIEDPNTDLKALLKS

SEQ ID NO: 5164 - protein, 531 aa, Rubrobacter xylanophilus
MSESIRPSGTYRTLAEQREVLTPAEERFERARQTIGLFLGPIVFLVMYLAPLPLEPNQQTLAAILSFTIVYWLSEAIPIPATAVLALALCVVLNVPGVGVNAEDSPGDIVYGAFGSDTIFLFIGAFIIAQAMITHGLDRRFAFRILSLPGVSRSTYGVIVAFGFIAAAISAFISNTATAAMLLPIGLGMMGALGGFVKEQSGTERDISRLRFGTALMLMISYGAGVGGLLTPIGTPPNLIGIGFIEEETDTTITFFSWVVAAFPVCLLMFIALCVILILLNRPEVRRLSGAEEYVAEQRRSLGPLSRGERNTLIAFATAVFLWMLPGFVALVLGEESRLYSLILSRLDEGTVAILAAALLFVLPVDWSERRFTLNWNEAVRIDWGTIVLFGSGIVLGTLLSDTGLAEVMGTGIAEALGFSSLLAISAVSALIAILISETTSNTASATIVVPIVIPIAAAAGVNPVIPALCAVFGASFGFMMPVSTPQNAVVYGSGLIPITKMVRSGIAFDIIGLILIVLLIPVMARLVGFV

SEQ ID NO: 5165 - protein, 417 aa, Idiomarina loihiensis
MSQQLAKEISQRAAKAARAVATLSETDKNAVLQKMADAIRARQDKIIEVNKKDLATGKEKGLSDAMMDRLELTPERVEGMASAIEEIIALKDPVGDSYVLDERPNGMKIEKMRIPLGVICMIYEARPNVTADAGALCFKSGNAVILRCGREAIESSKAIAEALHEALEASNLPKDVITVVPTPDRELMTELLQQKDYIDLVIPRGGEGLIHFVSDTSKIPVIQHYKGVCHLYVDKDADLDKALAILLNGKTQRTGVCNALEGLLVHQDVADKFLPMAAKALAEKDVTIHADKRSVSYFDGADEIADDAFGEEYLALEIAVRTVDNYEGAIEHIQEFGSGHTEVIITENDETAKRFIREVDSAVTMANVSSRFSDGGQLGLGAEIGISTSKLHAYGPMGLEALTTEKFVVTGNGQVRD

SEQ ID NO: 5166 - protein, 376 aa, Streptococcus pneumoniae
MNNRSETMKYKRIVFKVGTSSLTNEDGSLSRSKVKDITQQLAMLHEAGHELILVSSGAIAAGFGALGFKKRPTKIADKQASAAVGQGLLLEEYTTNLLLRQIVSAQILLTQDDFVDKRRYKNAHQALSVLLNRGAIPIINENDSVVIDELKVGDNDTLSAQVAAMVQADLLVFLTDVDGLYTGNPNSDPRAKRLERIETINREIIDMAGGAGSSNGTGGMLTKIKAATIATESGVPVYICSSLKSDSMIEAAEETEDGSYFVAQEKGLRTQKQWLAFYAQSQGSIWVDKGAAEALSQYGKSLLLSGIVEAEGVFSYGDIVTVFDKESGKSLGKGRVQFGASALEDMLRSQKAKGVLIYRDDWISITPEIQLLFTEF

SEQ ID NO: 5167 - protein, 491 aa, Unknown
  Rhodococcus sp. RHA1
MGGEVHRCRVLVIGTGFSGLGTAIQLRRRGRDDFILLEKAREVGGTWRENTYPGCACDVPSHLYSFSFEPNPDWTRMWSGQEEIFDYLRGLADKYDLRRNIHFGRTMTGGHWDAERRRWHVHTESGDEYVAQFVVSGIGALHIPNVPDLPGADTFDGTEFHSARWNHDYDLRGKKVAVIGTGASAVQFVPEIVGDVAELHLYQRTPPWVIPGLNFGIPPEARRLFGRVPLARRMVRAAVYWTYESLALGFNGHSRLMRPIESMARKNLNRTVADPELRRKLTPSYRIGCKRILGSDVYYPALISPKTVVITEGIAEVRPHSIVAGDGAERVVDAIIYATGFHVTDGFDNVELTGVGGRRLADEWEEHGIRTHLGITVAGYPNAFFLFGPNTGLGHNSVVFMIESQIRYALELMDLVDRRGADSAAVRPAVQSGFNADIQRKLARGVWSTGGCVSWYLDSHGVNRTIWPGSTVRYWQRTRSVEPADFEFTPG

SEQ ID NO: 5168 - protein, 1486 aa, Mougeotia scalaris
MSSRPGHVRNDIRPIRGPSRLSAQANLAAERQDAADAFIQSNYEKAAAGKGEFNYKGLLTTMDGRKPWEVDQMAYLAKMRRSGLGQPYGAMIVVEPPLRHAPKLHLLAYSENVAELLGVDPKEVGLGKNAIGFFSDSSGMVLYREASSRNSFQQPLVLHLRNKPVDFYAILHRGPEGILIDLEPVFPEDKSLSVATLRGISGDRDPTAAITMTEAKESVSGAIRRLQNLPSGSVLSMCQAVVEEVRDLLQYDRVMVYKFHPDQHGEVFAESVRDDMEPFLGLHYPSTDLPQAIRMLLMRVGSRMICDASRPMVKIVQPEVEEKSVDLSESTLRAPHGCHVQYMCNMGSMASITTAIMADERKDDLDPHESSKNKRLWGLIVGHHCGARYTPYPMRKAIEHLAQQFGLLLDREISLAANFHEENILNMQKKLCDMLESNIPLGIVKNSPSIMDLVKCDGAALLFADRFWLLGATPTERQVFDIAEWILKAHGKRSALCTDSLAEAGFPGAADLGEKTCGLVAIKIGPQDFVFWFRSHTAKEVRWGGRRQVQGEIDDDNKLMPRNSFQAFLDVVKKRCLPWEDIELEAINGLRLLLNETLENSRSDAVSNLEGGTDVDGNAMTTRVLLTAQRSIPKPVSALTEEVEVVLACFKTSFLVTDATKEDYPVIFCSEAFSLLSGYKAEDLLGGSCRKLEGYETDELEVSRFLEALEAGSQYSGRQLHYKSDGSPFWDLVTSAAVQDEFDNVVNHVIVYQEVAKYAEGQLPQGKPSIAMASPSTEKGFPVSLIRYDGRLKEKSTRKVNEIVQAMKNPSRAKVDGPLTPGRQGGIAEELKIPMPASPDFSRPQVRHGSIDHSKPSVKPARRRSVVDILMGKPKEEAEAARRGAVSTEEPKVSMDGSDSGKKRRAAKGIDFGTTLERIEYSFLVTDPRLDENPIIFMSDEYIRLTAYTREEHIGGELIYLDGDNTSTSDVRKIRSAAQNNKELSMQFLAYKKNGDTFWALYHFSMVKDSDGTVLYIVNVVKDLGKSMVDDAAFKKAVAKAEKEASSVAEALRDLPDAASEERQWTIHSRAVLPKPHKVEDPAWAAIKKVRAEEGRLGLKHFKPIKPLGNGDSGSVMLVELRGTGQLFAVKVMEKESMIERNKVHRVASEREILDNLDHPFLPTLYASFQTAKHVCFVTDFCPGGELYDFLEVQPGHRFEEKVAQFYAAEILLALEYLHCKGVVYRDLKPENILLTNGGHVVLTDFDLSVLSSTFPKVLRDTKGKRGRSRRPSKEPHPTFVAEPVTRSNSFVGTEEYIAPEIVTGAGHNSSIDWWSFGILLYEMLFGHTPFCGSSMRKTFSNILNREVFFPPEVNVSAEAKDLITLLLVKDADQRLGSKSGAAEIKVHKFFANIDWPLIRFKATAVPKVPVRLDNTVAPSTNAEGGASLENWRLQEVPSGVESARSSGSYLRDSIGSPYVMGASDSPMLKNPDEEYGKWYSSSSQV

SEQ ID NO: 5169 - protein, 1442 aa, Mougeotia scalaris
MDRTIDISDEKWQSRFAAQSSQAAESQYSSDALLNEKYEMASTHGSFVSYKELMKSSAEAPKPWEVDQIAYLEKMRRSGLTQRFGTMLVVEPPLRHAQKLHLLAHSENAVDLLGIEPRELEIGGDILPFFTSESGKALFSEAASKGDSVKTAIVTGRDGETKFYAICHRNACGVIIDLEPVVPKGIHTSYEPNLDTSSPPLSMEAALDIVQPAIQRLKAIPAGSVQEICDTVTREVRELLQYDRVIVYKFHPDQHGEVFAESAKEGLDPYVGLHYPSTDLPQAIRVLLLRVGIRMICDATQSMVKIIQPDDVEPVDLSDSTLRAPHGCHAQYMINMGSLSSITFAIVVESDKTVRAGEEPEKERTLWGIIVGHHSIPRFTPYPLRKAVQSLAETFGSLLTREIALAASWHEEKTLNMQKKLCDMLEADIPLGIVIDSPNIQDLVKCDGAALFFSGRFWLLGSTPTERQVADLAEWILKHHSKKGAVCTDSLAEAGYPNADELGSKTCGMVAVKVGKRDFVFWFREHTAKVVRWAGQRQKKEEIDDESKMMPRNSFKAFMEIVRKRCLPWEDIELEAINGLRLMLQDALDVSRGADIPVVVGGTTIEGDPFDGAGYHESTSEKPVSAITSEVEAALSAVEACFLITDATQESRPIIYCSHVFSTLTGYSAGELEGGTLEKLEGLETDVAAASKLHLALSGRTQYSGRLLHYKKDGTPFWNLITCGPIKNGQNEVVNFVIVFQELAKYHEISSVPPNLVDGDLSAPEKGFPVSLIRYDGRLKEKSSRIVDEIIRLVKNPATIADSLALLGQMSAMASPSVSQVESVPVVEHRERHSSMHIAKPAATKTSRRRSLVEVLLGKGKEIEAPVKEAFDSDVKSDDGKKRRAAKGIDLGTTLERLDYGFLVIDTRLDECPIIFMSDRYILQTQHTREENIGGDILFLDGEESSPAEVDKIRKAVQNNDELSLQLVAYRKNGDKFWALYHLSVAKDKDGNALYIINVVKDLGEAQISDAAFRKEDAEARKEAAEITRALHDLPDTAAYELWTVHSKFVASKPHRAWDSAWTAIKEVREKEGRLCLKHFKPIKPLGNGDSGSVVLVELRGTGHVFAAKIMEKERMIERNKVHRIASEREILNQLDHPFLPSLYASFQTTKHVCFITNFCPGGELYDFLEIQPYHRFEEHVAQFYAAEILISLEYLHCQGVVYRDLKPENILLAEDGHIVLTDFDLSILSSTFPKLIREANGTSKRKSSRRPSKERAPTFVAEPTMRSNSFVGTEEYISPEIVTGEGHGPSIDWWSFGILIYEMLYGETPFCGSSMNKTFHNILNKEVAFPSPVPVSDMAKDLITSLLIKDSEKRLGSKLGAAEIKVHPFFHGINWPLIRNKKVVPPKVPNKLNSVVGGHEEQDISSNHWRLQDTNNDSNRSFPNMSFDGSIIDATEDRSTW

SEQ ID NO: 5170 - protein, 637 aa, Zea mays
MTSNSSQNMSSCSTGGSDAAVGGGSWLGFSLSPHMAATMDGAADGVPVQHHHHEGLFYPPVVSSSPAPFCYALGGGQDGLATAAANGGGGFYPGLSSMPLKSDGSLCILEALHRSEQERHGVVVSSSSPKLEDFLGASASTAMALSLDSSSFYYGCGHGHGHDQGGYLQPMQCAVMPGSGGHDVYGGGHAQMVDEQSAAAMAASWFSARGNGGYDVDGAGAGAIVPLQGHPHPLALSMSSGTGSQSSSVTMQVGSAHADAVTEYIAMDGSKKRGAGNGASAGQKQPTIHRKTIDTFGQRTSQYRGVTRHRWTGRYEAHLWDNSCRKEGQTRKGRQGGYDVEEKAARAYDLAALKYWGTSTHVNFPVEDYREELEEMKNMTRQEYVAHLRRKSSGFSRGASIYRGVTRHHQHGRWQARIGRVSGNKDLYLGTFSTQEEAAEAYDVAAIKFRGLSAVTNFDITRYDVDKIMESSTLLPGEQVRRRKEGADAAVSEAAAALVQAGNCMTDTWKIQAALPAAARADERGAGQQQRQDLLSSEAFSLLHDIVSVDAAAGTGTGTGGMSNASSSLAPSVSNSREQSPDRGGASLAMLFAKPVAAPKLACPLPLGSWVSPSAVSARPPGVSIAHLPVFAAWTDA

SEQ ID NO: 5171 - protein, 461 aa, Salmonella enterica
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 5172 - protein, 839 aa, Mougeotia scalaris
MAALVNLPISRYPQPLLGEGVDVIHKSEKVLGEASQGLKDALTAFQQTFVMCDATKPNTPVMFASEGFYRMTGYSAKEVIGKNCRFLQGPETDRSEVEKLKQALLDGQSWCGRLLNYRKDGSSFWNLLTVSPVKDDSGRVVKFIGMQVEVSKFTEGKNDDIKRPNQLPVSLIRYDDRQKDEAEVRVEELLQDMKESESPAEVEAKVQTVQVSVPAQPSKLSKEAPAETKKTRRSSYFGKNAAPKAEEVPPVFEPGVEVSLLMEDELDTMAVEKKHRHGIDLATTLERIQKNFVITDPRLPDNPIIFASDDFLELTEYTREEIIGRNCRFLQGKDTDKETVAKIRHAIDNHQDITVQLLNYTKSGKPFWNLFHLQAVRDTKGRLQYFIGVQLDASTYVEQASKNIPDNLKKMGTEEIHNTANNVDFGLKELPDTNTGNKDDIWTLHSKQVTALPHKSNTENWDAIRKVIASEGQISLKNFRPIKPLGYGDTGSVHLVELRDSGVFFAMKAMDKEVMVNRNKVHRACTEREILELLDHPFLPTLYGSFQTPTHVCLITDFCPGGELFAHLENQKQKRLKENVAKVYAAQILMALEYLHLKGVIYRDLKPENILICEGGHLLLTDFDLSFRTETEVKVAMVPIPEEEGAPVVEKKKKKKGKAPAAAAMAPRFIPQLVAEPSGTSNSFVGTEEYIAPEIISGVGHGSQVDWWAFGIFIYEMLYGKTPFRGKNRKRTFTNVLTKELAYPTVPEVSLDVKLLIKDLLNRDPSQRLGATRGASEIKEHPWFNAIQWPLICKDVPESDVPVKFMQVENERRDSTADDDADWESNDGRNSLSLDLGRQ

SEQ ID NO: 5173 - protein, 803 aa, Mougeotia scalaris
MNSPLSPSRAIQTSEGKILEQKSELKDVLTSFHQTFVISDATKPDIPIVFASEGFYEMTGYGPEEVIGYNCRFLQGEGTSRDEVTRLKQCLVEGQPFCGRLLNYRKDGTPFWNLLTVSPVRSATGKVVKFIGMQTEVSKFTEGAADGIKRPNDLPVSLIRYDARQKDEAEVSVTEIVHAVAHPEKAIARLSTAVTESSKKHQQQSVSPEFGAEGLKTPLITINEKEAVDEVEVEEEGRDSFEITGEKKIRRGLDLATTLERIQKNFVITDPRLPENPIIFASDDFLELTEYSREEVIGRNCRFLQGPDTDQDTVQKIRDAIRDCRDVTVQLLNYTKSGKPFWNMFHLQAVKNSKGELQYFIGVQLDASTYIEPKLQPLSESAEKEGTKQVKTTADNVDSSLRELPDPNVSKEDIWGIHSSVAEPKPHQKRGYSSKWDAVLKIKARDGKIGLKHFRPVKPLGCGDTGSVHLVELKDTGKFFAMKAMDKEVMINRNKVHRTCTERQVLGLVDHPFLPTLYASFQTTTHICLITDFCPGGELYMLLDRQPSKRFPEYAARFYAAEILLALEYLHLQGVVYRDLKPENILIGYDGHLMLTDFDLSFVSETVPELVFPPNYNKDKPKSKNKKDREGNLPVLVARPSGTSNSFVGTEEYICPEIISGIGHNSQVDWWSFGIFLYEMLYGKTPFRGRNRQRTFSNALTKQLEFPPTPHISQEAKDLITLLLVKDPSKRLGAIFGANEVKQHPFFRDFDWTLIRCRQPPSLDVPVKFNNHSPQRTSGDEEEMEWDEDENISTSTTVSLDFD

SEQ ID NO: 5174 - protein, 148 aa, Zea mays
  misc_feature (102)..(102): Xaa can be any naturally occurring amino acid
AAERDEQQQSRGIALMQGICAVVYRKADNTPCPIKQGLYLGSVGAAFNKDALKSLNITHILIVAKSLDPVFPAEFNYKKIEDEAISSGGNVLVHCFAGRSRXKHQMSLESALSLVRSKRPQVAPNGGFISQLEKFQKSLQVEQERRMQ

SEQ ID NO: 5175 - protein, 296 aa, Brassica rapa
LHYVRNHGGVPKAEWSDWSVEVTGLVKRPARLTMEQLISEFPSREFPVTLVCAGNRRKEQNMVKQTIGFNWGSAGVSTSLWRGVALSDVLRRCGVYSKRGGALNVCFEGAEDLPGGGGSKYGTSIKKEMAMDPARDIILAYMQNGELLTPDHGFPVRVIIPGFIGGRMVKWLKRIIVTPQESDNYYHYKDNRVLPSYVDAGLANEESWWYRPEYIINELNINSVITTPGHEEILPINAFTTQKPYTLKGYAYSGGGKKVTRVEVTLDGGETWSVCELDHQEKPNKYGKFWCWCFWS

SEQ ID NO: 5176 - protein, 716 aa, Triticum aestivum
MAGADPNRSSMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWAATGGVPVVITSGCASQSLVKVLRGEKIGTLFHKNASLWEPSKDTSVREMAVAARDCPRHLQNLSSEERKKILLDVADALEANEDLIRSENEADLAAAHEAGYESALVSRLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKIPELNDILVALKAAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 5177 - protein, 560 aa, Unknown
  Oceanobacter sp. RED65
MSESFAELFEESLSGLDMQQGSIVTGTVVDIDSDWVIVNAGLKSEAVIPRNQFLDDNGELEVAVGDEVPVSLEAVEDGFGETKLSREKAKRAESWKELEKAFEAQEVVTGVINGKVKGGFTVDVASIRAFLPGSLVDVRPVRDTAHLEGKELEFKVIKLDQKRNNVVVSRRAVLETANSQERDELLANLQEGQEVTGIVKNLTDYGAFVDLGGVDGLLHITDMAWKRIKHPSEIVNVGDEIQVKVLKFDRERNRVSLGLKQLGEDPWVAIKARYPENTKVTAKVTNLTDYGCFAELEEGVEGLVHVSEMDWTNKNIHPSKVVQVGDDVEVMVLDIDEERRRISLGIKQCQVNPWEEFSSQFNKGDKISGKIKSITDFGIFIGLDGGIDGLVHLSDISWNEQGEDAVRNYKKGDELETIILSIDPERERISLGVKQLERDPFAEFVAENDKGTIVKGKVIEVDAKAATIEIAEGVEATLRASEISRDRVEDARNALKEGDEVEAKIISVDRKNRNIALSVKSKDEVDDKEAIKQLREKEAEQAGPTTIGDLIKEQLNSQKD

SEQ ID NO: 5178 - protein, 404 aa, Vibrio vulnificus
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDERHRVHSFVEKPQNPPHLPNDPERSLVSMGIYIFSMEVLQQALIEDADDDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSIIANGVINSGGSVQHSIVSSNVRINDSATVVDSIIFDDVEIGEGCQLVNCIIDKHVKVPPYTQIGLNRLEDAQRFKISENGIVVVPESYQF

SEQ ID NO: 5179 - protein, 183 aa, Clostridium perfringens
MIRDIKDDVKKVLYSEEQLAKRVKEMAEEISKDYAGKDLLVVGILKGSVLFTSDLIKNISIPCEIDFMAVSSYGNSAQTSGVVRILKDLDSDIENKHVLIVEDIVDTGTTLSYLLEYLKARKAASIEIVALLDKEARRTSNVSAKYKGFDVPDEFIVGYGIDYAEKYRNLPFIGALKEEIYNK

SEQ ID NO: 5180 - protein, 104 aa, Bacillus subtilis
MAIVKATDQSFSAETSEGVVLADFWAPWCGPCKMIAPVLEELDQEMGDKLKIVKIDVDENQETAGKYGVMSIPTLLVLKDGEVVETSVGFKPKEALQELVNKHL

SEQ ID NO: 5181 - protein, 605 aa, Unknown
  Synechococcus sp. WH 5701
MTRDRRVILLPIEPGLICLRGLSPKRLRFEVEYGLERGTTANAFLFEAGSSTGGAPIPPVLVHPPGASFSEPFLEQLSELVPSDAALKVVVGHLNPNRVTLLRELALRWPALMLVASNAGARLLEELWSQRKPTSPAVADAEAEPPLPPLPPIDVIKQEVSRELANGYRLTLIPTPTPRWPSALVAFEERTGLLMSGKFFAAHLCSESWAEANRDSTEEDRRYFYDCLMAPMARQVETVVDRLDELPIRTIAPGHGPAISESWRSLLADYRRWGESQEKAQLSVALLYASAYGNTAAIADALAQGVARTGVRVESLNCEFAPPEQLLQTIRGCDALMIGSPTLGGHAPTPIVSALGTLLAEGDREKPVGVFGSFGWSGEAIDLLESKLRDGGFRFAFEPIRVKFSPDGATLKRLEETGTALGRELQQRQKRQKRVAAGGLSESRSNPAVLALGRVVGSLCVLTTRKGEGENALAGAMVASWVSQASFSPPGFTVAVARDRAVEALLHVGDAFALNVLAAGRESGPMKQFLQPFPPGADRFAGLELESSPGGQPVLPEALAWLEARVSQRMECGDHWLIYAEVSHGALLDPSGTTAVHKRRSGANY

SEQ ID NO: 5182 - protein, 500 aa, Prochlorococcus marinus
MNVKYKNLTVICSNPGAKLFKEIWNLRKPSQNTNPKEALETVEVLPNIQIIKQLETHTLNSNFEVTYIPAPTARWPGGLIVFEKQTGLLMSDKLFGAHVYEEKWAELTSSSTEEERRHYFDCLMAPMSTQVNSIIEKFEDFEIDTIVPGHGPAISGSWRSLLNNYQSWGESQKYSNLRVALLFASAYGNTAAIADAIARGISKTGVNVKIINCEFTASDSLVTEIRKADGYLIGSPTLGGHAPTPIVSALGSLLAEGDRGKPAGVFGSYGWSGEALDLLEKKLKDGGFKFGFEPIKIKFSPDPLMIKKLEETGIQFGKQLINAKLRQQRKANVGLNTSKSDPTINALGRVVGSLCILTAQKGDEDNLISGAMVASWVSQASFSPPGITIAVAKERAVENLLHTGDNFALNILEQNNHQSLLKQFLQSFKPGDNRFTNLEIKLSPSNQPLLNEALAWLEGTVSQRMECGDHWLIYAEIKYGKVIKKDGVTAVHHRKTGANY

SEQ ID NO: 5183 - protein, 530 aa, Ralstonia eutropha
MDNYDAIVVGAGFSGLYMLHRLREAGLSARVYEAGDNVGGVWYWNRYPGARCDVESIYYNFTFSKELLAEWTWTSRYAEQPEILAYLNHVADRFDLRRDIEFSTRVVSAHFDASAGKWRVQTDDGRVATAKYFISGVGCLSTSSTPRFKGLDSFRGEQYHTGTWPHEPVSFAGKRVGVIGTGSSGIQAIPQIAAQATQLFVFQRTAQYSTPAANRPYDSEYVAQVKANYPALRQQVLKSWGGTTTRPRPDRSTFEDTEAQRQQRYEAAWTEGGWMHGLYKDLVTDASANETVCEFIRDKIRTVVKDPEIAAKLTPTYLYGVKRPVMDTGYFETYNRDNVTLVDVKAAPIVEFTPTGLRTADAEYPLDVIVFATGYDAMTGALFRIDIRGKDGMTLREKWAEGERIQTYLGLATAGFPNMFMITGPESPSVLSNMVWSIEQHVEWIDACIRQMEQNGTAVIEAKPQAEAAWSRHCHEVADATLFPKGESWYNGSNVEGKKMSFPIYLAGISVYRELCARVAANGYDGFLQA

SEQ ID NO: 5184 - protein, 178 aa, Medicago truncatula
MVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 5185 - protein, 334 aa, Coccidioides immitis
MPRAEVGSTKFISNKLKSKGLQRLRWYCQVCQRQMRDENGFKCHTQSESHVRQMLLVGEDPKKYIQGYSNDFLRDFIQLLRTSHGEKQVHINHFYQEYIANKEHIHMNATKWSSLTEFAKYLGREGICRVEEGEKGIFISWIDNSPEALRRQDAIRKRERQDRGDEEREKKLIEDQIKRAQRDKDATGTTDGDAPEAPKKLQRVEGEKITLNFASKLTPQENSAFSSASEKPDQPKMDHESETEKSEIPSSASTPAPAAQAQKVPIKLGLGSSGSKSKNVFASMSRKTAATKKADIPPRPLSAIERVMKEDMERKRARENSGFKGSTMKRQKIS

SEQ ID NO: 5186 - protein, 134 aa, Vitis vinifera
YIGNTRDIRLDYALFKAPGVVVQDGQLGYKNLFDAILDAVYSALERVGGGSLQVVISESGWPSAGGTATTVGNAKTYNSNLIQHVKGGTPKKPGGPIETYVFAMFNENRKSPEYEKHWGLFLPNKQAKYPINFN

SEQ ID NO: 5187 - protein, 223 aa, Medicago truncatula
MAIDHEDELKDEKNPRPLDEDDIALLKTYGLGPYSTSIKKVEKEIKDMAKKVNDLCGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLGQGCC

SEQ ID NO: 5188 - protein, 458 aa, Staphylococcus epidermidis
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 5189 - protein, 563 aa, Ashbya gossypii
MRGQSLLAPLMLVPALVAGTSIQGGKAQLEKRQSMPDDLVAAVGGHLSKLRSKMNVQQGKFFDARGSLKNIADSLGVSEQEVSSVSAELESVMAEMSELFPQDAKQLKFLSEPRGDVRKVREWDNVVRKESLQDYQLRVRKVSDPAGLGVDPDVKQYSGYLDVEAEDKHFFYWFFESRNDPKNDPIVLWLNGGPGCSSMTGLFFELGPSSIDQKLKPVRNPYSWNTNASVIFLDQPVNAGYSYSSNSVANTVAASKDVYAFLELFFRQFPEYQAGQKFHIAGESYAGHYIPAIAAEILSHPDEERSFKLSSVLIGNGLTDPLTQYPYYERMACGGGGEPAILGPEQCSAMNETLPRCLRLIRTCYTLQNVWSCVPASLYCNGNQLTPFQRTGKNVYDVRKECEGQLCYDDMKYSEEYLNTPEVIKAVGAEVDSFTSCNFDVNRNFLLNGDWMKPYQRHVTEILDKGLPVLIYAGDKDFICNWLGNRAWTDELPWKHHDDFTKQPIKPWNGPSGDQAGEVKNYKHFTYLRVFGAGHMVPYDVPENSLDMLNTWLQGDFGMGAQE

SEQ ID NO: 5190 - protein, 505 aa, Glycine max
MRLMFDTMNETADEAAIGAKKYATKQANISGFQTLYCLVQCTPDLSTQGCRSCLSDAIGLLPWCCEGKQGGRILNPSCNVRYDLYPFYRTNVSAPPASVPPTDSSNSGGGGSEISPGTIVAIVVPITVAVLLFIVGIWLLSKRAAKKRNSAQDPKTETEISAVESLRFDFSTIEAATDKFSDANKLGEGGFGEVYKGLLPSGQEVAVKRLSKNSGQGGTEFKNEVEVVAKLQHKNLVRLLGFCLEGEEKILVYEFVANKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLILEIISGKRNSSFYETDVAEDLLSYAWKLWKDEAPLELMDQSLRESYTRNEVIRCIHIGLLCVQEDPIDRPTMASVVLMLDSYSVTLQVPNQPAFYINSRTEPNMPKGLKIDQSTTNSTSKSVNDMSVSEVDPR

SEQ ID NO: 5191 - protein, 1008 aa, Unknown
  Synechococcus sp. WH 5701
MSVESSSDSAVAGAPREFSPFLQRHLGPSAAEQARMLERLGCADLEGFVAEVVPADILIPASAAEQDLPEGVGEAEALAELRRISSLNQVRRSLIGLGYYGTATPALIQRHVLENPSWYTAYTPYQAEIAQGRLEALLNFQTLISELTALPIANASLLDEATAAAEAMSLSAGACRRSEARRFLVDEQVFPQTLEVLRTRAEPLGILIETFDPATASAASSSAAKAASGDQFFGSDVFGVLLQLPGSRGRLLDPSAVIAAAHQVGAMVTVAIDPLAQVLLAPVGALGADIAIGSSQRFGVPLGFGGPHAAFFATTEAHKRQIPGRLVGRSLDAEGRPALRLALQTREQHIRRDKATSNICTAQVLLAVMAGFYAVHHGPEGLSAIARQVLRLRAALALGLTRLGFQLEPGPSFGTLSVLTAEAAPLLERAEVAGFNLRPLMAPGGPLEGVALSLDERSDAAELDQLLALFAAGAACADVPSTAALLAELADDQELLAGLPLREGPWLRQEAFQRYRSESELLRYIQRLASRDLSLVHGMIPLGSCTMKLNAAAELAPVSWSEFADLHPMAPPSQARGYARLIADLESWLAAITGFAGVSLQPNAGSQGEYAGLLVIRAWHRSRGDGHRDICLIPTSAHGTNPASAVMAGLRVVPVACDAKGNIDLEDLEAKAQTHAASLAGVMVTYPSTHGVFEPGIRRLCDVIHRHRGQVYLDGANLNAQVGLAKPGLYGADVCHLNLHKTFCIPHGGGGPGVGPIGVAAHLVPFLPGQVQGIGAVAAARWGSAGILPISWMYIRMMGGAGLRRASAVALLAANVIAERLEPHYPVLFRGPGGRVAHECILDLRPLKRSAGLEVDDLAKRLMDYGFHAPTVSWPVAGTVMVEPTESESLAEIDRFCEALIAIRAEAAAIEAGQVDPLDNPLKRAPHTLAAVTADDWGRPYSRQQAAFPAGEGQYATKFWPAVARIDNAYGDRNLVCTCPSVEELAAVSLGSVPEGVATAPALAGHGR

SEQ ID NO: 5192 - protein, 466 aa, Idiomarina loihiensis
MSYASVVDVLTGKVAVDETVTVRGWVRTRRDSKAGISFINLHDGSCFDAIQAVVPAELPNYSNEVQKLTTGCSVAITGVVVPSQGKGQSFELQATKVHVYGWVEDPDTYPMAPKRHSMEYLREYAHLRPRTNITGAVMRVRNALSQAIHRFFHEEGYLWVSTPIITTSDCEGAGEMFRVSTLDMLNIPKTDKGEVDYSEDFFGKEAFLTVSGQLNVESYACSLSKVYTFGPTFRAENSNTSRHLSEFWMVEPELAFATLDDVAGLAEAMLKYVFKAVLEERPDDMAFFAERINSDAISRLEAIVNNDFVHMDYTDAIEILKNCDRKFEYAVEWGVDLQSEHERYLAEEHVGAPIILKNYPRDIKAFYMRQNEDGKTVAAMDVLAPGIGEIIGGSAREERLDILDQRIDEMNLPKEEYGFYRDLRRYGTVPHAGFGLGFERLVAYVTGVQNIRDVIPFPRAPKSAEF

SEQ ID NO: 5193 - protein, 382 aa, Arabidopsis thaliana
MSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 5194 - protein, 68 aa, Rickettsia akari
MVVHALIYIFFNYDKPGLIKGWAVPIATDTAFVLGIVSFFSRHISLELRTFIIGFSLIDDAFAPIILS

SEQ ID NO: 5195 - protein, 237 aa, Neurospora crassa
MATATESAPRNHLADKPENSMGGRNLSIITPTIQMSAPPGDPMDITSSNSNSSSNSNSSSINNNNATMAAPSNSDSLPPPKSPVEDTLNAQAAPNGRPQLSSANDQLSPDNIIMPAPAAAAPAVHQPKIVQTAFIHKLYNMLEDKSIQHLISWSPTSESFVMQPSQEFSKASSQYFKHTNISSFVRQLNMYGFHKGKESPDVAGYQQSLTWSKSERCLPPWSSRRYHLGVQAWQRQL

SEQ ID NO: 5196 - protein, 321 aa, Unknown
  marine gamma proteobacterium HTCC2143
MAAFNDNSLAIGQTPLVRLNRIGDGNIFAKVESRNPANCVKCRIGSNMIWEAEKSGLLKPGMEIVEPTSGNTGIALSFVGAARGYKVTLVMPHTMSLERRQLMKALGANVVITDAAKGIKLCIDTAQQLVAEAPDQRWMPSQFDNPANPAIHEQTTGPEIWEDTDGGVDVLICGVGTGGTLTGISRYLKNTRGKAITSVAVEPMSTTMITAAKAGEEPVHGPHKVQGIGAGFVPANLDLDMVDQVEQVSDEDAIEYAHRLMKEEGILAGISSGAAAAIAHRVSQQPEHKGKTIVVILPDSAERYLSTPLFEGQFSDNETVQ

SEQ ID NO: 5197 - protein, 171 aa, Pediococcus pentosaceus
MEETAIFAGGCFWCMVEPFETQPGIINVVSGYTGGHVANPTYEQVTSHTTGHTEAVKITYDPEIISYRQLVQIYWQQTDPTDAMGQFQDRGDNYRPVIFVNSAEQREIAEKSREQLAKSEMFDDPIVTKIEDAQPFYPAEEEHQEFYKKNPLRYQIQEAGGRSEFQKKYWK

SEQ ID NO: 5198 - protein, 336 aa, Roseovarius nubinhibens
MDRFDRLLAPFPQAGFMPAPTPLERLDRLSELYDLDLWVKRDDLTRIGFGGNKIRQLDYYFGAALAEGADVALITGAVQSNYVRSAAACAARLGMGAVVQLEDRVPGKGALYHSSGNVLLDKLLGAEILHYPEGEDEAGADRALHARAEELRAEGRKPFVIPLGLENPPKGALGYMQCGREILAQDAAGFDHYVVASGSGATHTGLLAGLRLCGASAPVHGICVRRDAEAQRARIGRLAELLAELLGEAVFGAADIDIWDGALAPGYGRMGETTRRALDQMARYEGLFLDPVYTAKSFAGVEGLLQEGVIQPGARVCFIHSGGLPALFAYGEDLLA

SEQ ID NO: 5199 - protein, 276 aa, Mesorhizobium chacoense
WGFDGSSTMQAEGRSSDCVLKPVALYPDPARTNGVLVMCEVMMPDGVTPHASNSRATILDDEGAWFGFEQEYFFYKDGRPLGFPESGYPAPQGPYYTGVGYKNVGDVARKIVEEHLDLCLAAGINHEGINAEVAKGQWEFQIFGKGSKRAADQIWMARYLLLRLTEKYGIDIEFHCKPLGDTDWNGSGMHANFSTAYMRETGGKEYFEALMAAFEKNRADHIAVYGPDNHMRLTGKHETQSIHTFSYGVADRGASIRVPHSFVNNGYKGYLEDRRP

SEQ ID NO: 5200 - protein, 363 aa, Eustoma grandiflorum
MAPSTLTALAEEKTLQSSFIRDEDERPKVAYNQFSNEIPIISLKGLDEIDGRRAEICKKIVEACEDWGIFQVIDHGVDSDLISEMTMLAREFFALPPEEKLRFDMSGGKKGGFIVSSHLQGEAVQDWREIMTYFSYPIKARDYSRWPDKPEAWRGVTEKYSEQLMGLACKLLEVLSEAMGLEKEALTKACVDMDQKIVVNYYPKCPQPDLTLGLKRHTDPGTITLLLQDQVGGLQATRDGGNTWITVLPVDGAFVVNLGDHGHYLSNGRFKNADHQAVVNSNSSRLSIATFQNPAPEATVYPLAVREGETPVLEAPMTFAEMYRRKMSKDLELAKLKKLAKENELKHVEKAKVESKPIEEIFA

SEQ ID NO: 5201 - protein, 276 aa, Unknown
  Mesorhizobium sp. ICMP 11708
WGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTEAYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRP

SEQ ID NO: 5202 - protein, 91 aa, Avena strigosa
KQFTMSEVRKHGSQDSAWIVVHGHVYDCTAFLKDHPGGADSILINAGTDCTEEFDAIHSDKAKALLDTYRIGELITTGTGYNSDNSVHGGS

SEQ ID NO: 5203 - protein, 296 aa, Brassica rapa
LHYVRNHGGVPKAEWSDWSVEVTGLVKRPVKLTMEQLITEFPSREFPVTLVCAGNRRKEQNMVKQTIGFNWGSAGVSTSLWRGVALSDVLRRCGVYSKRGGALNVCFEGAEDLPGGGGSKYGTSIKKEMAMDPARDIILAYMQNGELLTPDHGFPVRVIIPGFIGGRMVKWLKRIIVTPQESDNYYHYKDNRVLPSYVDAELANEESWWYRPEYIINELNINSVITTPGHEEILPINAFTTQKPYTLKGYAYSGGGKKVTRVEVTLDGGETWSVCELDHQEKPNKYGKFWCWCFWS

SEQ ID NO: 5204 - protein, 276 aa, Unknown
  Mesorhizobium sp. ICMP 12685
WGFDGSSTMQAEGRSSDCVLKPVALYPDPARTNGILVMCEVMMPDGVTPHESNSRATILDDEGAWFGFEQEYFFYKDGRPLGFPESGYPAPQGPYYTGVGYKNVGDVARQIVEEHLDLCLAAGINHEGINAEVAKGQWEFQIFGKGSKRAADQIWMARYLLLRLTEKHGIDIEFHCKPLGDTDWNGSGMHCNFSTKFMREVGGKAYFEALMAQFDKNLMDHIAVYGPDNDKRLTGKHETAPWNRFSYGVADRGASIRVPHSFIKNDYKGYLEDRRP

SEQ ID NO: 5205 - protein, 94 aa, Hordeum bogdanii
TDDKQFTMSEVRKHGSEDSAWIVVHGHVYDCTAFLKDHPGGADSILINAGTDCTEEFDAIHSDKAKALLDAHRIGQLITTGAGYNSDNSVHGGS

SEQ ID NO: 5206 - protein, 132 aa, Mesorhizobium plurifarium
KGSRKAADQMWMARYLLLRLTEKYGIDIEFHCKPLGDTDWNGSGMHCNFSTKYMREVGGKTYFEALMAQFEKNLMDHIAVYGPDNDKRLTGKHETAPWNKFSYGVADRGASIRVPHSFVKNDYKGYLEDRRP

SEQ ID NO: 5207 - protein, 95 aa, Hordeum chilense
PTDKQFTMSEVRKHGSQDSAWIVVHGHVYDCTAFLKDHPGGADSILINAGTDCTEEFDAIHSDKAKALLDAHRIGQLITTGAGYNSDNSVHGGSS

SEQ ID NO: 5208 - protein, 616 aa, Chromobacterium violaceum
MCGIAGWVSFERDLSTQRAVAETMTKTMALRGPDDEGLWLDRRAALGHRRLSIIDLEGGRQPMTADEDGRTLACLVYTGEVYNFRELRLELQGLGHAFRTRSDTEVVLRAYLQWGEAMLERLNGMYAFALWDAREQRLLLVRDRMGVKPLYYYPMPDGVLFGSEPKAILAHPEAERRVTAGGLREMLDLVKTPEAAAFAGMHEVRPGQVVTIDRGGLRKRRYWQLEAREHTDDLPTTIRTVRELLDDIVERQIIADVPLCTLLSGGLDSSVVTALAARSMRRQGKGTVRSFSVDFVKHGAAFEADYLRGSPDAPFVRDLAAHAGTEHREILLESRELADPRLRAAVLGAQDLPPAYWGDMLPSLYKLFEAIRAQSTVALSGESADEVFGGYRWFHDAAAVDGDAFPWLAGSSGAFFDGQSLIAPGLLRELDMPGFRRDSYAQALAEVPRLASDSTRERRMREISHMHLTRFVQALLDRKDRMSMAVGLEVRVPFCDHRLVEYVFNAPWSMKNFDGREKSLLRAAGKDVLPESIVRRVKSPYPATQDPAYEQALRQGLARVLDDSRSPALPLLDKAAAWKLLDRPFGKTSTSPERAGLEMALGLDEWLRHHQVSLDL

SEQ ID NO: 5209 - protein, 177 aa, Thiobacillus denitrificans
MAHEIATLAGGCFWCIETVFNRLQGVESAVSGYMGGHTETPSYEAVCNGDTGHAEVVQITFDPDVISYRDLLDVFFTIHDPTQLNRQGNDVGTQYRSAIFWHTPAQKAEAEAAIAALDASKQYGSPVVTEVAEATTFYPAETYHQRYYEANPRQPYCQYVVAPKVAKAEQKFADRLK

SEQ ID NO: 5210 - protein, 592 aa, Prochlorococcus marinus
MIFTKSTALENQKSDTPPKLSLQYEQIATDTHTLRSLDWDRSRFDIEFGLRNGTTYNSFLIRGKKTALIDTSHLKFKDIWFEKLRQEINPTDIDYLIVSHTEPDHSGLIKYLIELNPNIEIVASKVAIKFLEDQIHQPFKSRAVKSGEELNLEFNSISGIEHRIEFISAPNLHWPDTIFSFDHGTQVIYTCDAFGLHYCSEKLYDENPSLLNEDFRFYYDCLMGPNARSVVQALKKIDSLSTIQTIGVGHGPILNFNTQLWLNHYREWSKQKSTGENYAVVCYLSQYGFCDRLSQAIAHGIGKANAQVQLVDLIASDTQELSALISEASAVVVPTWPIKSDSELQSNIGTLLASLKQKQWVATYDSYGGNEEPIDFITNQLRKLGQKEAFKPLRVRDEPNKSVYQQFEEAGTDLGQILTRKKNLAATKSLDGDLNKALGCLSGGLYIVTAKDNEGADSRDGAMVASWVSQASFDPPGITVAVAKDRAIESLLQVNDRFVLNILQENNYLHLFRHFLKRFPPGANRFKGVELMNDLAAGGPVLSDALAFLSCKVIQRMETTDHWIIYSSVEKGNLSNTQSKTAVHHRRVGSNY

SEQ ID NO: 5211 - protein, 488 aa, Bacillus thuringiensis
MNSATNQATSKTEATKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 5212 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 5213 - protein, 243 aa, Ashbya gossypii
MMAATTTGSDYANEVHSVPIQHQFNPYDDTAGTILGIAGEDFAVLAGDTRHTTGYSINSREEPKVFDCGDNILISANGFAADGDALVKRFKNSMKWYRFDHNKKMTIKSAARSIQHLLYGKRMFPYYVHTIIAGLDEEGKGAVYSYDPVGSYEREQCRAGGAAASLIMPFLDNQVNFKNQYEPDSNGTKKRALRFLSVDEVVRLVRDAFTSATERHIHVGDGLQIMIVTKDGVREEFYSLKKD

SEQ ID NO: 5214 - protein, 187 aa, Arachis hypogaea
MASEAKESPANNPGLSTVRDEATKGYIMQQTMFRVKDPKASLDFYSRVLGMSLLKRLDFSEMKFSLYFLGYEDTSTAPTDPTERTVWTFGRPATIELTHNWGTESDPEFKGYHNGNSEPRGFGHIGVTVDDVHKACERFEQLGVEFVKKPNDGKMKNIAFIKDPDGYWIEIFDLKTIGTTAGNAANH

SEQ ID NO: 5215 - protein, 293 aa, Oryza sativa
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGDAKKASPRTLQQNGVSNCPLRDAAAFCLDGHRP

SEQ ID NO: 5216 - protein, 440 aa, Oryza sativa
MVTGGGHRHGGAAAERGEGKEETRRRSTAHPRSTATTKKAAGGVEGGGAARVDLDGGAPAIGELDEGVDGVDGCAAKPEEATPGREAVSEEPNVVNRITTAFWELQLPACSDEPISSGTPSSPSSPPTKETGDANTVVIDDLFLAHSDAILPAGGDQKEEHQLGDDLGQQQAATAMEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 5217 - protein, 738 aa, Saccharophagus degradans
MEPLFPKRLLSIAVLCVASATAQADTGMNPDNDYWWPNRLSLEPLRDSSLSADPRGANFDYNEALKDLDVEALKKDLKQVMTASQDWWPADYGHYGPFFIRLSWHAAGTYRMIDGRGGADGGMQRFAPLNSWPDNASLDKARRLLQPIKQKYGNNLSWSDLLVLAGTIGMEDMGFPIVGFAFGRDDEWEPEEVNWGPEGQWLTDRRHSGDRKLDKPFGATEMGLIYVNPEGPHGNPDPIAAAHDIRQAFGRMGMSDEETVALIAGGHTFGKAHGAHKPSDCVGADPEAASMEEQGLGWTNKCGKGNAEDTVTSGLEGAWTVSPAEWTHNFLQNLYAFEWELTTSPAGAKQWVPKGGAATNMVPDAHDSSKRHAPIMLTTDLALKEDPAYRKITQRWLEDPEEFTRAFARAWFKLTHRDMGPVSRYKGELVPSDTFVWQDPVPVADYKQIGERDVKKLKAAILDSGLSTSDLVKTAWASAASFRTTDMRGGANGARIRLAPQKDWAVNQPQDLQRVLKVLEGVQREFNKKSRKTKVSLADVIVLGGAAAIEQAAKKAGHKVEVPFFPGRTDASQEMTDVSTFAWLEPKSDGFRNFHAEGYKRNPAEALVERAALLGLTAPEMTALVGGLRVLQANADGSQHGVFTDNPGSLTNDFFVNLVDMSTVWKKSDTEAGLYKGLDRNSGKVKWTATSADLIFGSNSELRAIAEYYSQSDSQKTFVQDFINAWSKVMTADRFDLK

SEQ ID NO: 5218 - protein, 485 aa, Candida glabrata
MMLLRAARVPVLGRRFLSQQQLISKHVQEVDPEMFRILSDERSRQKHSVTLIPSENFTSKAVMDLLGSEMQNKYSEGYPGERYYGGNQFIDKAESLCQARALDLYGLDPEKWGVNVQALSGAPANLYAYSAVMEVGDRLMGLDLPHGGHLSHGYQLPSGTKISYISKYFNTMPYHVNTETGIIDYDTLAMTSKLFRPKVIVAGTSAYSRKLDYARFRKIADGCGAYLLSDMAHISGLVAANVIDSPFEHSDIVTTTTHKSLRGPRGAMIFYRKGIKKVNKKTGKETPFTFDKTINFSVFPGHQGGPHNHTISALAVALKQAKTPEFVEYQKQVVSNAKAFGDELLKRGFELVSGGTDNHLLLLNLSNMGIDGARLEAILEKINIAANKNTIPGDKSALFPSGLRVGTPAMTTRGFQEQDFKKVAEYIDNAVKLSIALKSQESADAKDVRSKLNSFKQLCDQSEPVQKLAEEVSSWVGTFPVPGEL

SEQ ID NO: 5219 - protein, 149 aa, Arabidopsis thaliana
  misc_feature (39)..(39): Xaa can be any naturally occurring amino acid
MDDKETSATDLKRPREEDDNGGAATMETENGDPKKEPAXFATVIPGRSSEMRPMWTGEAHSLKVEKALFSGRSDDQEGIAFQAATYGKVLDLDGEIQLTERRWNVLIRKRTVHLPLWFYPLTLRKGFGSMAGRTWNVVLPEKLNAMAFN

SEQ ID NO: 5220 - protein, 222 aa, Candida albicans
MSREALINRITNETKIQIALNLDGGKLELKESIFPNQSIIIDEHHAKQVSGSQYINVQTGIGFLDHMIHALAKHSGWSLIVECIGDLHIDDHHTAEDVGISLGMAFKQALGQIKGVKRFGHGFAPLDEALSRAVVDLSNRPFAVIELGLKREKIGDLSTEMIPHVLESFAGAAGITIHVDCLRGFNDHHRAESAFKALAIAIKEAISKTGKNDIPSTKGVLS

SEQ ID NO: 5221 - protein, 729 aa, Roseovarius nubinhibens
MGLVAKLTQERRARLAAERLLEQKQAELFAANRQLGKHARALSEEIVETRERVRSIEDENARVRDELSSANDRIQLVERRLWQSIETIPDGFALFDEDGRLVMANRAYLLPFDGLTAVGPGVSYMEMLQFCTEEGIVDIGDMAPAAWREYMRERWQSDAPGPRIVRLWNGRAIRLLDQRAPSGDMVSLALDITAEVRSKEVLRRAKHRAEAASRAKSAFLANMSHEIRTPMNGVMGMADLLRETDLDEDQALYATTIRNSAEALLGIINDVLDYSKVEADRLSLQLDGFDLERCLHEIILLMQPKARDQGVDVWLDYDLFLPTRLRGDGGRIRQVLTNLIGNAVKFTPEGHVLIRVVGVSAEGRAEIHVTVEDTGIGIAPDKIGHVFGEFNQVEEAQNRRFEGTGLGLAIAQKLIRLMGGEIWVESAPGQGSVFGFTITLDIEEPQGQEPCRLPEGLRQVVVAGRPEGARMILERQLAQLGLAVQSCHGAEALADALGAGGDLVIVIHEGEAWTDRALRKLPPDLPVIVMAASRGAWTGTRGQLLQMPVARHELCAALGRVGQAVGQVEPEKTVPQRVEPPPKPEPVSPQLRKLRVLAAEDNRTNRLVFEKMVKALAIELRFAENGREAVAGYAAFEPDIIFMDISMPEMDGKEASRAIRRHEGHGAHVPIVAMTAHAMQGDEADIRAAGIDHYLTKPLRKPELIARMAAAVGPGIAPIEPEAAISPDG

SEQ ID NO: 5222 - protein, 541 aa, Agrobacterium tumefaciens
MQATIEKLKATASSTAATDLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRFPAYLQQLDMESNGKGVTIDGTPVEGQSGPVVWGEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLVKALAGLAG

SEQ ID NO: 5223 - protein, 269 aa, Crocosphaera watsonii
MPVVSLEDLLNAGVHFGHQTRRWNPKMSQYIYTARNGVHIIDLVQTAQLMEDAYQYVRNNSDKGKRFLFVGTKRQAAGIIAQEASRCGANYVNQRWLGGMLTNWETIKTRVERLKELEAMEDSGQIARRPKKEASVLRRELGKLQKYLGGIKTMRRPPDVVVIVDQRREYNAIQECQKLGIPMISLLDTNCDPDYADIPIPANDDAIRSIKLILGRLADAIYEGRHGQLDSDDDYEEFEESLAEGDYDDYDEEEEEGVEAVASGEGEEE

SEQ ID NO: 5224 - protein, 772 aa, Oryza sativa
  misc_feature (174)..(174): Xaa can be any naturally occurring amino acid
  misc_feature (193)..(193): Xaa can be any naturally occurring amino acid
MASHIILPKEEEAALGVAVEEDHDSPAAPGYQHQQGPPVAKALPFSATCVRISRDSYPNLRALRNASAMSLPDDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLXCPGLNTVIRELVCGLSHMXYNVNDIFGIQNGYKGFYSSNYLPMTPKSVNDIHKRGGTVLGTSRGGHDTKKIVDNIQDRGINQVYIIGGDGTQNGAYDIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEGSSDAVVQEPFATTPTSPAALAAGAVSNPALTPAAVSMSFYDVNAGEQPSREDEAPEEVVEAAVANGAPTAVEKHNKLYSPAETPAGSGTRPHPTADAVAETAGAAPDDVDGCTTPPPPPVHDSEGSDTQSADDHGSPQREKPRTTSTAGGVKRDVAPSWSSRLLAFRSFSRDKKAKATVDARPPAHGKARDEGDEHKEKGKERRKRFWK

SEQ ID NO: 5225 - protein, 95 aa, Hordeum lechleri
TDDKQFTMSEVRKHGSQDSAWIVVHGHVYDCTAFLKDHPGGADSILINAGTDCTEEFDAIHSDKAKALLDAHRIGQLITTGAGYNSDNSVHGGSS

SEQ ID NO: 5226 - protein, 276 aa, Unknown
  Bradyrhizobium sp. ICMP 14291
WGFDGSSTQQAEGHSSDCVLKPVAVFPDAARTNGVLVMCEVMMPDGKTPHASNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFANNGYKGYLEDRRP

SEQ ID NO: 5227 - protein, 461 aa, Roseovarius nubinhibens
MFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPREWDEDELERITRRFAYELIKRDLINPSQNVPAPDMGTGEREMAWIADQYKRMNTTDINGRACVTGKPINGGGIQGRTEATGRGVQYALQEFFRHPEDMKAAGLSGTLDGKKVIVQGLGNVGYHAAKFLSEEDGCIITGIIERDGALVSEDGLHVEEVRHWIAKHGGVKGYPDAEYVEDGSKVLENACDILVPAALEGVIHMGNAANIQAPLIIEAANGPVTAGADEILRKKGAVIIPDMYANAGGVTVSYFEWVKNLSHIRFGRMGRRQEEARHQLIVDELEQLSADRGLGWTLTPGFKQQYLRGAGELELVRSGLDDTMRAAYQSMREVWHGRQDVTDLRTAAYLVSIDKVAASYRAAGL

SEQ ID NO: 5228 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 5229 - protein, 893 aa, Zea mays
MPPWWGKSSSKEVKKSAKENLIDTFQRLISSNEQKGSRKSRSSRRHGKDTAGDKGCWSTAQSRSTSPSKEVSRCQSFAADRPHAQPLPLPKSRAKVTRTSSDITNSKSTLEKHGKGQLLPLPPIQPKKRPEATEPVTEVATASVSSNCSIDSDDPGDSQLQSPVGNEAENATRITATSSSSVVRKECSSAITRKNTKEVAKPNSAILSNQILSTSPRGTFADGYQSNLQSPRQIALESAPNSLMSSPSRSPRNICPVQIPTSAFWAIKPHTDVTFLGSGQCSSPGSGQTSGHNSVGGDMLGPIFWQPSRGSPECSPIPSPRMTSPGPSSRVHSGSVSPLHPRAGGVTPESPTNRHAEGNKKQTHRLPLPPLSIANSSTFLPNSSNPTSPISRSPGRTENPPSPGSRWKKGKLIGRGTFGHVYVGFNSDRGEMCAMKEVTLFSDDPKSKESAKQLCQEISLLSRLQHPNIVRYYGSETVDDKLYIYLEYVSGGSIHKLLQEYGQFGEQAICSYTKQILLGLAYLHAKNTVHRDIKGANILVDPNGRVKLADFGMAKHINGQQCPFSFKGSPYWMAPEVIKNASGCNLAVDIWSLGCTVLEMATSKPPWSQYEGIAAMFKIGNSKELPPIPDHLSEEGKDFIRQCLQRDPSSRPTAVDLLQHPFVQNAPPLEKSSASHPLEQLTAISCRTNSKVVEHARNMSSLGLEGQSILQRRAAKFSLPNSDIHIRSNISCPVSPCGSPLLRSRSPQHQNGRMSPSPICSPRTTSGASTPLTGGSGAVPLNHVRQPAYRNEGFTVTSRGFDDHMPSRPVDPVHGRFIRVQQFSVGRQERVVSEVDILSSQYGKMRHANVWDPHDRPLPSERSSQQCFGNHAKLKPSLDLRSGPRHPGRNHGH

SEQ ID NO: 5230 - protein, 671 aa, Arabidopsis thaliana
MQSLQDKASVLSGVDQAEAFAIDESNLFDKLGLQTFINLSTNFYTRVYDDEEEWFQSIFSNSNKEDAIQNQYEFFVQRMGGPPLYSQRKGHPALIGRHRPFPVTHQAAERWLEHMQNALDDSVDIDQDSKIKMMKFFRSPAVTLFPPLMDSDSSKSRIDQFYVSKKRKHQSPNLKSGRNEKNVKVTGERSPGDKGTLDSYLKASLDDKSTTNSGLQARQEAFTRKLDLEVSASSVGQNIHPCLPKPVSFATFKECLGQNGSQDLHKEGVAAETHATDGLLCANQKDNSELRDFATSFLSLYCSGVQSVVGSPPHQKENELKRRSSSSSLAQDIQISHKRRCESENIPSLDDLTNPLGSKPESLARNGNNRDKPVSDPTKKMPSNESVEIPMGLRKCSKAPESSAHLTEFHTPGSAIKSCPVGTPKSGCGSSMFSPGEAFWNEAIQVADGLTIPIENFGSVEAKVRDQHVTILSCSKKTDKCTEKLERSLDLDEIRVKDKDAIGFSKVVEKHGRDFNKEVYQLPVKNLELLFQDKNINGGIQERCASFDQNNITLGSSRISESAFVGNKGCENLDIANNAQADKGLIGKMYPEPEGKKVLLCEENRGVRSVSMISNMRKPVGSSESEESHTPSSSHRNYDGLSLSTWLPSEVCSVYNKKGISKLYPWQVHNY

SEQ ID NO: 5231 - protein, 486 aa, Zea mays
MEELAALGHLLLFAFLFWFSTFMVAPVMTDVTMAALCPGRDECSLAIYLTGLQQAVSGLGALVLTPVVGNLSDRYGRKALLALPATASIVPLGILAYGRTKGYFYAYYVTKTLTAMVCEGTMMTLSLAYVVLLLPTYTTYQAAAVCPSPSDRRVQVCPPGSLPPAQADRVPETRRAAAFGVFSGVCSAGFVGGTVAARFLPVSSTFQVSAVAAVATAVYMKAFLQETDGGASVSSSSSSSSGSGSDEEAACRRPLCLPSSSSSSEEEASPPRLPPLRKAPSLSEIAAALTSSSTFCGAAVVTFFHGLGETGLLSALLYFLKAKFHYSKNQYANLLLIIGITGSFSQLTVMPLLVPKLGEQKLLVISLVASCGQAFLYSISWSSWVPYLAASSVILSMLVTPCIRSIVSKKVGPFEQGMVQGCMTGISSTASVVSPLIFTPLTAWCLSEATPFYLKGFSVACAGFATLVALATSISMRPAEVQPDRK

SEQ ID NO: 5232 - protein, 132 aa, Unknown
  Bradyrhizobium sp. ICMP 14753
KGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRP

SEQ ID NO: 5233 - protein, 95 aa, Hordeum vulgare
AGDKQFTMSEVRKHGSKESAWIVVHGHVYDCTAFLKDHPGGADSILINAGSDCTEEFDAIHSDKAKALLDTYRIGELITTGTGYNSDNSVHGGSS

SEQ ID NO: 5234 - protein, 276 aa, Unknown
  Bradyrhizobium sp. ICMP 14752
WGFDGSSTQQAEGHSSDCVLKPVAVFPDAARTNGVLVMCEVMMPDGKTPHASNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRP

SEQ ID NO: 5235 - protein, 438 aa, Silicibacter pomeroyi
MTETCDRFALIGAGPMGLAMAKVMLEQGIAFDGFELHSDVGGLWDIDGPRSTMYESAHLISSKRMTEFTDFPMEEAVAEYPSHRELKRYFHAFAARYGLRDHYRFGAEVLRCEPLGEPGAGWRVIWRDAEGEHTETYAGVMIANGTLSEPNMPTFQGRFDGELIHSSAYRHPSQFDGKRVLIVGAGNSGCDIAVDAIHHGALCDLSMRRGYYFVPKYVFGKPADTLGGMIKLPMWLKRRVDGMILKWFVGDPQKYGFPKPDYQLYESHPVVNSLVLYHAGHGDLRIRPDIDRFDGRRVIFADGSSEEYDMILAATGYKLFYPFIDRDLLNWQGDAPHLYLNALHPERDDLFVLGMIEASGLGWQGRHEQAEMVARYITGLRRGGAAAAELKAAKSAGFERATGGMNYLKLARMAYYVDKATYRGAVTGWIDRLKRAQS

SEQ ID NO: 5236 - protein, 276 aa, Unknown
  Bradyrhizobium sp. ICMP 12835
WGFDGSSTQQAEGHSSDCVLKPVAVFPDGARTNGVLVMCEVMMPDGKTAHSTNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRSIGGKEYFEALMAAFDKNLMDHIAVYGPDNDKRLTGKHETAPWNKFSYGIADRGASIRVPHSFVNNGYKGYLEDRRP

SEQ ID NO: 5237 - protein, 399 aa, Clostridium tetani
MYCVRKITEDLYWVGGNDRRLALFENIHPIPKGVSYNSYLLLDEKTVLFDTVDWSICRQFIENVKGVLGNKPLDYMVINHVEPDHAACVEEIILRYPDVKIICTEKALMFMNQFGFNIDEKVIEVKEGDTMSFGKHQVVFVSAPMVHWPEAMVTYDTTEGILFSADAFGSFGSLDGKLFNDEININRDWIDEGRRYYTNIVGKYGAHVQSLLKKAADLDIKIICPLHGPVWRNNLDYLLDKYDKWSSYEPEEKGVMIVYASMYGNTEAAANDLATRLVEKGMTNVAMYDVSKTHVSYLISETFKYSHVVLASVTYNLNIYPPMFNYIMDMKALNLQKRTFALIENGSWAPQSGQLMYKLLDEMKEMTILDNEISLNSTIKKDDMDSIEELAQNIIESMN

SEQ ID NO: 5238 - protein, 319 aa, Bacillus licheniformis
MKRIGVLTSGGDSPGMNAAVRAVVRKAIYHDVEVYGIYNGYSGLISGKIEKLEIGSVGDIIHRGGTKLYTARCPEFKTVEGREKGIANLKKYGIEGLVVIGGDGSYMGAKKLTEHGFPCVGVPGTIDNDIPGTDLTIGFDTALNTVIDAIDKIRDTATSHERTYVIEVMGRHAGDIALWSGLAGGAESILIPEADYDMEEIIARLKRGHERGKKHSIIIVAEGVGSGVEFGKRIEEATNLETRVSVLGHIQRGGSPTAADRVLASRLGAFAVELLLEGKGGRCVGIQNNQLVHHDIIEILEQKHTIDQSMYRLSQELSI

SEQ ID NO: 5239 - protein, 276 aa, Unknown
  Bradyrhizobium sp. ICMP 14533
WGFDGSSTQQAEGHSSDCVLKPVAVFPDGARTNGVLVMCEVMMPDGKTPHASNKRATILDDSGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRSIGGKEYFEALMAAFDKNLMDHIAVYGPDNDKRLTGKHETAPWNKFSYGIADRGASIRVPHSFVNNGYKGYLEDRRP

SEQ ID NO: 5240 - protein, 614 aa, Magnaporthe grisea
MTSIADLFKSSGVPSKRKLDPVRDPSKQFDSLCLGFLTHIQWTDEIYKSAKLNPSSSRHAQVQDDDDVEAGPAPPEDDEDGDYGPSAPPEDDIPDDDEDGRFFGGGITRQEAEVLDFVESADSAAPPADDKFDAAWLRRTALALEKKINRNAELRARHADDPAKFIDSEADLDAAVRNLSILAEHPSLYPEFARLGIAGSLTGLLAHENTDIALAAVQIVAELTGDDVEGATEDDWAALVDSLLEADLLSLLVSNLERLDEAGDEADREGVYRILEVVENLCGGRPATAETVGRCDPLLKWLLARATKAEEPVSQNKQYAAEMLAILAQASPVNRDRLARDLDAVEPLLQLVAPYRARDPERGGDEEEFMENCFEALTCIADRPEGKQKFVDAEGYALCLVLIGSPTAKKARTPALRLLDHAVAQSREAGVCEQVVEYGGLKTLFTLFMKSSSSAKASSKKRDPKVVEHLISIFACMLRLLPTDSAERIRTLAKFVEKDYEKTERLVLLRREYAGRVAAVDAAGMDELDEDERFSRRLDAGLFVLQSIDVILAWLVAEDDGAKRKIQTLLADRDETLELLSESLKEQADAVDVETENGKEMHDMLTTLREFLQD

SEQ ID NO: 5241 - protein, 447 aa, Bacillus cereus
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDVLLQKNIIGGYDLGRDYKEHENHMLVAVTELRTKEEIDTLVNEMGAIQ

SEQ ID NO: 5242 - protein, 558 aa, Silicibacter pomeroyi
MANASMEEFEALLNESFEMDTPEEGSVVKGKVIAIEAGQAIIDVGYKMEGRVELKEFANPGEAPEISIGDEVEVYLRAAENARGEAVISREMARREEAWDRLEKAYADDQRVEGAIFGRVKGGFTVDLGGAVAFLPGSQVDVRPVRDAGPLMGLKQPFQILKMDRRRGNIVVSRRAILEESRAEQRAEVIGNLTEGQTVDGVVKNITEYGAFVDLGGVDGLLHVTDMAWRRVNHPNEILNIGETVKVQVIKINKDTHRISLGMKQLQEDPWDLVGAKYPLESVHTGRVTNITDYGAFVELEPGVEGLVHVSEMSWTKKNVHPGKIVSTSQEVEVMVLEIDGAKRRVSLGLKQTMRNPWEVFAETHPEGTVVEGEVKNITEFGLFIGLPGDIDGMVHLSDLSWDERGEDAIQNYRKGDMVKAVVSEVDIDKERISLSIKSVGGDKFAEAVGGVKRGSIITVNVTAIEDGGIEVEYEGMKSFIRRSDLSRDRADQRPERFSVGDKVDVRVTNVDSKTRRLGLSIKAREIAEEKEAVEQYGSSDSGASLGDILGAALKGDN

SEQ ID NO: 5243 - protein, 152 aa, Unknown
  Photobacterium sp. SKA34
MHRTTRTMASSKHIALVAHDNCKVDLLRWVKEHKDKLRSHELYATGTTGHLLSKEIGLPITCLISGPMGGDQQLGALISEGKIDMMIFFWDPLNAVPHDPDVKALLRISAVWNIPVATNRASANFMITSPLLDQEVSIEVPDYDAYLEERIN

SEQ ID NO: 5244 - protein, 325 aa, Rhizobium leguminosarum
MTEKFGAKSTADEVLSGVDLRGKRFLITGVSSGIGLETARALVAHGASVVGAVRDRAKAERATASVRDAASQGGGTLELTELDLASLQSIRACADRLLADGRRFDSIIANAGVMATPFARTADGFELQFGTNHLGHFALVNRIASLLADNGRLVVLSSQAHRVADVDLDDPNFERQAYDPWVAYGRSKTATSLFAAEFDKRHRDRGIRAASVMPGNSLTDLPRHLRQEDLQGLFETVGKARAEAGLPPAELKDIPQVAATSVWAAVVADKDEIGGHYLDDCAVAPINDTPNPFADGVRSYALDADKAKRLWAKSEEWIGANTAAI

SEQ ID NO: 5245 - protein, 545 aa, Zea mays
MSMGYQVVAAQLKVASSADHASVVIITLFVALLCACIVLGHLLEENRWLNESITALIIGLCTGGVILMTTKGKSSHVLVFSEDLFFIYLLPPIIFIAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 5246 - protein, 500 aa, Rhodopirellula baltica
MRNQQSTQLLFELSRAGRRAHRLGDLDVPSVNVDELFADEALAETPPPLPELAEGDVVRHFVGLSTLNMSVDTHFYPLGSCTMKYNPKRNERIASLPGFLNVHPLQHESGLQGLLELLYELQGMFAEISGLPGVSMQPAAGAHGELAALLVAAAYFREQGSDRNVVLTADSAHGTNPASAQMAGFKTKTVKSNANGLVDLEDLKAKLDDKTAVFMLTNPNTLGLFDRQIEEINKLVHDAGALIYLDGANMNAILGITRPGDFGADLMHYNPHKTFSGPHGGGGPGAGPICVRDFLAKYLPGPIVTRVENENASGDDDRYTYHLTSPSDDSIGRVRSFFGNTGVLVRAYIYLRTYGGDGLRHVSEDAVLGANYLLSKVKHFLDVPHGDRCMHEFVASATRLKKEKKLSAMDIAKRILDYGFHAPTVYFPLVVDEAVMVEPTETESKQTLDAFVEALFRITEEGEELIHDAPHSTRISRPDDVTAARRPILKWTDAAGESAT

SEQ ID NO: 5247 - protein, 399 aa, Ustilago maydis
MAVPFIKNPACVVNVACLALARQVRSTGLAIVAPLLTASPFVLLCLTSACLKTGLVNPYFELDQRGKVQAEYIWIDGDGEIRGKTTTLDGPVKSLKDLKEWNFDGSSTNQAPGGNSDVYLRPVAYYPDPFRRGDNVIVLAECYNNDGTPNKSNYRYQCNKIMTQIADEKPWFGLEQEYSLFDMDDRPYGWPKGGFPGPQGPYYCGAGAGKVFARDLVEAHYRACLYSGVNISGINAEVMPAQWEFQVGPCEGIEMGDHLTLARYLLIRVAEEWGVKVSFHPKAVPGDWNGAGCHTNYSTASMRKEGGMKAIEAAIEKLSKRHNEHIAVYGADNDKRLTGKHETGHIGDFSSGVANRGASIRIPRHVAAQGYGYLEDRRPASNCDPYLVTGIVAETTLLL

SEQ ID NO: 5248 - protein, 665 aa, Pyrococcus abyssi
MFIGDRVIRVVCPYCGFGCNLLIDPKTLKVKPYKGEPNRGKLCPKGLHALEFVLSKDRLRYPLKKVGSDFVRIGWDDAIREIASKLREIKERYGPNAIAFIASSKVSNEENYLLQKIARLLGTNNIDNCARLCHEASVHALKMTLGAGVQTNPYSDLENFKAIMIWGYNPAETHPVVMDYILNAKRKGAKIIVIDVRETTTMRLADYKLMINPGTDITLANALMNVIISEGLYDKEFVRSRTVGFSEVKMAVKKYTPEYAEKVTGIEAKLIREVAREFAKAGSGAIMWGMGLTQHVSGVENVIAVIDMALLLGYVGDKGGLYPMRGQNNVQGAAYMGALSEFLPGYVPLTDSTFRKRVASLWGVEDIPTERGLYLTELWDAILEGEVKALYIMGENPAVSEANVLKVRKALQKLELLVVQDLFLTRTARFAHYILPAAAFCEKEGSYMNSERRIQWSFKVCDPPGEAKPDWEILSLLGKELDLPGFPYEKVEDITEEYFKMFPELAGISVEELKNSNGIIIPYKRLHTIRFQTPDGKARLIAVEQIMPWEQPNGEYPLILTTVRVMSHYNTGEMTMRSPSLVKLMSEPVVYISESDAKKYGIKDGDLVKVETRRGSIVLKAKISKVKEGVIVVPFHFDANILTNDALNKAGTPELKYSSARIRKI

SEQ ID NO: 5249 - protein, 292 aa, Thermus thermophilus
MGEVRHAVLQFRPEKSRLRESLARLRARLEALRPHAPQVVVLPEAALTGYFLQGGVRELALTRHELLELLVGVYEKVGWEGVLDVVVGFYERDEGAYYNSAAYLELPHRVVHVHRKVFLPTYGVFDEERYLARGRRVEAFRTRFGRAALLICEDFWHSITATIAALDGAEVIYVPSASPARGFQGGYPENVARWRTLAQAVAAEHGLYVVVASLVGFEGGKGMSGGSLVVGPDGRVLAEAPLFEEAALLFALDRERIPPVRYDSPLLSDLEAGLPLLLSDLQRVLGRRDADT

SEQ ID NO: 5250 - protein, 481 aa, Rhodopirellula baltica
MPLIKNSVPKQVDRMSYLFHTDEDRREMLKSIGANSIDEIINDQVPEAVRMKRPLDLPPACNELALTAEMTRLAARNASADSHVCFLGGGAYDHFIPAAVDEIASRGEYYTSYTPYQAEVSQGNLQVMFEYETLVTQLTGLGVSNASLYDGGSAATEAVLMALSMQRGRNKVITTDVVHPQYRDILVAYLKNIDAELVVVPSDENGHSKPMIDAIDDKTACVLIQHPNFVGQLESVSEIAAAAKEAGALTIQVFDPVSLGRLKRPGDMGVDIAIAEGQSLGNPLAYGGPYLGIMACRDELVRRLPGRIAGQTTDRRGKRCWVLTLQTREQHIRREKATSNICSNQTLLALRATVHLSLLGPEGLKETADHCIAKTAYAKEVIAKSDRFEIVGEGPSLKEFVVRDLGADVDGLLAHARDNGLLAGIDMTPMCVGGAEATDASIALPSRYEQCFLVAVTEKRSRVEIDRWAKVLCEAPAMATV

SEQ ID NO: 5251 - protein, 161 aa, Oryza sativa
MKPSTVLPETESICPHGRLRLDQFFEVEMKVRDYELDQYGVVNNAIYASYCQHGRHELLESVGISADAVARSGESLALSELHLKYYAPLRSGDKFVVKVRLASTKGIRMIFEHFIEKLPNRELILEAKATAVCLNKDYRPTRISPEFLSKLQFFTSEGSSS

SEQ ID NO: 5252 - protein, 266 aa, Mesoplasma florum
MAYKEVTRDELSAAGVQYGHQTKRWNPKMAPFIYGSKSKNHVIDLEKTLIQLRQAEKLVQSIGAKGEKVLFVGTRRSAKLAVKEAALRSGNYYVNQRWLGGTLTNFKTIVKRIKALWEIEESEKNGQLALRTKKEQILILKEKANLEKSLGGIKQMRKLPAALIVVDPKSDEIAVKEAIKLNIPVIGLCDTNVDPDIVTLPIPANDDLQESVNIMINALVDAFADGANLKLAPSVLKTVVVKRERTEGENNYSNNRSWNKPERTNN

SEQ ID NO: 5253 - protein, 240 aa, Coccidioides immitis
MPRSNASNDDDTAALLDALEHEESNPVYNSQRIAQIKAELSSTKTSQSNPIADTTPSSAGTVTTLLNNSPLPTLPTDQAVLDFTTQLSHCILHFSHPDFARCATMDKHLTCLSTAHSSSSGARFARVDVRNVPFIVEKLKIRVLPCVIGFVDGEVRERVLGFEGLGTGGLDALGDDFDTGVLEDRFVKKGILSGVKIGRKGRDDDGQSDGSEDWEEKRNRGKKSIRSGRRKVEDDDSDWD

SEQ ID NO: 5254 - protein, 763 aa, Oryza sativa
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYANTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 5255 - protein, 465 aa, Mesorhizobium loti
MGAKHGSGKNRPTWKEEREKEAAELGFKTQPYTLIIGGGQGGIALGARLRQLGVPTIIVEKNERAGDSWRKRYKSLCLHDPVWYDHLPYIDFPKNWPVFSPKDKIGDWLEMYTKVMELNYWSSTEAKSASYDDKTKEWTVVVRRDGKDITLKPKQLVLATGQSGKANLPKFKGMETFKGDQHHSSKHPGPDDYAGKRAVVIGSNNSAHDIAAALWEAGADVTMVQRSSTHISRSDTLMEIGLGSLYSEQALQNGITTAKADLIFASLPYKILHEFQIPAYAEMKKRDAAFYKGLEKAGFMLDWGDDESGLFMKYLRRGSGYYIDVGASQLIIDGSIKLKSGVDVEEIKQHSVLLSDGSELPADLIVYATGYGSMNGWAADLISRETADKVGKCWGLGSNTTKDPGPWEGELRNMWKPTQQEALWFHGGNLHQSRHYSQFLSLQLKARHAGLPTPVYGLQKVHHKG

SEQ ID NO: 5256 - protein, 568 aa, Schizosaccharomyces pombe
MAGLESKVSDMKIKSDVVFYIDEASGNDETGNGSQTSPFKTAIHALETDANCTIFVKKNGSEEFEPITTNALKKAKKGVEQAAKKKAKAAEAEAAAAARAAAAKEAEAKRLEAAKNIVLKEPKDAPAAKKIAIIDSTNFRDSRVRVNGWVHRMRTQKGIIFIILRDGTGFLQCVLSGKVYDRASYDFINLGPESTVCLYGVIKELPEGKSAPGNHELVVDYYQILHAAPTGEEAFTNRLNAEAEPSYLLDQRHLVIRGETASSVLKVRARALRAMRDTFENLKMTEVTPPCMVQTQVEGGATLFKFNYYGQDAYLTQSSQLYLEAALPALGSVYTIQESFRAEKSLTRRHLSEFTHVEFELPFVNFGEFLEIIEEFICQTIDRLLDDPIATPLIKQLNPDFVKPSRPFMRLSYEDAIKYLNEHNILTPEGEQHKFGDDIAEAAERKMTDQINRPIFLTYFPLEIKSFYMKRVVDRPELTESVDCLMPNVGEIVGGSMRISDIQELLAAYKREGIDPAPYYWFTEQRKYGTTEHGGCGLGLERFLAWLCDRYTVRECCLFPRFTERCTP

SEQ ID NO: 5257 - protein, 424 aa, Ralstonia eutropha
MSNTQSFFSQPLAERDALVRGALSKELERQQSQVELIASENIVSRAVLEAQGSVLTNKYAEGYPGKRYYGGCKFADEVESLAIERVKQLFNAGFANVQPHSGAQANGSVMLALTKPGDTVLGMSLDAGGHLTHGAKPALSGKWFNAVQYGVNRESMLIDYDQVEALAKEHKPSLIIAGFSAYPRQLDFARFRAIADSVGAKLMVDMAHIAGVIAAGRHSNPVDYAHVVTSTTHKTLRGPRGGFVLTNHEEIAKKINSAVFPGLQGGPLMHVIAAKAVAFGEAMTSDFRTYIDNVLANAKALGEVLKEGGVDLVTGGTDNHLLLVDLRPKGLKGTQVEQALERAGITCNKNGIPFDTEKPTITSGIRLGAPAATTRGFGVAEFREIGRLILEVFEALRANPEGDAVTEQRVRQQIFALCDRFPIY

SEQ ID NO: 5258 - protein, 805 aa, Candida albicans
MATSNNSTVAGSQTTPKYNINSEENQLMIKNLNLIAARDSSLNALMRTVALGQASMQQIDVFKEYIKRAKAMGPPPHDDSVWEEVFRTPVWGSVINNESQSSQESKPSSSENKKDKDSVESKVKEEADKTTQSNDKEKLPKETSSKNEEKAEEAEGQSKDLESTEKKELNPKDNVNVNKNENEKSGLKDKVETNEKESKPKEKEEIKDKEEQTKKNSQDSKKDKVEIDSKEEKETDKQKIEKNEESEKNKAEEPKKDKSEESTKSNEESKKDEESKKDEETSKKKDEDKTQANEDSTKGKKVEIDVKKEDTNEKEIPPETKSDKDLKDLPSKEKKKSFEKPPKVKKEKLPKQSKHSKAEIPDDQKLTAFQERYLEDATLLFEFVENPNVRFLLPKDAICEVLPASTMINAENGNNSDNRDILMSFIWIHNQKEVDEYEKKLEEYKKKKAEEEEKKRQKEKEEEEEEERKNKEQLEKEKSNEKNKEGDESKSVQSLDEVQEGQSKDVEMGDNTTNTVKSENEVIEISDDVQATEEPEEIKQVIEEIEETEETEEIEEIEEIVPAKRRAPPRRGKKKRRVPPPKKPTTPKPLEPPVEPEYRFTTLSFTIHGIPSKLVPIFMNSVNPIKEVQTKMKHILEVGTRTSSFYLWYQVDGKLDEELAENIRVSLNQEEKKMTGIPTIQHETPSEPKKYPKKRKIKEESKTGNEQGDDDLGENNNNNNNNNSKKIKVESIEDNDEQNEGNKSENDSKVRDESNELVSKDHDNDESQPQNEDVKEAPVATDTVDSLISDQIEQTPEPIKENSST

SEQ ID NO: 5259 - protein, 238 aa, Arabidopsis thaliana
MSHYIRPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMVRNKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 5260 - protein, 487 aa, Unknown
  Nocardioides sp. JS614
MHVVVIGAGFGGLGMAHALRQAGVTDVTVLERADEIGGVWRDNTYPGAACDVPSPLYSWSWATNPEWGRRYSPQPEILDYIRRTAAADGLLELVRTGVEVSAVEYDDATSTWRVTTSTGTVTADLVVSAVGQLSNPVVPAIPGASTFAGPAFHSAHWRHDVDLTGKRVAVVGTGASAIQFVPGIVDRVGAITIFQRSAPYVVPKPDQAYRPRHHRLFRRWPGIPAAERRAVYWLTERLNGALAGESPISRPMIAALRAAWRLQLRRQVRDPELRHRLVPDYPIGCKRLLFSNDWYPALDRDHVEVVTDRITGIEPAGVRTADGALHEADVLIWGTGFAATEFLAGIDVRGAGGVSLKELWADGARAHLGLTVPGFPNLFCVYGPNTNLGGSSIIAMMEAQAGWIAQVARRIADGRAHRVAVRRDVWEVYDREMQGRLGESVWAGCDSWYVDGDRITTNWPGLVTEYKQRTATVDWSELQEVDLQRAK

SEQ ID NO: 5261 - protein, 475 aa, Pseudomonas aeruginosa
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 5262 - protein, 447 aa, Pediococcus pentosaceus
MADKTSGKGLPTLSKNLIWMINFGFLGVQTAFTLQSSQMSRIFQTIGADPNNLGWFFILPPLAGLIVQPIVGYYSDRTWKPRLGGRRLPYLILGTLIAVIVMLLLPNSGSFGFGYGSLMALWFGAITVAFLDLSSNVAMQPFKMMIGDMVNDKQKSYAYGIQSFLSNTGAVLAAIFPFLLTWLGIANTANKGVVPQSVVISFYAGAILLIITSLFTVFRVKEYDPATYAMYHGISEKENSEGGNWITLLKNAPKAFWTVTLVQFFCWFAFQYLWTYSAGAIAQNVWHTANASSAAYQAAGNWYGVLAAVQSIAAVACSYVLAKLPNRFHKSGYAVSLILGALGFVSVFFVHNQYILIVSYILVGIAWAGMNTYPLTIVTNALSGNHMGTYLGLFNGSICLPQIVASLLSFGLFPLLGSSQANMFLLAGAVMLLGAFAVGTIKETFAE

SEQ ID NO: 5263 - protein, 628 aa, Lactobacillus helveticus
MQANINWLDNPEVFRVNQLPAHSDHPFFRDYREWQKQHSSYQQSLNGKWKFHFSANPMDRPQDFYQRDFDSSNFDSIPVPSEIELSNYTQNQYINVLFPWEGKIFRRPAYALDPNDHEEGSFSKGADNTVGSYLKRFDLSSALIGKDVHIKFEGVEQAMYVWLNGHFVGYAEDSFTPSEFDLTPYIQDKDNLLAVEVFKHSTASWLEDQDMFRFSGIFRSVELLGIPATHLMDMDLKPRVADNYQDGIFNLKLHFIGKKAGSFHLLVKDIKGHTLLEKNEDIKENVQINNEKFENVHLWNNHDPYLYQLLIEVYDEQQNLLELIPFQFGFRRIEISPEKVVLLNGKRLIINGVNRHEWDAKRGRSITMSDMTTDINTFKENNINAVRTCHYPNQIPWYYLCDQNGIYVMAENNLESHGTWQKMGEIEPSDNVPGSIPQWKEAVIDRARINYETFKNHTSILFWSLGNESYAGDNIIAMNEFYKSHDDTRLVHYEGVVHRPELKDKISDVESCMYLPPKKVEEYLQNDPPKPFMECEYMHDMGNSDGGMGSYIKLLDKYPQYFGGFIWDFIDQALLVHDEISGHDVLRYGGDFDDRHSDYEFSGDGLMFADRTPKPAMQEVRYYYGLHK

SEQ ID NO: 5264 - protein, 448 aa, Streptococcus pyogenes
MSKKLISIVDVKDYVGQEVTIGAWVANKSGKGKIAFVQLRDGSAFFQGVAFKPNFIEKYGEESGLEKFDVIKRLNQETSVYVTGIVKEDERSKFGYELDITDLEIIGESHEYPITPKEHGTDFLMDNRHLWLRSRKQMAVMQIRNAIIYATYEFFDQNGFIKFDSPILSENAAEDSTELFETDYFGKPAFLSQSGQLYLEAGAMALGRVFDFGPVFRAEKSKTRRHLTEFWMMDAEYSFLSHEESLDLQEAYVKALIQGVLDRAPQALDILERDVEALKRYITEPFKRVSYDDAITLLQEHEADEDTDYEHLEHGDDFGSPHETWISNYFGVPTFVVNYPASFKAFYMKPVPGNPERVLCADLLAPEGYGEIIGGSMREDNYDALVAKMDELGMDKSEYDFYLDLRKYGSVPHGGFGIGIERMVTFVAGTKHIREAIPFPRMLHRIRP

SEQ ID NO: 5265 - protein, 329 aa, Burkholderia xenovorans
MAKQFGATSTTDDVLSGKRLDGKRILVTGVSAGLGVETARALASHGATVVGAARDLEKAERAITSARQEAVAGGGSIELIELDLASLASVRACSDKLLAEGKPFDIVIANAGVMATPQGKTADGFETQFGTNHLGHFVLVNRLARLLHDGGRVVMLASSGHRFANVDLDDPGFERTPYDPFVAYGRSKTANILFAVAFDQRHRARGVRAAAVHPGGIQTELGRHMGEEQLATMVETINKQLASEGKPPFQFKTVPQGAATSVWTAAVASAEEIGGRYCENCHVSEVVPDDTVITPVSEGVRRYALDLANAEALWRKSEQMVGETFPASA

SEQ ID NO: 5266 - protein, 338 aa, Anisodus tanguticus
MEVISNHNNGSTTKIILKNGSICNGNVNGNSHSHEKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIETIDIVEIDDVVVDVSRKFFPYLAAGFDDPRVTLIIGDGAAFVKAAQPGYYDAIIVDSSDPIGPAKDLFERPFFEALAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 5267 - protein, 550 aa, Wolbachia endosymbiont
MNNNDPTVNLPISIRKLSSNKFIEEICQDQFEDQDNALFEDSFINKIKEGDVVEGIITRVNPNDIVVHIGLKSDGRIPIKELGCNDKIVVGSKIRVYVERIEDYHGNVVLSREKAIRDEKWNKLEEDAVTKAEVSGVIKRSIKCGFIVDLGDGISAFLPLSHVDLKQVKDARHLIETEQKFIVLKMDKKQGNIVVSRKLVLEKLHAGEKTKFLEFLNEGDIIEGKIKSITHYGVFVGIHESDAVGVIDGLLHITDISWSRVSHPSAAFACGQIIKVKIIKIDKENAKVSLGIKQLEDNPWQDVESKYQVDSIHKGHITSIEDYGLFVELKPGIEGLVHSSEITWVKSNLPVNSLVTRGQEVSVKILNVDITKNRMSLSMKRCVDNPWQVFVNKYPPGSIVSGKVKNNTISYMSITFNDDEIDENVEGTIYAQDLSWSKNGSDEIKKYNVGDTIEAKVIRANVNRTRIYLGIKQIEYDPLIELIKKVKVGDKMQVTVGKREDSGLVVEVENDVALLIDQEHLPESKKFSISDKIEVEVLGVEEYNVILSAK

SEQ ID NO: 5268 - protein, 606 aa, Unknown
  Delphinium x belladonna
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDKHTILKTTLVELGRTLGLEECALCMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVFKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLRDWQAPEIFMVSSDSHFHLCVQVKDSGCGISPQEIPHLFTKFTQLRSGQNRGNDGAGLGLALCKRFLNLMEGHIWVDSDGTDKGCTVTIIVKLGICEGQPEPSNLQVVSRPRLS

SEQ ID NO: 5269 - protein, 427 aa, Crocosphaera watsonii
MTDTNLDFLAQTDPTLAAMIQGELQRQREHLELIASENFTSAAVLAAQGSVLTNKYAEGLPKKRYYGGCEWVDQAEQLAIDRVKELFGAAHANVQPHSGAQANFAVFLTLLKPGDKIMGMDLSHGGHLTHGSPVNVSGKWFEVCHYGVSAETERLDYDAILELAKKEKPKLLICGFSAYPRIIEFDKFRAIADEVGAYLMADIAHIAGLVASGHHPNPLPYCDVVTTTTHKTLRGPRGGLIMTNDPELGKKFDKSVFPGTQGGPLEQVIAAKAVAFGEALKPEFKVYSGEVIANAQSLANQLTQRGFKLVSGGTDNHLMLVDLRCIDMTGKEADKLVSEINITANKNTVPFDPESPFVTSGLRLGSPAMTTRGLGVDDFAEIGNIIADCLLNRNDEGVKQDCLNRVKALCDRFPLYPHLNIPVPVLA

SEQ ID NO: 5270 - protein, 430 aa, Arabidopsis thaliana
MAQILAASPTCQMRVPKHSSVIASSSKLWSSVVLKQKKQSNNKVRGFRVLALQSDNMSLNSDEILLNLSDSTYKDRIIAEYIWVGGSGMDMRSKARTLPGPVTDPSQLPKWNYDGSSTGQAPGEDSEVILYPQAIFKDPFRRGNNILVMCDAYTPAGEPIPTNKRHAAAKVFSNPDVAAEVPWYGIEQEYTLLQKDVKWPVGWPIGGYPGPQGPYYCGIGADKSFGRDVVDSHYKACLYAGINISGINGEVMPGQWEFQVGPAVGISAADEIWVARYILERITEIAGVVVSFDPKPIPGDWNGAGAHCNYSTKSMREEGGYEIIKKAIDKLGLRHKEHIAAYGEGNERRLTGHHETADINTFLWGVANRGASIRVGRDTEKEGKGYFEDRRPASNMDPYIVTSMIAETTILWNPTLEAEALAAQKLSLNV

SEQ ID NO: 5271 - protein, 980 aa, Idiomarina loihiensis
MLINATQLEELRVALVDGQRLYDLDIESPGHEQKKANIYKGKITRIEPSLEAAFVDYGAERHGFLPLKEIAKTYFPQGYTFQGRPNIKDVVKEGQEVIVQIDKEERGQKGAALTTFVSLAGSYLVLMPNNPRAGGISRRIEGDERSALKEALSDLNVPKEMGLIVRTAGVGKSKEELEWDLNVLLNHWEAISKAADERPAPFLIHQESNVIFRALRDYLRRDIGEVLIDSPKVYEQVRSHIQLIRPDFLQRVKQYEGDVPLFSHYQIESQIESAFQREVRLPSGGSIVIDPTEALTSIDINSSRATKGGDIEETALQTNLEAAEEIARQLRLRDVGGLVVIDFIDMTPARHQRDVENRLRDSLSQDRARIQVARISRFGLMEMSRQRLRPSLGESANNVCPRCNGQGTIRSSDSLALSILRLIEEEAIKDNTIQVHAQVPVDVATYLLNEKRQSVNHIEKRHNVKIVIIPNHHMETPHFEVLRIRDDEVPESASFELVQKPEQTESTVSITLTQDKAKFEEPALKGLQAPSAAPTPAPAPKVEEKKAAQPSLLSRLATWFSGLFGSDEAQKQAEAEKEKERNAQNQRNQQRRGRNRRSGNRQQRGRNQSAGKDKEASKENTSAATEDKSTESRDDAGNRNSRNRNDRRRRGRSNKNQQQPKPEAVKNEQVDSPAEAEKPKEAKAVQDKPRRQRKPIEKSVRVSSTGDSVEAKEPTQPAQKAVDASTDGADTQKPTQAKEKTAKQSGSDKSENKAISDKVLDPRMQAAAELVQNQTQSATPAEQSEEKSVEKSVDESTEEKSPQADTQVTQQTETSTDETVQTPDTTKPEADPEVASDDKVEASVEQASEAVSATEEQSNSSETPEEPPKPTETEDTVEEKPEPKAEEKKSRDRSRRSPRHQRAAGQKRKQMKTEAVIPNRSLSGSSFSAMTKATAEERKEAFKALPVASSDNRPQFVKDSRIASISQARSTSYAEMAKCD

SEQ ID NO: 5272 - protein, 596 aa, Unknown
  Delphinium x belladonna
MMGSCDCIDTRWPANDLLVKYQYLSDFFIAVAYFSIPLELIYFVQKSAFFPYRWVLMQFGAFIVLCGATHLISLWTFSMHSKTLAMVMAIAKGATALVSCATALMLVHIIPDLLSVKTRELFLRNKAEALDRDLGLIRTEEETGRHVRMLTHEIRSTLDRHTILKTTLVELGRILDLEECALWMPSRNGMNLQLTHTLHHHIPVGSTVATNLPVVNLVFNSTEAIQIPPTCPLARIKPHTGRYLPPEIVAVRVPLLHLSNFEINDWPELSAKSYAVMVLMLPIDSARKWHDHELDLVEVVADQVAVALSHAAILEESMRARDKLMEQNIALDLARQDAERAIRSRNDFLAVMNHEMRTPMNAGMALSSLLLEIELTPDQRVMIESVLKNSNILETLINDVLELSRLEDGSLELNVKTFNLREAFREVLKLLKPIAAVKKLSLTLKVAPDLPVWAVGDETRIMQIILNVVGNAVKFTKEGHISVAACVAKAESIRGGLTPESHPLSSDSHFYLRIQVKDSGCGISSQDIPHLFTKFAQSRGGQIRNNDGAGIGLALSKRFLHLMGGHVSIESDGTGKGSTVTMVLKLGTSDGPNPQI

SEQ ID NO: 5273 - protein, 430 aa, Arabidopsis thaliana
MAQILAASPTCQMRVPKHSSVIASSSKLWSSVVLKQKKQSNNKVRGFRVLALQSDNMSLLADEVLLNISDNPEKDRIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNPTLEAEALAAQKLSLNV

SEQ ID NO: 5274 - protein, 511 aa, Coprinopsis cinerea
MSKPSLDSDLYGDIYGDELQDFLDDDGTANDATEQTSTEPQDASDDANRSASPQQAMDTSSSDNTQPGQLSYSAQIAQQFSAYKQTPSQERQQRAAQRPIPRVDSSTPAASSSDSIFGKKPSEMHDAGKMFIGGLSWDTTDEGLRDYFEQFGKVDACTIMRDPNTGTSRGFAFLTFEDPNCVDLVLKQSHSLDGKAIDPKRAIPREEHLRNTRFFVGGLAHSTTSESMKAFFSSYGKVVDATVMMDKETGRSKGFGFVTFEDVGTSLNHIVGKIGLVLDDKEIEIRLAQARNQRDQTRNLVNKITSDRGSTPDRSSTTPSPALSLPALNLAQMGPMAAMLFNRSMGNLGAMNMANMNNNPMSIPNTPMNNMGMPMNMSMNNMNPAAGGAMPLNVMAAMNPMMLASLNMANLASGNASGGNSNSAGAPIQNPLNAMAGMNMMLMNGLNPTMRMGMGGMIPGMAGAAGMQQGMAGMMNNSGRGKPGGMQPNGLGPARTHGAMRKQQGFHPYSR

SEQ ID NO: 5275 - protein, 430 aa, Arabidopsis thaliana
MAQILAASPTCQMRVPKHSSVIASSSKLWSSVVLKQKKQSNNKVRGFRVLALQSDNSTLLSDEVLLNLTDATGKDRIIAEYIWIGGSGMDIRSKARTLPGPVTDPSKLPKWNYDGSSTGQAAGEDSEVILYPQAIFKDPFRKGNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILGEPTLEAEALAAQKLSLNV

SEQ ID NO: 5276 - protein, 209 aa, Francisella tularensis
MKVTLYTTKYCPYSLRARIALAEKKMSTNIVEAGDLEPAMIKKIAPNGVFPILMEKDYSINNRKALLIYIDERFPAPSLLPNVVNERIKIRLSLDKIDNEWYPVLDQIRKHRSDQKMLESMFKDLKESLLAMEKAFTGSEFFISSGFTLADCYIAALIICLEAEGFIIDDEYGAIYEYKKRLFARDSVKKANIKGGAGESLLKTLRTHR

SEQ ID NO: 5277 - protein, 276 aa, Unknown
  Bradyrhizobium sp. ICMP 14754
WGFDGSSTQQAEGHSSDCVLKPVAVFPDGARTNGVLVMCEVMMPDGKTPHASNKRATILDDSGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTIGGKEYFEALMAAFDKNLMDHIAVYGPDNDKRLTGKHETAPWNKFSYGIADRGASIRVPHSFVNNGYKGYLEDRRP

SEQ ID NO: 5278 - protein, 276 aa, Unknown
  Bradyrhizobium sp. ICMP 14755
WGFDGSSTQQAEGHSSDCVLKPVAVFPDGARTNGVLVMCEVMMPDGKTPHASNKRATILDDSGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRP

SEQ ID NO: 5279 - protein, 276 aa, Bradyrhizobium liaoningense
WGFDGSSTQQAEGHSSDCVLKPVAVFPDAARTNGVLVMCEVMMPDGKTPHPSNKRATILDDAGAWFGFEQEYFFYKDGRPLGFPASGYPAPQGPYYTGVGYSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRP

SEQ ID NO: 5280 - protein, 74 aa, Thermotoga maritima
  misc_feature (38)..(38): Xaa can be any naturally occurring amino acid
MGKEDVIRMEGTIIEALPNAMFRVELDNGHKVLAHVSXRMRKNFIRLVPGDRVIVELSVYDLTRGRIVYRKKPE

SEQ ID NO: 5281 - protein, 332 aa, Clostridium acetobutylicum
MGGVTFIGGGSFGTALAIMLAKKGHNVVIWDRNKEILEDINTLRTNTRYLPNNIIPCCVKAVDDIEKAAKESKYIVLAVPSFAIREVCRKIKGFLREDQIIISIAKGMEEETKKRLSEVVKEELYKNPVVVLSGPSHAEEVANDIPTTVVVTSTDMKYAEEVQDVFMTNSFRVYTNSDIVGVEIGGAVKNIIALASGIGDGIGYGDNTKAALMTRGMSEIMRIGVKLGGKPETFFGLTGMGDLIVTCTSMHSRNRKAGILIGRGMSCREACDKIGMVVEGVKACHTFYELKESLGVSMPITTSLYKVLFENGDPKKEVYELMARDKKNEYYF

SEQ ID NO: 5282 - protein, 276 aa, Bradyrhizobium elkanii
WGFDGSSTQQAEGHSSDCVLKPVACYPDAARENGVLVMCEVMMPDGKTPHPSNKRATILDDDGAWFGFEQEYFFYKDGRPLGFPEEGYPAPQGPYYTGVGYKNVGSVARKIVEEHLNLCLAAGINHEGINAEVAKGQWEFQIFGKGSKTAADQMWMARYLMLRLTESYGIDIEFHCKPLGDTDWNGSGMHANFSTKYMREVGGKEYFEKVMGAFEKNLMDHIAVYGPDNDKRLTGKHETAPWNKFSYGVADRGASIRVPHSFVNNGYKGYLEDRRP

SEQ ID NO: 5283 - protein, 309 aa, Nostoc punctiforme
MTNSKSVAILGAGAWGASLANLAAANGHQVRVWSRQGSQTLQTVLEDAQIILSAISMIGVRDVASQIQSFSLSPETIFVTATKGLDPQTTCTPSQIWQTVFANHAVVVLSGPNLSKEIQLELPAATVVASNIPTAAEVVQLVFSSHRFRVYTNPDPLGVELGGTLKNVIAIAAGVCDGLHLGTNAKAALVTRGLTEMVRIGNDWGAKTETFYGLSGLGDLLATCNSPLSRNYQVGYQLAGGKTLKETLANLQGTAEGVNTCQVLMQRAKQQNIPVPITEQVYRLLQGEVTPRQALDELMLRDIKPEYNY

SEQ ID NO: 5284 - protein, 276 aa, Unknown
  Mesorhizobium sp. ICMP 11719
WGFDGSSTQQAEGHSSDCVLKPVAVYPDPARSNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKNDYKGYLEDRRP

SEQ ID NO: 5285 - protein, 249 aa, Bordetella pertussis
MSLMREMLEAGVHFGHQTRYWNPKMAPYIFGHRNKIHIINLEQTVAKYQEASKFVKQLVARGGNILFVGTKRAARELVATEAARCGMPYVDARWLGGMLTNFKTVKSSIKRLKDMEAMVADGGFERMTKKEGLLFQRELDKLNKSIGGIKDMNGLPDALFVIDVGYHKIAVAEAKVLGIPVVAVVDTNHSPDGIDHVIPGNDDSARAIALYAKGMADAVLEGREQNINGLVEEIGEGQEEFVEVQDNQA

SEQ ID NO: 5286 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLEQFSAMNKLKKLALRVIAERLSEEEIAGLREMFKAVDTKNRGVITFGELREGLRRFGAEFKDTEIGDIMEAAHNDNNVTIHYEEFIAATLPLNKMEREEHLLAAFTYFDKDGSGYITVDKLRRACGEHNMEDSLLEEIISQVDQNNDGQIDYAEFVAMMPGSNVGLRWQTMESSLNVALRDAPQVH

SEQ ID NO: 5287 - protein, 465 aa, Clostridium perfringens
MKDVVLVKSLYRNTSEYSDKKVKISGWIRTLRASNAFGFIEVNDGSFFKNVQVVFDSAKISNYKEISKLPISSSISVIGTLVETPDSKQPFEIQAEEIIVEGMSDSDYPLQKKRHTFEYLRTIAHLRPRSNAFSATFRVRSVAAYAIHKFFQDQGFVYTHTPILTGSDCEGAGEMFRVTTLDMMAPPIAEEGGIDFSQDFFGKETNLTVSGQLNAECFALAFRNIYTFGPTFRAENSNTVKHAAEFWMIEPEMAFADLIDDMEVAENMLKYVIKYVMDECPEEIAFFNQFVDKGLLERLNHVVNSEFGKVTYTEAVKLLQESGKEFEYPVEWGIDLQTEHERYLTEQIFKKPVFVTDYPKDIKAFYMRLNEDGKTVAAMDCLVPGIGEIIGGSQREERLDVLKARMAELNLNEEDYWWYLELRKYGETVHSGFGLGFERLIMYITGMANIRDVIPFPRTTGTAEF

SEQ ID NO: 5288 - protein, 830 aa, Yersinia pestis
MKLSRRDFMKANAAVAAAAAAGMTIPTVAKAVGETTNAIKWDKAPCRFCGTGCGVLVGTQNGRIVASQGDPDSPVNRGLNCIKGYFLPKIMYGKDRLTQPLLRMKDGQYDKEGDFTPISWEKAFDIMELKFKNALKEKGPTAVGMFGSGQWTVWEGYAALKLLKGGFRSNNLDPNARHCMASSVVGFMRTFGMDEPMGCYDDIEEADAFVLWGSNMAEMHPVLWSRMTSRRLTNAHVRIAVLSTYEHRSFELADNPIVFTPQTDLVIMNYIANYIIQNNAVDKDFLAQHVNFRRGATDIGYGLRPTHPLEKAAKNPGSDASEPMSFEDFKTFVAEYTLEKAAKMSGVPEDQLESLAQLYADPKVKLVSYWTMGFNQHTRGVWANNMCYNLHLLTGKISTPGSGPFSLTGQPSACGTAREVGTFSHRLPADMVVTNEKHRQIAETTWQLPAGTIPEKVGLHAVAQDRALKDGTLNAYWVMCNNNMQAGPNINEERMPGWRDPRNFIVVSDPYPTISALSADLILPTSMWVEKEGAYGNAERRTQFWRQQVPSPGEAKSDLWQIVEFAKRFNVEEVWPAELVNQKPEYRGKNLYEVLFANDVVSKYPLSEIPDDQLNDEARDFGFYIQKGLFEEYASFGRGHAHDLAPFDVYHQVRGLRWPVVDGKETLWRYREGFDPFVPKGEEVRFYGKPDGKAVIFALPYEPAAESPDQEYDLWLSTGRVLEHWHTGSMTRRVPELHRAFPEAVLFIHPLDAKARGLHRGDKVKVISRRGEVISLVETRGRNRPPRGLVYMPFFDAAQLVNNLTLDATDPLSKETDFKKCAVKLERVVA

SEQ ID NO: 5289 - protein, 156 aa, Kluyveromyces lactis
MDQPAANNQENVTNEQGPLMDLEEDEEIDVFHNVGQGLAGRYREIMIQYWQELINEIESTNEPGSQFQDDFKSHSLPLARIKKVMKTDEEVRMISGEAPILFAKACEIFITELTMRAWCVAEENKRRTLQKQDIADALQKSDMFDFLIDIVPRNVQ

SEQ ID NO: 5290 - protein, 325 aa, Thermus thermophilus
MEFNLSALGSAPAAEETYDVVIIGGGPAGLTAGIYAGRAQLKTVIVEKGLPGGQIAQTDEVENYPGFPEGISGPELASRMVRQAEKFGARIVMDEVLGLEKAEGGYLVRGYERNYRARAVIVATGANPRRLGVPGEDKFYGRGVSTCATCDGFFYRDKEVVVVGGGDAAVEEGIFLTKFARKVTLVHRRDELRANKVAQKRAFQNPKMHFLFSHVVTEILGEDQVTGVRLKNLKTGEEYVYPTDGVFVFIGHEPNTAFLKGVVELRPDGYIAVRDEVFTSEPGIFAAGDVADPIYRQLTTSVGAGTRAAMMAERYLAEEAEKVKG

SEQ ID NO: 5291 - protein, 520 aa, Sinorhizobium meliloti
MTAGNDFQHQAIAAHVAQRLAGPARAILGFQELLVEQARDLGLIHIKGDLDRIGAAARQLNGFIDRLLEGAACPLEEGEAEAEARLRHDLRTPLNAIIGYSEMILEEASDAPEHALKEDLHVILSAAAELLTQVDAIASLSRGETVEMLQPGERAEIDAAGLERLLFKAQEVACPEQGGRILVVDDVASNRDLLSRRLRREGHRVVTAESGLSALARLAEDEFDLILLDILMPDMNGIEMLSRLKSEERWQHVPVIMISGLSDVTAVARCIEAGADDYLTKPFNPILLRARINSTLEKKRWLDREHRYLQQIKTEKLRADSLIRAILPDQIVARLQDGEEIIADRFDEVSILFADIVGFSPIAASLTASDLVRRLDRMFRRFDLLTEQHRVEKIKTIGDAYMAACGIPEPAPDHADRIVALGKSMLRSLQDMEAGPDRFRVRIGIHTGPVVAGLIGRLRFVYDVWGETVNIASRLESQGVADVIQISEATRRALRGPWTLERRCALELRGIGAVETYLVR

SEQ ID NO: 5292 - protein, 521 aa, Pseudomonas aeruginosa
MLDANLKTQLKAYLEKVSQPFEIVASLDDSDKSRELLGLLQDIVGLTDKITLKTDGSDARKPSFSLNRPGADIGLRFAGIPMGHEFTSLVLALLQVGGHPSKLDADVIEQVKGIEGTFEFETYFSLSCQNCPDVVQALNLMAVLNPNIRHVAIDGALFQDEVEARQIMSVPSIYLNGEVFGQGRMGVEEILAKIDTGAAARDAEKLTARDAFDVLVVGGGPAGAAAAIYAARKGIRTGVAAERFGGQVLDTMAIENFISVQETEGPKLARALEEHVRHYEVDIMNLQRASKLVPAKNAGELHEVRFESGGSLKAKTLILATGARWREMGVPGEQEYKAKGVCFCPHCDGPLFKGKRVAVIGGGNSGVEAAIDLAGIVAHVTLLEFDSKLRADAVLQRKLYSLPNVEVITSALTSEVKGDGQKVTGLVYKDRNSEEFKSIELEGIFVQIGLLPNTEWLKGSVELSPRGEIIVDARGETSLPGIFAAGDVTTVPYKQIVIAVGEGAKASLSAFDHLIRTSAPE

SEQ ID NO: 5293 - protein, 267 aa, Triticum aestivum
MAAMATTASSLLKPSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGVKRLQDIGMIQAVPGMKALDMNTAEVP

SEQ ID NO: 5294 - protein, 257 aa, Unknown
  Synechococcus sp. WH 8020
MTNQRFKSTDPVNIEGWSWQPFLEDAIKRLEGLNVEPYPVPDRFLQREDQTGSKSKSIPVTTATWACKTEKFRQVRAACVSAGSAASVLNFVINPKSTYDLPFFGGDLVTLPAGHLLALDLQPAIKTDEVHTTHVWDRLIPIFERWRDQLPYGGPIPEEAQPFFSPGFLWTRLPLGEEGDELIQSIVRPAFNDYLDLYLELAASAERVTDERSEVLLQGQRKYTDYRAEKDPARGMLTRFHGSEWTEAYIHTVLFDL

SEQ ID NO: 5295 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAIECGIPMPCMASAITFLDGYTTERLPANLLQAQRDYFGAHTYERTDKPRGEFFHTNWTGKGGDTASTTYDI

SEQ ID NO: 5296 - protein, 560 aa, Idiomarina loihiensis
MSENFAELFEESLKEVETRPGSIVKGTIVAIEKDLILVDAGLKSESAIPAEQFRNAEGELEVSVGDVVDVALDAVEDGFGETILSREKAKRYEAWLQLEKAHEDNATVIGIISGKVKGGFTVDLGGVRAFLPGSLVDVRPVRETTHLENKDLEFKVIKLDQKRNNVVVSRRAVIEKENSAEREELLENLQEGQEVQGIVKNLTDYGAFVDLGGVDGLLHITDMAWKRVKHPSEIVNVGDEITVKVLKFDRERTRVSLGLKQLGEDPWADIANRYPEGHRLTGRVTNLTDYGCFVEIEEGVEGLVHVSEMDWTNKNVHPSKVVNLDDTVEVMVLEIDEERRRISLGLKQCKPNPWEEFAKNHNKGEQVTGKIKSITDFGIFIGLDGGIDGLVHLSDISWNATGEEAVRDYKKGEEVTAVVMQVDAERERISLGIKQLEEDPFNNYLAANKKGAIVTGTVTEVDAKGAKVELAESVEGYVRAADISRDRVEDASTELSVGDSIEARFMGVDRKNRTLSLSIRAKDEVEEKEAVESVNKQQDSGSGLNSAMAEAFKAAKTDDE

SEQ ID NO: 5297 - protein, 433 aa, Magnaporthe grisea
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHGTLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 5298 - protein, 444 aa, Carboxydothermus hydrogenoformans
MKYTPHTPDEVREMLSSLGLSSIEELFSDIPEEVKLKRPLNLPSGMSELEVKKHLANLAAKNGSADKYTVFLGAGVYDHYVPAVVNHILLRSEFYTAYTPYQAEMSQGVLQSIFEYQTMICELTGLDITNASMYDGGSALAEAALMAVSQTRRDKVLVLATVHPEYRSVVKTYTWGPEIEVVEVPYKSGTVDLEKLEELIDDKTAAVLVQHPNFFGQLEPVEEISRLIHAQKGLLVVAVDPISLGILKPPAEYGADIAVGDGQALGNGLAFGGPHLGFFAARKDLARRMPGRLVGLTTDKEGNRGFVLTLQAREQHIRREKATSNICSNQALNALAATVYLATVGKKGLKEIALQSLQKAHYAFERLIGEGYEPLFSGPFFKEFVVKVKNEEEITQKLLKHHILAGPGISRFYPELAPALMIAVTEKRTREEIDNLVEVLGGDR

SEQ ID NO: 5299 - protein, 378 aa, Solanum tuberosum
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 5300 - protein, 375 aa, Solanum tuberosum
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 5301 - protein, 138 aa, Unknown
  Acidovorax sp. JS42
MRLLHTMLRVGNLQRSIDFYTQVLGMQLLRTSENPEYKYSLAFLGFEGGNPGQAEIELTYNWGVESYEMGTAYGHIALGVPDAYAACEKIKAAGGTVTREAGPVKGGTTVIAFVTDPDGYKIELIERKSDAGAGTGLR

SEQ ID NO: 5302 - protein, 486 aa, Carboxydothermus hydrogenoformans
MGSYPLIFELSKEGRTGFELPELDVPAKDINNLIPEEMQRKTEPDLPEVAEVDVVRHYVGLSRRNFGVDNGFYPLGSCTMKYNPKINEDTSRLAGFAELHPYVPEELAQGALELLYDAEQYLKEITGMDRFTFQPAAGAHGEFTGLMIIKAYLEKKGEKRTKVIVPDSAHGTNPATAAMCGFNVISIKSNERGLVDPEELAKVLDKEVAALMLTNPNTLGLFEEEIVKIAKMVHDVGGLLYYDGANLNAIMGVTRPGDMGFDVMHINLHKTFSTPHGGGGPGSGPVGVKAHLAEFLPVPVVEKDGDRYYFNYNLPNSIGKVRTFYGNFLVVVKAYTYLKALGGEGLTDVSQKAVLNANYLREKLKKYFYLPYDRLCKHEFVLSGKWQKEKGVRTLDIAKRLLDYGVHPPTIYFPLIVDEALMIEPTETESKETLDRFIEVMIAISREVEENPELLHEAPHVTPVKRLDEVGAARNPILRWSKDWQK

SEQ ID NO: 5303 - protein, 271 aa, Solanum tuberosum
AQVYIDKFFELPLCEKQKAQRRVGEHCGYASSFIGGFSSKLPWKETLSFQYSDEEGSSHIVEQYFQRTLGEQFSYIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 5304 - protein, 307 aa, Bacillus anthracis
MNVYRGVHELIGHTPIVEITRFSLPEGVRLFAKLEFYNPGGSVKDRLGRELIEDALEKGLVTEGGTIIEPTAGNTGIGLALAALQHDLRVIVCVPEKFSIEKQELMKALGATVVHTPTEQGMTGAIAKAKELVNEIPNSYSPSQFANEANPRAYFKTLGPELWSALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 5305 - protein, 184 aa, Mesorhizobium amorphae
WGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDW

SEQ ID NO: 5306 - protein, 184 aa, Unknown
  Mesorhizobium sp. ICMP 13190
WGFDGSSTMQAEGHSSDCVLKPVAVYPDPTRTNGVLVMCEVMMPDGVTPHASNKRATVLDDEGAWFGFEQEYFFYKDGRPLGFPETGYPAPQGPYYTGVGYKNVGDVARQIVEEHLDLCLAAGINHEGINAEVAKGQWEFQIFGKGSKKAADQMWMARYLLLRLTEKYCIDIEFHCKPLGDTDW

SEQ ID NO: 5307 - protein, 276 aa, Unknown
  Mesorhizobium sp. ICMP 11541
WGFDGSSTMQAEGHSSDCVLKPVAVYPDPTRTNGVLVMCEVMMPDGVTPHASNNRATILDDEGAWFGFEQEYFFYKDGRPLGFPETGYPAPQGPYYTGVGYKNVGDVARQIVEEHLDLCLAAGINHEGINAEVAKGQWEFQIFGKGSKKAADQMWMARYLLLRLTEKYRIDIEFHCKPLGDTDWNGSGMHANFSTSYMREVGGKAYFESLMAQFDKNLMDHIAVYGPDNDKRLTGKHETAPWNKFSYGIADRGASIRVPHSFIKNDYKGYLEDRRP

SEQ ID NO: 5308 - protein, 552 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQAHADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELCKQHVHAGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEACNNA

SEQ ID NO: 5309 - protein, 478 aa, Unknown
  Acidovorax sp. JS42
MLLAIAFMPALPGLPQAGQMMLAILAFAVILWMTEALDYAVSAVVIGALMIVLLAISPVPGKEAAGAMMGTRAALPYALGGFSNSAVVLVAAACFIAAAMTATQLDKRIALQVLSYVPARANHVAMGAILVGFLLSFIVPSATARVACLMPIMLGFLSAFGADRRSKFAALLVITAAQTASVWNIGIKTAAAQNMVAIGFIEKQFGQTITWGEWFVAGAPYSIVLTFALYFIMTRMLKPEMDHIVGGREAIQRQLAELGAMTANQWKLLGITLVLLGFWATEGVLHDVDTTTSTIVAIALMLLPRLGVMGWKESQKGFPWGTVLLFAVGIAMGAALLKTEAAPWLARLIVDSLGLANATAFAIFMLLALFLIVIHLGFASATGLASTMIPIIISVLQAVQTPGINPIGMTMLLQFVVSIGFILPVNSPQGMLAYGTDTFDIKDYVRTGLVLTAVAIALLVVFALTYWPWMGYMTLPAH

SEQ ID NO: 5310 - protein, 276 aa, Unknown
  Mesorhizobium sp. ICMP 11722
WGFDGSSTMQAEGHSSDCVLKPVAVYPDPTRTNGVLVMCEVMMPDGVTPHASNKRATILDDEGAWFGFEQEYFFYKDGRPLGFPESGYPAPQGPYYTGVGYKNVGDVARQIVEDHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFIENDYKGYLEDRRP

SEQ ID NO: 5311 - protein, 388 aa, Streptomyces coelicolor
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDP

SEQ ID NO: 5312 - protein, 72 aa, Desulfovibrio desulfuricans
MAKEDAIEVDGIVQEALPNAMFQVELENGHTVLAHISGKMRKFYIRILPGDKVRVELSPYDLNRGRITYRMK

SEQ ID NO: 5313 - protein, 1031 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 5314 - protein, 540 aa, Nicotiana tabacum
  misc_feature (64)..(64): Xaa can be any naturally occurring amino acid
  misc_feature (67)..(67): Xaa can be any naturally occurring amino acid
MGGCFSKKYRQEGANGGYRATRRNANQEYQKPPQHQPERPYQPQPQPQPQPQPRPQPQAHTVTXQPXQTQDQMQGPHLNNILGKPFEDIRKQYTLGKELGRGQFGVTYHCTENSTGNPYACKSILKRKLVRKNDREDMKREIQIMQHLSGQPNIVEFKGAYEDRHSVHLVMELCAGGELFDRIIARGYYSEKDAAEIIRQIANVVNICHFMGVMHRDLKPENFLLTSKDENAKLKATDFGLSVFIEEGKVYRDIVGSAYYVAPEVLRRSYGKEADVWSAGVILYILLSGVPPFWAETEKGIFNAILKGEIDFQSDPWPSISNSAKDLIRKMLTQEPRKRMTSAQVLEHPWLRMGEASDKPIDSAVLSRMKQFRAMNKLKKLALKVIAENLSEEEIKGLKAMFANIDTDNSGTITYEELKSGLARLGSKLTETEVKQLMEAADVDGNGTIDYIEFITATMHRHRLERDEHLFKAFQYFDKDHSGFITRDELESAMKEYGMGDEATIKEIIAEVDTDNDGRINYEEFCAMMRSGTQPQPKLF

SEQ ID NO: 5315 - protein, 589 aa, Saccharomyces cerevisiae
MTISSAHPETEPKWWKEATIYQIYPASFKDSNNDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQPSDPFTMNGPRIHEFHQEMNKFIRNRVKDGREIMTVGEMQHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 5316 - protein, 682 aa, Glycine max
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYDPLSLVRDHRAKEVLTAQGITVRSFNADLLYEPWDVNDAHGRPFTTFAAFWERCLSMPYDPESPLLPPKRIIPGDASRCPSDTLLFEDELEKASNALLARAWSPGWSNADKALTAFVNGALIEYSKNRRKADSATTSFLSPHLHFGEVSVKKVFHLVRIKQVFWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELARLPTEWIHHPWNAPESVLQAAGIELGSNYPLPIVGIDAAKVRLLEALSQMWQQEAASRAAMENGTEEGLGDSSESAPIAFPQDIQMEERPEPVRNNPPHGTRRYQDQMVPSITSSHVRVEEEETSSDLRNSAADSRAEVPINVTTQQNARETVNQGVLLNTNRNTRVQNNPTTWLRNAAEDSTAESSSSTRRERDGGVVPVWSPPASNFSEQFVDDENGIGTGSSYLQRQHPQSHQLMNWTRLPQTG

SEQ ID NO: 5317 - protein, 98 aa, Mastigocladus laminosus
ATYKVTLINEAEGLNKTIEVPDDQYILDAAEEAGIDLPYSCRAGACSTCAGKLISGTVDQSDQSFLDDDQIEAGYVLTCVAYPTSDCVIETHKEEELY

SEQ ID NO: 5318 - protein, 413 aa, Thermus thermophilus
MTATSLWELAERARKRLSEIAKGNRDRALLAMADLLEARWEEVLRANREDLEEAERTGLPKAKLDRLALKEKDLKTLTEGLRQIARLPDPLGRIEGLAKRPNGLRVGRMRVPLGLIGFIYEARPGATVEAVSVALKAGNAMLLRGGKEAFRSNRALVALWHEALGEAGLPEEAVTLVPTTDREAVLEMCRLELLDLLIPRGGEELIRLVQREARVPVLAHAKGVNHLYVDKKADLSMALRLALNGKTQRPAVCNALETVLVHEKVAEAFLPRLEKAMREKGVELRACPRALPLLKEAVPAREDEWDREYLDLVLRVKVVSGLEEALAHIARYGSRHTEAICTEDPKAAWRFLEEVDASLVLWNASTRFNDGFELGLGAEIGISTSKLHAYGPMGPMELTTLKWVALGEGQERT

SEQ ID NO: 5319 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 5320 - protein, 265 aa, Glycine max
  misc_feature (261)..(261): Xaa can be any naturally occurring amino acid
LRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCVGVGESDGSIWNPDGIDPKELEDFKLQHGSILGFPKPRXYEGS

SEQ ID NO: 5321 - protein, 336 aa, Thellungiella halophila
MAKSLNILIVALSLIAFSPLCLCSKAYGSGGYLFPQFYDHSCPKAQEIVQSIVAKAFAHDPRMPASLLRLHFHDCFVKGCDASILLDSSGTIISEKRSNPNRDSARGFELIEEIKQALEQACPETVSCADILALAARDSTVITGGPSWEVPLGRRDARGASLSGSNNDIPAPNNTFQTILTKFKRQGLNLVDLVSLSGSHTIGNSRCTSFRQRLYNQSGNGKPDLTLNQYYAYVLRKQCPKSGGDQNLFSLDFVTPFKFDNHYFKNLIMYKGLLSSDEILFTKNRESKELVKLYAENQEAFFEQFAKSMVKMGNISPLTGMRGEIRRICRRVNHAY

SEQ ID NO: 5322 - protein, 391 aa, Unknown
  Nocardioides sp. JS614
MSQDLYELLGVGRDADADAIKKAYRRLARQYHPDVNPDPEAQERFKEISLAYEVLSDPQKRAHYDRGGDPFGGGAGGFGQGAGFSFTDIMDAFFGGGGAAGAGRGPRPRERRGQDALIRLEVELAEAAFGVTREIKVDTAVRCSTCHGEGTAAGTHPIPCETCHGAGEVAHVQRSFLGEIRTLRPCPACRGFGTIIPEPCRECSGDGRVRSRRTLTVKIPAGVDNGTRVQLSGEGEVGPGGGPAGDLYVEIHTAPHETFTRHGNDLHCTVTLPMTAAALGTTLTLPTLEADVVTGDPDESEVETSFDLDVRPGTQSGTEQVLRGRGVPGLRGGRGDLVVTVVVETPTRLDPRQEELLIELAAIRGEEAPTGQVRPGAKSVFGRLRDAFNAH

SEQ ID NO: 5323 - protein, 337 aa, Thellungiella halophila
MSPVPERTKLHIAMAVFQTGYAGNHVIMRFALNLGVSKLIFPLYRNIIALSVLAPSAFFLEKKERPRMTTSLLIQFFLLGLVGITLNQGFYIFGLDNTSPTFASATENAVPAVSFLMAALLGIEKVELKRRDGVAKVVGTFVSVAGSLAITLYKGPTIYQPSLRSMDQPTNAGEAEEQNKNWTLGCVCLMGHCLCWSSWIVLQSPLLKRYPARYSFVSYSCLFAVFQIVGISAYFERDLESWKIKSGREMYALLYTGLVGSGMVFAIQIYVVERGGPLFVSAYLPLQTLLAALLATFALGEHLYLGGLIGAILIICGLYLVVMGKSGRRKLFANSNT

SEQ ID NO: 5324 - protein, 256 aa, Unknown
  Synechococcus sp. WH 5701
MRIVGAGPGAIDLMTVRATRAVEAADVLVWTDSLVSPQIAALAPQHCERIRTSTLTLEEVMELVVERARAGLRVVRLHDGDPCLYGALAEQICRLADAGLEVEVVPGLSAYQATAAALKAELTIPGLVQTIVLSRAGGRTGVPERESLAHLASLRASLCLYLSARHVESVQQELLEHYAADTPVAIGYRVSWPDQWLQVVPLEQMAAVSRERQLIRTTLYVVSPALAAPEQARSRLYSASHDHLFRAATAAGGSEG

SEQ ID NO: 5325 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 5326 - protein, 834 aa, Mannheimia succiniciproducens
MGNIMELNRRDFMKANAAVAAAAAAGITIPVKNVHAADDDMGIRWDKAPCRYCGTGCSVLVGTKDGRVVATQGDPDAEVNRGLNCIKGYFLSKIMYGADRVQTPLLRMKDGKFHKEGDFTPVSWDQAFTVMADKIKAILKEKKDPNAIGMFSSGQTTIFEGYAKVKLWKAGLRSNTIDPNARHCMASAAVAFLRTFGMDEPMGCYNDIEKTDAFVLWGSNMAEMHPILWSRISDRRLSSDKVKVVVMSTFEHRSFELADTPIIFKPHSDLAILNYIANYIIQNDKVNWDFVNKHTKFKRGETDIGYGLRPEHPLEVAAKNRKTAGKMYDSDFEEFKKIVAPYTLEEAHRISGVPKDQLETLAKMYADPQQNLVSFWTMGFNQHTRGVWVNHMVYNVHLLTGKISKPGCGPFSLTGQPSACGTAREVGTFVHRLPADMVVTNPKHVEIAENIWKLPKGTISNKPGFPAVQQSRALKDGKLNFLWQLCTNNMQGGPNINEEIFPGWRNPDNLIVVSDPYPSASAVAADLILPTCMWVEKEGAYGNAERRTQFWRQQVKGPGQSRSDLWQIVEFSKYFKTEEVWSEELLAQMPEYRGKTLYEVLYLNGEVNKFQTPTNVPGYINDEAEDFGFYLQKGLFEEYASFGRGHGHDLADFDTYHQVRGLRWPVVDGKETLWRYREGYDPYVKAGEEVSFYGYPDKKAIILGVPYEAPAESPDEEYDLWLCTGRVLEHWHTGTMTRRVPELHKAFPNNLCWMHPTDAKKRGLRHGDKVKLITRRGEMISHLDTRGRNKCPEGLIYTTFFDAGQLANKLTLDATDPISGETDYKKCAVKVVKA

SEQ ID NO: 5327 - protein, 430 aa, Carboxydothermus hydrogenoformans
MFCYQCEQTAQGKGCVGPVGVCGKNEDLAALQDLLIFGLKGIAAYAYHARELGAHDPEVDAFMHEALFTTLTNVDFDLDHHLQMVLKAGEMNLKIMELLDKAHTEKFGNPVPTKVYTGIKKGPAILVTGHDLLDLYELLKQTEGTGINVYTHGEMLPAHAYPELKKFPHLVGNYGTAWQNQKKEFEEFPGVILATTNCVLIPKDSYKDRMFTCGVAHLPGVKHIANRDFSEVIKKALELPPAEEKEGGYITTGFHHTAVLSLADTIIEGVKSGKIKHFFLIGGCDGAKTTRNYYNEIADKVPKDSIILTLACGKYRFIHKDFGEIEGTGIPRLLDIGQCNNSYSAVKIALALAEAFKVGVNDLPLSLILSWFEQKAVAILLSLLYLGVKNIRIGPTAPAFLTPNLLAILNEKFGLKLITTPDEDLKAILG

SEQ ID NO: 5328 - protein, 84 aa, Oryza sativa
  misc_feature (34)..(34): Xaa can be any naturally occurring amino acid
  misc_feature (40)..(40): Xaa can be any naturally occurring amino acid
MQTAASRVVGLSAVLPAAVNGRSLQIQAPQRVAXRVRAAXAADVAVEAEDVDYSSNIMVFPMEAIDLISRKACNVQMYPQAKLS

SEQ ID NO: 5329 - protein, 276 aa, Unknown
  Mesorhizobium sp. ICMP 12635
WGFDGSSTMQAEGHSSDCILKPVAVYPDPTRTNGVLVMCEVMMPDGVTPHASNKRATILDDEGAWFGFEQEYFFYKDGRPLGFPETGYPAPQGPYYTGVGYKNVGDVARQIVEEHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFIKNDYKGYLEDRRP

SEQ ID NO: 5330 - protein, 405 aa, Burkholderia xenovorans
MSTDRHVIVGAGHAARRAAETLRERDPGARIVMIGAEPHAPYDRPVLSKDALLAEGGEQKAFIRGLEWYAAHGIELRLGTTVESIDRTRNQVRLHDGSSIGYDRLLLATGSRVREFAGPMDERVRLYYVRTLADSLALRAALAPGRKVAILGGGFIGLEVAAAVTQVGCEATVIEPAATLLQRSLPPAASRFVASLHARRGVTLRLGETPLRIGYENRRALIETDRGTLAADLVVVGIGVLPNVELAREAGLQVDNGIVVDAQCRTSDPRIFAAGEVTMHFNPLLGRQARIESWQVAENQPVIAAANMLGDTQEYAEWPWLWSDQFDCNIQSLGMIDASHTLIERGDAHNGPFCVLALDAGRRLRAVVAINAGREMGACKRLVASGKVLDPALLADTAVALRSLL

SEQ ID NO: 5331 - protein, 276 aa, Unknown
  Mesorhizobium sp. ICMP 14319
WGFDGSSTMQAEGHSSDCVLKPVAVYPDPTRTNGVLVMCEVMMPDGVTPHASNKRATILDDEGAWFGFEQEYFFYKDGRPLGFPESGYPAPQGPYYTGVGYKNVGDVARQIVEDHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFIKNDYKGYLEDRRP

SEQ ID NO: 5332 - protein, 727 aa, Unknown
  Rhodococcus sp. RHA1
MTSPELALTVRLNTSAADTRRGVVRLHPEALAALGLREWDAIALVGARRTAAVAGRAPAGTPTGTALLDDVTLSNAGLTENSTVVVTPVTVYGGKTVTVSGSNLAVNSVSDVTLRHALLGKVLTVGDTVSLLPRDLGPGTSTAPATQALSRTFGVAWTSELLTVTGVDPAGGPVSVQPNTAVGWGEGVRATVSAAPTRLPAPPVRPAEEVPPVPVEDLVGAHTQAAKLTEWLGLALDEPELLRKLGASPHLGVLVTGPAGVGKATLARAVLASRRLVELDGPSAGALEADSRLQRVTAAVDAIRSGGVLLITDIDALLPATPEPVSALIVEQLRRAVDTVGVAFVATSAHPESVDARLRGQDLCDRELTLTLPDGSTRRALLELLLRKVPTDGIALEAIAARTPGFVVADLAALCREAALRAASRAARKPVDPALTQDDLLGALDVIRPLSRSGSEELAIGTLTLDDVGDMVETKQALTEAVLWPLQHPDSFARLGVDPPRGVLLYGPPGCGKTYLVRALASSGHLSVHAVKGAELMDKWVGASEKAVRELFQRARDSAPSLIFLDEVDALAPRRGQSSDSGVSDRVVAALLTELDGVEPLRDVVVVGATNRPDLIDPALLRPGRLERLVFVPPPDGEARRAILRTSGKSVPLADDVDLDALADDLDGYSAADCSALLREAALAAMRRNIDAADVTAADVAEAREKVRPSLDPEQVAHLESYALSRP

SEQ ID NO: 5333 - protein, 212 aa, Medicago truncatula
MLHPFSFRCSNHASTTPFPSLLLLNTTSFHLAGKSPTFPFLRRPFNPPALRSVHHVRAVSSLPLFDFSGGKGMSGFCDVELKVRDYELDQFGVVNNSVYAGYCQHGRHEFLESIGINCDAVARCGDALALSELSFKFLAPLRSGDRFVVKVRVSGSSAARIYFDHFIYKLPNQEPILEAKATAVWLDKNYRPIRIPADIKSKFVKFIRNEDS

SEQ ID NO: 5334 - protein, 384 aa, Oceanicola granulosus
MSKRDYYEVLGVSKGASADEIKKAFRRKAKELHPDSNADNPNAEAQFKEANEAYDCLKDPEKKAAYDRFGHAAFEGMGAGGGGRRPGGAGQQDFASAFSDVFDDLFGDFMGGRPGAGGGRQRATRGSDLRYNLRVTLEEAYNGLQKTITVPTAVQCGTCHGTGAEGGVEPQTCPTCSGMGKVRAQQGFFTVERTCPTCNGAGQTVKNPCHTCHGAGRVEKERSLSVNIPAGVETGTRIRLAGEGEAGLRGGPAGDLYIFIEVREHELFQRDGSHLFCRVPVSLAKAALGGDIEVPSIDGGRSRVKIPEGSQTGRQMRLRGKGMPALRGGGHGDMFIELAVETPVNLTGRQKELLREFERLSEENNPQSSSFFSAVKSFWDGMKG

SEQ ID NO: 5335 - protein, 925 aa, Silicibacter pomeroyi
MADGAHVEMVSFTLNGEEVTVPEGLTIWEAAHGRGLVIPHLCHKPDPGYRPDGNCRACMVEVAGERTLVASCIRPVAEGMVVTTDSARAEGARKMVVELLLADQPEVAHDASSHFHAMAGLNGVSESRFPAKTPDSVPLLDASHVAMRVNLDACINCNLCVRACREVQVNDVIGMAGRGAGAQVVFDQNDPMGASTCVACGECVQACPTGALMPATVLDAEQAGDSKDYDREVTSVCPFCGVGCQLSFKVKDNKIKYVTGVDGPANESRLCVKGRFGFDYIDHPHRLTKPLIRRADAPKGLNVDPGNPLSHFREASWEEALDFAARGLADLRAQKGSYVAGFGSAKCSNEEAYLFQKLIRQGFGHNNVDHCTRLCHASSVSALLENVGSGAVTATFNEIENADVAIVIGCNPIENHPVAATYFKQFTKRGGKLIVCDPRGVGMGRFATHRLQFKPGADVSMLNAMMHVIVEEGLYDQAYIDQFTENWEEMKAHLADYSPEKMEPICGIAAGELRDAARTFAAGKAGMIFWGMGVSQHIHGTDNSRCLISLALMTGNVGKPGAGLHPLRGQNNVQGASDAGLIPMFLPDYQSVTDDGVRSAFTSVWNSGDFSNQKGLTVVEIMHAIHDGDIRGMYILGENPAMSDPDVDHARAALAMLEHLVVQDIFLTETANYADVILPASAWAEKTGTVTNTNRQVQMGRPAVAPPGQAKEDWWIEVELARRLGLDWNYSHPSEVFAEMKRNMKSLDNITWARLEGEAVTYPSLSPEDPGQAIVFGDGFPRANKRARFTPAKIVEPDERPDADYPFVLITGRQLEHWHTGSMTRRASVLDAVEPEANCSMHPATLRAMGIEPGDMIRLTTRRGSVQVMVRADRAIAQDNVFLPFAYVEAAANILTNAALDPYGKIPEFKYAAVKVEKAEALAAE

SEQ ID NO: 5336 - protein, 331 aa, Bacillus cereus
MNLAKFPRKKYTESYTPIEKLNNFSEALGGPTIYFKRDDLLGLTAGGNKTRKLEFLVADAQENGADTLITAGGIQSNHCRLTLAAAVKEKMKCILVLEEGLETEEKRDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYTGKAVAGLIDLIRKGNFNKEDNILFVHSGGSPALYANTSLFV

SEQ ID NO: 5337 - protein, 57 aa, Glycine max
  misc_feature (49)..(49): Xaa can be any naturally occurring amino acid
MFLQLIAVILGHLWCSEHPQMRGRIELLLKQNKLSKKHIKDILQEYHDXIGDLDGPE

SEQ ID NO: 5338 - protein, 382 aa, Saccharophagus degradans
MAQQETAGGVLLIAASILALIFANSYLSGFYNGVLNLPLVVAIGAFEISKPLLLWVNDGLMALFFLMVGLEVKREVLEGHLSQPSQVVLPGLAALAGVAFPAIIYASFNWQDPTALRGWAIPSATDIAFALGVFSLFGRHLPVSLKLFLLSVAIFDDIAAIVIIALFYSHELSTLSLLVAGIGIVMLFVLNRLKIRHVSPFMFVGLVVWAAVLKSGVHATLAGFVIAWFIPLKHKNIHDEPMLLSLEHALQPWVAYFILPFFAFVNAGVHLGGIGLDTLTAPVTLGIIVGLFVGKQLGIFSVCWLSIKLRIAKLPEGATWRELYGVCLLAGIGFTMSLFIGSLAFEGANSEMVASVKLGVLFGSLLSAICGALILTNSRKIK

SEQ ID NO: 5339 - protein, 124 aa, Schizosaccharomyces pombe
MTSIHTGSNNNIVELDMSELIRPIPPVLDMNKVNSMMETMTGKTPPASCGLTSEDLEAGELPPVDVLTFKKSGKPYYFAFGGCHRLRAHDEAGRKKVRCKLVNCSPNTLRLYLGASANKFLDSD

SEQ ID NO: 5340 - protein, 609 aa, Phaseolus vulgaris
MESSVNGVDSLSEVQNSVSGVHHHDPLPSGTPQPSRPPLRASRNYDGGHQTKAIHHHNSHVINQKHSHQEGKTLKQEGLPTKLSSKQPPLDDSKGCEPNGVLESEKKRVVDNHGKNYSQPDATFCASPQNSFYSATVYSEAKESFTNTEVSECASVDKSCESEVANSSDFNESRKTSICRASTGSDASDESSTSSLSSVLYKPHKANDIRWEAIQAVRTRDGMLEMRHFRLLKKLGCGDIGSVYLAELSGTRTSFAMKVMNKTELANRKKLLRAQTEREILQSLDHPFLPTLYTHFETEIFSCLVMEFCPGGDLHALRQRQPGKYFSEHAVRFYVAEVLLSLEYLHMLGIIYRDLKPENVLVREDGHIMLSDFDLSLRCSVSPTLVKSSNNLQTKSSGYCVQPSCIEPTCVMQPDCIKPSCFTPRFLSGKSKKDKKSKPKNDMHNQVTPLPELIAEPTNARSMSFVGTHEYLAPEIIKGEGHGSAVDWWTFGIFLYELLFGRTPFKGSANRATLFNVIGQPLRFPESPTVSFAARDLIRGLLVKEPQHRLAYRRGATEIKQHPFFQNVNWALIRCATPPEVPRQVINLPQTEKDLGVKPSGNYLDIDFF

SEQ ID NO: 5341 - protein, 213 aa, Oryza sativa
MVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 5342 - protein, 370 aa, Bacillus halodurans
MSKRDYYEVLGVDRNASADEVKKAYRKLARKYHPDVNKAPDAEDKFKEVKEAFDTLSDPQKKAHYDQFGHTDPNQGFGGGGAGDFGGFSDIFDMFFGGGGGRRNPNAPRQGADLQYTMTLEFKEAVFGKETTIEIPREETCHTCSGSGAKPGTKPESCPHCGGSGQLNIEQNTPFGRVVNRRVCHHCEGTGKYIKHKCATCGGKGKVRKRKKINVKVPAGIDHGQQIRLSGQGEAGVNGGPAGDLYIVFNVKPHEFFERDGDDIYCEMPLTFVQVALGDEIEVPTLNGKVKLKIPAGTQTGTSFRLRGKGVPNVHGRGQGDQHVQVRVITPKQLSEKEKELLREFAQMSGGRPDEQDDSFFAKVKRAFKG

SEQ ID NO: 5343 - protein, 100 aa, Arabidopsis thaliana
  misc_feature (62)..(62): Xaa can be any naturally occurring amino acid
EKQHEEGKDQSMFSTTDVVTYPAQATMVTPFTGSKRYGYLPVTRKVNNHITCITSNIGRVKXIESWTPIKKNKVETLYNLPDLNDGELAKEECFVTGNKW

SEQ ID NO: 5344 - protein, 399 aa, Candida albicans
MATSNNSAVAGSQTTPKYNINSEENQLMIKNLNLIAARDSSLNALMRTVALGQASMQQIDVFKEYIKRAKAMGPPPHDDSVWEEVFRTPVWGSAINNESQSSQESKPSSSENKKDKDSVESKVKEEAGKTTQSNDKEKLPKETSSKNEEKAEEAEGQSKDLESTEKKELNPKDNVNVNKNENEKPGLKDKVETNEKESKPKEKEEIKDKEEQTKKNSQELKKDKVEIDGKEEKETDKSKIEKNEESEKNKAEEPKKDKSEESTKSNEESKKDEESKKDEESKKDEESKKDEESKKDEETSKKKDEDKTQANEDSTKGKKVEIDVKKEDTNEKEIPPETKSDKDLKDLPSKEKKKSFEKPPKVKKEKPPKQSKHSKAEIPDDQKLTAFQERYLEDAIIFV

SEQ ID NO: 5345 - protein, 437 aa, Mycobacterium tuberculosis
MSIKAYAKTQGIAVTSVNGLVAGHGSVQETWLAMQSAAALSGTPRLVGFSCIDTFPEVLWLAQRARQAWDGVRIVIGNAMATLNYERILRQHDCFDYVVVGDGEVAFTKLALALANDAAVDDVPGLARRSEQGQILRTPSSLVDLDELPRPARDELPTVLADGFAASVFSTRGCPYRCTFCGTGAMSAMLGKDSYRAKSVDAVVDEIDYLVSDYDVNFLSITDDLFISKHPGSQQRAADFANAVLRRGISVNFMVDIRLDSVVDLDLFKHLHRAGLRRVFIGVETGSYEQLRAYRKQILTRGQDAADTINALQQLGIDVIPGTIMFHPTVQPDELRETVRLLRATKYTVGFKFMSRIVPYPGTPLYQAYSDAGYLTAKWPLGQWEFVDPEASRVYADVVAKVAPDVGISFDEAEAYFLSRLDEWENVIAGRIAEATS

SEQ ID NO: 5346 - protein, 186 aa, Triticum aestivum
TFFCPGLLTSANTTKIYKWPTSAGYNGAMHLVTVETVFPSPLVPSRKCTFVRCCRDMQNGTVIIVDVSLDNGDGTVKCHKMPSGVLVRSLNSDASQVTVIEHVQVNDTGLHELYRPSLSGLMFGARRWVSSIVRQSARMRDLFVVSKSASNGNTNGRKTLMKIADGLLAGYASGIAAVPGGGWTIL

SEQ ID NO: 5347 - protein, 148 aa, Leptospira interrogans
MKEVSVPAIKRIVLIAHDNRKEDLVNWVKTHREILSKHQLYGTGTTGKLISEETELPVYRFLSGPLGGDQQIGAKIAEGDLDIVIFFWDPLTAQPHDPDVKALLRIAVLYNVPMACNRSTADYMISSPQFTKTYKKILLSYNTKVKKD

SEQ ID NO: 5348 - protein, 92 aa, Triticum aestivum
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 5349 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 5350 - protein, 431 aa, Thellungiella halophila
MKLLGLIIFLAIVIQQSYWELGADAFSSDGFVRTKGVQFSLNGYPYYANGFNAYWLMYVASDPSQRSKISAAFQEASRHGLTVARTWAFSDGGYRPLQYTPGSYNEDMFQGLDFAIAEARRHGIKVILSFANNYVSFGGKKQYVDWARSRGRPVSSEDDFFTDSLVKDFYKNHIKAVLNRFNTFTKVHYKDDTTIMAWELMNEPRCPSDPTGRTIQAWVTEMAAHVKSLDRNHLLEAGLEGFYGQSSPQSKTLNPPGQFGTDFIANNRVPGIDFVTVHSYPDEWFVDSSEQAQMEFLNKWIDAHIQDAQNVLQKPIIIAEFGKSEKKAGYSPAQRDIVYNTVYSKIYGSAKRGGAAAGGLFWQLLGNGMDNFQDGYGIILSQRSSSTVNVIAQQSRKLTLLRKIFARMINVEKWKRAHQRRVRKGAHKIQN

SEQ ID NO: 5351 - protein, 334 aa, Avena sativa
MASQGVASMFALALLLGAFASIPQSVESIGVCYGMSANNLPAASTVVGMFKSNGINSMRLYAPDQAALQAVGGTGVNVVVGAPNDVLSALAASPAAAASWVRSNIQAYPKVSFRYVCVGNEVAGGATQNLLPAMQNVQGALASAGLGHIKVTTSVSQAILGVYSPPSAGSFTGEADAFMGPVVQFLARTGSPLMANIYPYLAWAYNPSAMDMSYALFTASGTVVQDGAYGYQNLFDTTVDAFYTAMGKHGGAGVKLVVSESGWPSAGGEAATPANARIYNQYLINHVGRGTPRHPGGIETYVFAMFNENQKDNGVEQNWGLFYPNMQHVYPISF

SEQ ID NO: 5352 - protein, 317 aa, Rickettsia akari
MNKFKNIAVYGGGSFGTSLAALAAQNCSNVTLFLRDEEIAKEILHKKTNIKYLGGIKLPAHLHATTNLSVIKDFELIIIAVPSYAFDDSIKLLKTHGISEDNTLLIATKGFARNPTELFSDRLKTLLPHSSTAFFAGPNLAKELAKNLPASASIASLDIDIANKIANNISSKIFTTNMTSDIVTLQVAGALKNIFAIKSGIDLASEQGENARATLIVDALKEIITLSKVFGGLQKNSDILLEAGVVGDLVLTCYALGSRNTNFGYELGISSDKKKFLQEYKQLVEGREALKLVLDLIKQYDLHMPIISEVASYVMPA

SEQ ID NO: 5353 - protein, 1029 aa, Triticum aestivum
  misc_feature (629)..(629): Xaa can be any naturally occurring amino acid
SLSGHWKFRLAQSPETVPDKFYDAQFNDSDWEALPVPSNWQMHGFDRPIYTNVTYPFPMNPPFVPSENPTGCYRKVFHIPKEWKGRRILLHFEAVDSAFLAWVNGVPIGYSQDSRLPAEFEITDCCHHCDSDKENVLAVQVMRWSDGSYLEDQDHWWLSGIHRDVFPAPAPQIFITDYFFKATLDENFRVADIEVEVEIDSHKQDREHIPTLSIEATLFDNSESSDDLNSDMSAANIVNLKTKPEPKGGPCHGFHGYVLGGKVENPKLWSSEKPNLYTLVVLLKDANGKLIDCESCQVGIRNVVLAHKQMLVNGSPVVIRGVNRHEHHPRVGKTNLEACMIKDLVLMRQNNINAVRNSHYPQHPRWYELCDIFGLYVIDEANIETHGFDENSHFKHPTLEPIWANSMLDRVVGMVERDKNHACIIIWSLGNEASYGPNHSAMSGWVRGRDPTRLIHYEGGGSRTSSTDIVCPMYMRVWDILKIANDPSENRPLILCEYSHAMGNSNGNIDAYWKAIDNTMGLQGGFIWDWVDQGLLKEDADGSKSWAYGGDFGDIPNDLNFCINGIVWPDRTLHPAVNEVKYLYQPIKISLVDNILKIENGKFSETTEALDFSWILHGDGSVLGSGSLXLPNLAPQSSHLINMDSSPWFTLWSTCAAKETFLSVHVTLRGQTRWAKAGHVLASAQLCLPQTKGFAPRVIALSKSPLTSEQVGDGVIISKNHEWQIKINSQLGTIDSWKINNVELMSKGIFPCFWRAPTDNDNGGFYTKSYATTWREAFLDNVSFYSSQFSVKELPDHTVEVSTTYYGLPGHLPKPDDAALSEASESVLFRVHMRCRIYESGDVILDYEVNPKSDLPPLPRVGIVFNAEKSLNHVTWYGRGPFECYPDRKAAAHVGVYESSVEDLHVPYIVPGECGGRADVWWVALKNADGFGLFASTHGESPPMQVSASYYGAAELDRATHQHKLVKGDHIEVHLDHMHMGVGGDDSWTPCVHEEYLLSPAASYRFSLRLRPLPPSSSSHDIYSSRLPN

SEQ ID NO: 5354 - protein, 240 aa, Oryza sativa
MAGAGRDELKLLGMWASPYVSRAKLALQLKGVSYEYIEEDLGNKSDLFLRSNPVHKTVPVLIHNGNPICESSIIVQYIDESFPSSAASLLPADPYDRAVARFWAAYIDDKLAAPWRMVYRVKTEEERDELMKQTLAAVDVLEGGLKECSKGKGCFFGGDSVGYVDVVLGGLVSWVHASDKLSGAKLFDAAKAPLLAAWLGRFGELDAAKAVLQDVDKVVEYAKKFQPRDSGTAADRQAVN

SEQ ID NO: 5355 - protein, 448 aa, Oryza sativa
MALKLLWLHADGHCQCHLSLLLRLVACLALVLLLPPPPPAQAATVVTHLPGFDGPLPFYLETGYVGVEEETGTELFYYFVESERSPRSDVVLLWLSGGPRCSVFSGFVYEIGPVMFVAERYSGGTVPRLEYNPYSWTKLASILFVDSPVGSGFSYAHDPKGYDVGDISSSMQIVKFLRKWLDDHPKYLSNPFYIGGDSYAGKVVPLITQYLSEGIEEMRHPIINLKGYLVGNPSAGDKIDVNSRVPYSHSFGVISDQLYEAALANCKGDYENPTNKPCTDVMQTINNLMSEVLEPACPFDWPWPMPGRDASNRKSLTEEHYWLGDPPVEPPFSCFAAYRYYLSYFWANDNATRAALGIKEGTVTEWIRCPTGLPYTRDLPSSIECHFNVTTRGYRALVYSGDHDPIVPFSGTQAWIRSLNFSIVDDWRAWHLDGQAAGLNSQSSMLTT

SEQ ID NO: 5356 - protein, 513 aa, Rubrobacter xylanophilus
MELQVRFPLGASGPLGCASEIAARHPSYRVEGGGDGARVSVRLELPGDWRLLDDFSTLLRGEEVSYAADGTPVPGEELLRGLRCFLRKQRSGKTAREWCTPASLGDRQLFPCRQIRVYDNDHLTPNSWYAFGSVGGDGAFRVDKEALTERVLEDLGPCVRCPLLDLEAVAETVAALPDRIDPAREAGWRYREGGGGWKVTKAGAAGPSPEEAAAEESRREGLLERLARSVRGGGVPVVGGPVGSRNVPDTGYGDVGGMDETIALVREAVELPITHPEIFQRLGIRPHKGILFHGPPGTGKTLLARAVARESGAHFIAVSGPEILNKYWGQSEARLRGIFAEARAKAPSIILFDEIDSFASARDAMSESFEATLVSQLLSLMDGLNSLGRVCVIATTNRPEALDPALRRPGRFDHEIEIGLPDAGARLHILQIHTRRMPTDPDLDLEQIARLTGGYSGADLEALCREAALACMRRTLNLRDFERRITPRQLAALSVTTYDFRTAMKRVGASIRR

SEQ ID NO: 5357 - protein, 195 aa, Unknown
  Azoarcus sp. EbN1
MRQAEVTRDTLETRITARVDLDGSGKAAFATGVPFLDHMLDQIARHGAFDLDIRAEGDTHIDDHHTVEDVGITLGQAFARALGDKRGIRRYGHAYVPLDEALSRVVVDFSGRPGLHYFVSYTRARIGSFDVDLAREFFQGFVNHAGVTLHIDSLRGDNAHHQCETIFKAFGRALRMAAERDERAAGAIPSTKGAL

SEQ ID NO: 5358 - protein, 76 aa, Medicago truncatula
MKGAPVDYELDQYGVVHNSYACYCQQGRHEFLKSIGINCDDILAASGDAFAISELSLKFIGPLRVSHAKFVGNFYL

SEQ ID NO: 5359 - protein, 551 aa, Myxococcus xanthus
MDLDPLWYKKALIYELHLRAFHDSNGDGHGDIPGLIEKLPYLQDLGINCLWLLPHYPSPLRDDGYDIADFYGVHPDYGTLADFQRLVDEAHKRDIRVITELVVNHTSDQHPWFQEARSDPNSPKRNWYVWSDTDEQYKGARIIFLDTERSNWTWDPVAKQYFWHRFFSHQPDLNYDNPEVQEAMLDVMRFWLNMGVDGFRCDAVPYLFEREGTNCENLPETHAFLKRLRKTIDSEYKGKMLLAEANQWPADVRVYFGDGDEFHMGFHFPVMPRLYMAVRREDRTPIVEIMQQTPDIPDNCQWAIFLRNHDELTLEMVTDEDRDYMYREYATDPRMRINLGIRRRLAPLMDNGRRRIELMHSLLFTLPGTPVLYYGDEIGMGDNIYLGDRNGVRTPMQWTGDRNAGFSRADYARLYAPVIADPVYGYQSINVEAQERVKSSLLHWVKRMIRIRQRYPVFSLGNLRFLQTDNRKVLAFIREWEGQTVLVVCNLSRFAQPAVLDMREWEGAVPVELIGETPFPRVSELPYQLSMGPFMFLWFRLDRPQQVRSLE

SEQ ID NO: 5360 - protein, 1692 aa, Ostreococcus tauri
MLYECNWEALVHWVLRCTGLRAVLKLYDCWVFRTSRILGLLLRLGEAGYAMFFDVYVREALHGVRIHLHATFKDSRSTFEKEQGTVGQIPDWENPTIVGRNRRYGVATLESKGTTYAFTDEAEFVSFWRSGGCWERRLTLSNVRSLNGVWQFKLLSYPISLTGEYVAMDFSTNEWDSINVPSNWQCEGWDRPIYTNFQYPFPLHPPVARTQSDYSSDNSRGHTKISAVNPTGVYRHSFNLEDDWNAKHDKTYIVFEGVDAAFHVWVNEQSVGYSQDSKLAAEFDISRYIHSGVNQLVVHVYRWCDGSYLEDQDQWWLSGIFRDVYLYRKCLSQISDYSFRTQCPDHQTGKWDVTVQAEICETTEAYFKKVNKVLVLRLLYNNFVEIHQACLHDFRIHQKMPYLGTMHDACTEEVYLQTKVHFSLEHIMEWSSESPTLYMLVISLETESGEVLDCEGCRVGFRTVRVENKQILINNRPVLIQGVNRHEHCPVRGKAVSEKLMLDDILLMKHTNFNAVRTSHYPNHPRFYELCDEYGLYVVDEANIETHGFEFGLHSTPYLANRPTWKNAYMARVTRMFARDKNHCSVIIWSLGNESGCGGAHFAMYSWIKHNDQSRLVQYEGGGYKTPCTDIICPMYAPPLLCAQLASQPDWRPVILCEYSHAMGNSNGGLHKYFDVFRNQTGVQGGFIWDLIDQGLQCSKDGVQYWGYGGDFGDEPNDKQFCINGLFFPDRTPHPASFEAKYLQQPLMITLQADQVQVHNRYAFTDLDQLKFHWCVVLDNGYTLAAGNIHCIKVGPGMVANYDWVDLFPSVASLSQTATERRLTFDEWWVDITASFVEDQLWADSQMIIAKCQLMLPKRVTSVSKEPRLESRVRVERGCNRLTVDCRDSSYIFDTASGSLVEFQFRGETLIDSGLAPCLWRAPTDNDNGGSIFSFAARWAHAGLNKLDEYKTSTSSRINEHGCFQLLVQKSLGPTKRKLVCTLCTRYTVTRCGHLEVKCTFNFARNLPPLPRIGVSVTCPKQLHQVEWLGLGPHENYLDRKTSAFLGRYGATVEELHVPYIVPCENGARQGTRWLSLGSSESTNKCLFTSKENFSFSASNFTDEELARRVHQHELQRAQSINIHLDAFHMGLGGDNSWFPSVHPEFTSSITTKNYDFALKPNDNYCDFEDWIMPILDEMLREQNEEGVKWTCSKVIKRLGLEINHEDSIFYWAAKNDIPCYCPALTDGSIGDMLYFHSYKNPGLVIDVVADVRAMNDESIKVKRPRKTGIILLGGGVAKHHICNSNLMRNGADYAVFINTAQEFDGSDSGARPDEAVSWGKITMDAKPVKLYVDATIAFPLLVAQTFKKNFQPRGPPARAPLLERCTHVDHTSLLIRTGSKRKVQQTTQSATDLAAQTPTRADLEGWSAASTSGALSQSDVREFQRLGFLALTGWCTDDECAAMRNRASAIVRDFDPASHASVFSTTDQTRTTDEYFLASGNGVSCFFEEKALRADGTLTVEKEVAINKIGHAMHDLDDVFRAFSRSDKVKRLMESLSMSKPTPVQSMYIFKQPSIGGEVVPHQDSTFLNTSPATCIGIWLALEDCTVENGCLFALPGTPPVARVMTVDYPGGSRKIEFIGANPTHDLDAAHALEVPAGTLVLLHGANVHFSRANTSAKSRHAYSVHFVSGDAAWKPTNWLQRSNDFPFTPL

SEQ ID NO: 5361 - protein, 485 aa, Clostridium tetani
MGKVYLIGAGPGDEELITLKATRMLQKCTAVMYDRLAGPGFLKYLNEDCEIYYCGKEPGCHYKTQDEINEMLAKLAKKGHVVGRVKGGDPFIFGRGGEEILRLLEDNIEFEVIPGITSAISVPSYAGIPVTHRAIAQGFHVFTGMTAEKLDIDWKAVANVGGTLIFLMGYRNLDIIRNRLMENGMNENTPCAIIMRGTTSNQKKVVGTLKDISEKAEKQGVTSPCIILIGDVVQFNDKFNWYEKKRLFGKNICVTRSRVQAKELREKLSDLGAQVTEINAIKIKSRDDELEKYVERLKDYKFIVLTSVNAVNILFDYLVKKEYDIRNIKGRFAVIGPATEKALLKRGIKADIIAKEFVAEDLFNELKPYLNKDDKIFVPHSKQARQYLVEALKDKGCHVEEVYSYEVVKGEVPNLEIFDDVDIVLYTSPSIVRNMIDMIGLEKLKKKTSISIGPITAKELDKNGIDYIICDEYTTDGMIEKLLTL

SEQ ID NO: 5362 - protein, 315 aa, Zea mays
YCRTLLKQYGKVLGLDPKRIPQNWAATQFAEALGRAWAEYNNDSAVVLMVVQPEERNMYDQYCLVNHLKESYGVATIRKTLAQVEAQGQVLTDGTLVVDGRTVAVVYFRAGYAPTDYPSEAEWRARLLMEQSSAVKCPSIAYHLVGTKKIQQELAKPNVLERFLDNKDDIAKLRKSFAGLWSLDNEEIVRSAIQKPNLFVLKPQREGGGNNIYGQDLQDTLIKLQKEQGEALAAYILMQRIFPKASLTPLVRGGDCFEDLTISELGIYGAYLRNRDKVILNNQSGYLMRTKVSSSNEGGVAAGFAVLDSVLLTDE

SEQ ID NO: 5363 - protein, 219 aa, Hordeum vulgare
MGATEDSSSGSETTTSSSVEALASPPSPTATTASSKKKRARNDGRHPTYRGVRMRSWGKWVSEIREPRKKSRIWLGTFATAEMAARAHDVAALAIKGRAAHLNFPDLAHELPRPATAAPKDVQAAAALAASADFPASATATANAGAKNPDGPEPNAASASTPPDTAEDALFDLPDLLFDLRHGPPSCQVSCASTWDDDVAFAGPGAGVFRLEEPLQWEY

SEQ ID NO: 5364 - protein, 236 aa, Oryza sativa
MALASTSATASAAVLKTPFLGAKRALANAVAVAGAKPGPSRALVVSAKKSWIPAFKSDAEFINPPWLDGSRSSSGTGRRSLIHGRWAMAAVLGIFVGQAWSGVPWFEAGAQPEAIAPFSFGSLLGTQLLLMGWVESKRWVDFFNPDSQAVEWATPWSRTAENFSNATGEQGYPGGKFFDPLGLGGETRDGVYIPDTDKLDRLKLAEIKHARLAMLAMLIFYFEAGQGKTPLGALGL

SEQ ID NO: 5365 - protein, 466 aa, Unknown
  Photobacterium sp. SKA34
MTYAPVTDVLSGKLAVDSEVTVRGWIRSRRDSKAGISFLAIYDGSCFDPIQAVVPNELNNYQEEVLKLTTGCSVEVTGTIVASPAKGQDFELAATNVKVVGWVEDADSYPMAKTRHSIEYLREVAHLRPRTNVIGAVARVRNSLSQAIHRFYHEQGFIWMSAPLITASDCEGAGEMFRVSTLDMANLPMTDKGEVDFDKDFFGKETFLTVSGQLNAEAYACALSKVYTFGPTFRAENSNTSRHLAEFWMVEPEVAFADLDDAAKLAEDMLKYVFKAVLEERRDDLEFFASRIDKEAITRLEQFVTSDFAQVDYTDAIQILQDSGRKFEFDVEWGIDMSSEHERFLAEEHFKAPVIVKNYPKDIKSFYMRLNDDGKTVAAMDVLAPGIGEIIGGSQREERLDILDARMIEMGIDPEHMSWYRDLRRYGSVPHAGFGLGFERLVSYVTGMGNVRDVIPFPRTPRSANF

SEQ ID NO: 5366 - protein, 203 aa, Brassica napus
MGTEEESVSVELPAPSSWKKLFFPNKVGSVKKTEIVFVAPTGEEISNRKQLDQYLKSHPGNPSITEFDWTTSGTPRRSARISDKKTKSTPSPDKEPPKKRGRTKSSGSKKDAEEEGEKPEDTEMSPLKGTEESVTVKDGSGETKDDMVAEKTPVQEAVGESMKEQTPDLVGESSKERVESQTDKEEETGSVVKTSVEAEIKTA

SEQ ID NO: 5367 - protein, 583 aa, Arabidopsis thaliana
MASQLDLIGGDYIAGISINPPTNSRVTSVYSEVQASRIDHTLPLPSVFKTPFKIIDGPPSSSAGHPEEIEKLFPNLFGQPSALLVPNQSNEVSSDQKLKIGVVLSGGQAPGGHNVICGIFGFKNLICDCIFVVGLIDYLQEYARGSSLFGFRGGPAGIMKGKYIELTSEFVYPYRNQGGFDMICSGRDKIETPEQFKQAEETVTKMDLDGLVVIGGDDSNTNACLLAEHFRAKNMKTLVIGCPKTIDGDLKSKEVPTSFGFDTACKVKMIGNVMIDARSTGKYYHFVRLMGRAASHITLECALQTHPNITIIGEEVFEKKLTLKNVTDNIVDVIYKRAENGYNYGVILVPEGLIDFIPEVQQLISELNEVLAEGNVDEEGQWKKNLKKETLEIFEFLPQTIQEQLMLERDPHGNVQVAKIETEKMLIQMVETELEKKKTEGTYEREFMGKSHFFGYEGRCGLPTNFDATYCYALGYGAGSLLQSGKTGLISSVGNLAAPVEEWTVGGTALTSLMDVERRHGKFKPVIKKAMVELEGAPFKKFASQREEWALKNRYISPGPIQFKGPGSDARNHTLMLELGAQA

SEQ ID NO: 5368 - protein, 516 aa, Zea mays
  misc_feature (199)..(199): Xaa can be any naturally occurring amino acid
MANPLAGLQDHLKLARDYALEGLYDTSIIFFDGAIAQINKHLTTLDDALIRTKWMNCKKAISEEVEIVKQLDAQLKSLKEAPGTRRSSSPPIRSNKSFVFQPLDEYPTSSPAPFDDPDVWAPPRDTPTRRPTRGQSSARKSSQDGAWARGSSRTGTPSRSAKPNGIKGGAVKSTASNSSVRKGKQSSSKADSTSSDAEXGKSKKGQYEGPDMDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCTSRGASGEHESSRRVKSELLVQIDGVNNSSTTDDGQPKIVMVLAATNFPWDIDEALRRRLEKRIYIPLPDFESRKALININLRTVQIAADVNIDEVARRTEGYSGDDLTNVCRDASMNGMRRKIAGKTRDEIKNMSKDEIAKDPVAMCDFVEALVKVQKSVSPSDIEKHEKWMAEFGSA

SEQ ID NO: 5369 - protein, 846 aa, Bifidobacterium longum
MKNPPLHRYATRPGLYFTDDGGADVVVRSETADQVWLCVLEPIDEPSAFFQDAIRLFEDPNISFIQQIHEFPVCTRIIEHLYLRETLFRMTGPNYGLWYVHLPKAWDGMRYGYRVDGAWDPKHGVRFNPYKFLLDPYGKGIDGSMELTPAAFSYECDVVDHKVTGSAYGAMSTVDSLGHVPVSVAIDDRDIHKHEGDPQHPHVPWRKTVIYEMHVKGFTANAPWLPESLRGTYAGLAHPTTLAYLQGLGITSIELLPIMAKQDELFLQEHGRKNYWGYSTLSYFAPEPSYATKAAQEKGAAAVRQEVIDMVRALHEAGFEVIMDVVYNHTCEGGVEGPTVCWRGLDDLAYYRHQKSNTGRLEDTTGCGNTLDFTNTHVVTFAIDSLRYWAKRIGIDGFRFDLGVTLARLEGEFTHHHPFLYALRSDLLLGNLKLIMEPWDLGNLGWRTGQFSVPFAEWNDRFRDTARTFWLEDVDGGSDFGRISLQEMSTRLCGSADLFATEPGRGAPASINFVSCHDGFTLTDLTRYRSKHNEANGENNNDGSSVNHSANFGVEGVTDDPDVIAAREQAAMNMIGMLLLSLGTPMMLAGDEFRNTQDGNNNAYCQDNDITWLKWDWMYSTNKTREMRRLETVSRLVALRKSLDLYHHEDFFTRLTQLGLLKPSSRVQWFLPDGTTPMERDWFDLGVRSFTMRLLSNSEVDVCIVVNGTADDRTFRLPPDTHWTPKWCSAEINGRRAGHGTQVEECDLNGDTTVWTQHVPDASETVLKMVKEVAMQRTESSTENEADTIKFAMPVTDHAANGTSSAPRDEVSADMPDAPVDDTPDTPVDDNVWTMPALSITLMKQV

SEQ ID NO: 5370 - protein, 447 aa, Kluyveromyces lactis
MSVSESIAKTARAAGNILKTLSDEERSSILYKIHDGLKANAASIEAANKLDLEQAKSTNLSDSLVKRLDLFKGDKFETMLQGIVDVANLQDPVGKVNFAREIDENLTLYQITAPVGVLLVIFESRPEVIANITALSIKSGNAAILKGGKESLNTFKEMSRIVNDVVEQNEKTTHVPVGAVQLIETREDVSDLLQQDEYIDLVIPRGSNALVRQIKSSTKIPVLGHADGICSIYVDESADIGKAKRILVDAKTNYPAGCNAVETLLINPKLQHWWEVLNSLIENGVTLHVSKEVKKQYKEHNSTSDHIVDLDESKDFDKEFLSLDIAVAFVESTEAAVLHINTHSSKHTDAIVTENSENAEYFLKAVDSSSVYWNASTRFADGFRYGFGTEVGISTSKIHARGPVGLDGLVTYQYQLRGNGQIASDYLGAGGKKAFVHKDLDVKSISI

SEQ ID NO: 5371 - protein, 439 aa, Ralstonia eutropha
MNGKATRIQLLSLRSPQMRAFHLTWMAFFVCFFAWFACAPLMPVIKGEFGLTPAQIANINIAAVAVTILVRLVIGPMCDRFGPRKTYTGLLVLGALPVIGVAFAQSYETFLAFRLLIGAVGASFVITQYHTSVMFAPNVVGTANAAAAGWGNAGGGAAQALMPLLLGAVLMLGVDHAMGWRVALLVPGVLMLVMAVVYWCFTQDCPEGNYSDMRARGQAITGKDGGKGGGWASFRAASANYRVWLLFVTYGACFGVEIFIHNIAATFYVDHFGLSLKAAGLAAGSFGLLALFARALGGWLSDKAARRRGLDARSTLLFVLILGEGLGLLWFAQAGNVVMAVTAMLLFGLFTHMACGATYALVPFIDRKALGGVAGIIGAGGNVGAVAAGFLLKGLGDLQQTLTVLGVLAALAALCAIAIRFSAEHKAQEQALYDSALAN

SEQ ID NO: 5372 - protein, 853 aa, Ralstonia eutropha
MKLIIVGHGMVGHKFLECLAEAGAQNLDVTVLCEEPRPAYDRVHLSEFFAGKSAEDLSLVPAGFFEQHNNILLRLNARAVSIDRAARTVTVSTGETLAYDKLILATGSYPFVPPVPGKERKDCFVYRTIEDLEAMRECGARSKRGVVIGGGLLGLECAKALRDMDLETHVVEFAPRLMAVQVDEGGGRMLRQKIEGLGVTAHTGKNTVEIIDGADGTHRMVFADGTHLDTDMIVFSAGIRPRDELARAAGLAVGERGGITVDNNCRTSDPDVYAIGECALWQGKIYGLVAPGYDMARVAARHLRGEAAEFAGADMSTKLKLMGVDVASIGDPHGTVPGARLYQFSDDSKQVYKKLVVSDCGKYLLGGVLIGDASEYGTLLQMMLNKIELPESPEFLILPDSSGKAKPALGADALPDTAQICSCNNVSKGEICAAVCDGATSIGAMKSCTKAGTACGGCVPLVTQIMKAEMKKQGMAVNNHLCEHFPYSRQELYHLVRVGKFKTFDALLEAHGKGLGCDICKPTVGSILASCWNEFVLKEEHAALQDSNDYYLANIQKDGTYSVVPRMPGGEVTPEGLIAVGQVAKKYGLYTKITGGQRVDLFGARAEELPYIWEELIAAGFESGHAYGKALRTVKSCVGSTWCRYGVDDSVGLAIELENRYKGLRAPHKIKFGVSGCTRECAEAQGKDVGVIATEKGWNLYVCGNGGMKPRHAELLAGDLDRDTLIRYIDRFLMFYVRTADRLQRTSVWRDNLEGGLDYLKDVVLDDKLGIAADLEAEMQHVVDTYEDEWKKAVTDPETRKRFRHFVNSERRDDNLVFIEERGQIRPATPEERNLQRSRLSHIPVVAVPAKAA

SEQ ID NO: 5373 - protein, 413 aa, Ralstonia eutropha
MTPSAPSQSRPRLIVVGNGMAGMRTVEELLKLAPDLYDITVFGAEPHGNYNRILLSPVLAGEKTVDDIMLNTREWYAQNGIELLAGDPVVAIDRPRRTVRAQSGREVRYDRLLLATGSKPFILPVPGHQLDGVIAFRDIQDVEIMLDAARNHRHAVVIGGGLLGLEAANGLLRQGMDVTVVHLCDSLMERQLDKPAATLLKGALERKGLRFMLGAQTAEILGDTRVTGVRFKDGNEIPADLVVMTAGVRPNIELAAGAGLRCERAIVVDDTLQTYDPRIYAVGECVQHRQATFGLVAPIWDQARVCAAHLAGAGHRRYIQQATATKLKVTGVDLYSAGDFIGGEGSEDLVLRDARRGVYKRLVLQDGRLIGAVLYGDVQDGPWYFDLIQQCAPVAALRQRLLFGKAQCEALAA

SEQ ID NO: 5374 - protein, 833 aa, Oryza sativa
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKFSDGCAYKKYFLIGIGGSDNLPEKRCKIFFKTQQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 5375 - protein, 556 aa, Aspergillus nidulans
MSLAQNHYIIQLPQTPLLHRAPEPRSIAQKWITEFEVLLRTNDFSKLPQLFHEDSWWRDLLCLTWDFHTIQNLSGITAFLTENQPRARLFGFRLQHEGKFQPGLEHPAPGLTWISTIFFFETGTGRGSGVFRLTQDKEGVWKAYAIYTSLQELKGMEEPLGFRRVYGTTETMPGGLARGTWIERRTRQILFDEEEPTALIVGAGQAGLNVGARLQSLGVSCLIVDRHERIGDNWRKRYRTLVTHDPVEFTHMAYLPFPKNWPEFTPKDKLGDWFEAYASIMELNVWTKTSVTGATYDEAKKEWAVTITRGDGSERVLRPRHLVWCTGHSGEPLVPTFPDQEKFKGTIYHATKHQDASTSLANNPSPPTEECDLIAESLPYPVRFALDVHFTKRAFEAEKDLMMGLQKAGFELDHGIDGAGISRAYMTRGGGYYIDVGCSQLIADGKVKVRRSPDGIAGFTERGLVLKDGGVLESDIVVLATGYDNMRTTVRKTLGDKIADRLRDVWDLDEEGELNSMWRPSGQPGFWYMGGNLALCRIYSKFLALQIKAVEAGLVD

SEQ ID NO: 5376 - protein, 126 aa, Borrelia burgdorferi
MEKKIALIAHDKKKEDLVNFVKQNYLFLSKFKLIATGTTGSKIQQATDLTIFKYKSGPMGGDQQIGAEVAEGNILAIFFFRDPLTSQPHEPDVSALIRLCDVHKIPLATNVKTAEILIKGLESLIF

SEQ ID NO: 5377 - protein, 906 aa, Ralstonia eutropha
MNLSDIPVVSATPTTTTATTCPYCGVGCGVRATVRADGQVEIAGDAEHPSNHGRLCVKGSALGETVDLQGRLLHPKVRHEDGTLEQVSWDHALDTVAQGFSRIVREHGPDAVALYVSGQLLTEDYYVANKLMKGFIGTANIDTNSRLCMSSAVAGHKRAFGEDLVPGNYEDLELADLVVLVGSNTAWCHPILFQRLSKAKEARPEMKIVAIDPRRTATCELADLHLPVRAGTDVWLFNGLLSYLAREGKADTAFVAASTAGLDDALQATVDCSDPKAVARACKLDVEDVLAFYRLFADTEKVVTAFSQGVNQSSAGTDKVNSIINCHLLTGRMGRAGMGPFSLTGQPNAMGGREVGGLANMLAAHMELANPLHREIVQDLWQSPVMADQAGLKAVDLFNAIEQGRVKAVWVIATNPVVSLPDADQVRRALAKCELVVSSDIIERTDTNDAAHVLLPALGWGEKDGTVTNSERRISRQRAFLPAPGEARADWRVLCDVAQRMGFAGFDYAGPHEIFDEHARLSAWRNDEAPRAFDIGGMAGMDKDSYDTFEPLQWPVVAGSAAGTRRLFENGRYAHPDGLARFVATRTRAPAHAPDDDYPLILNTGRVRDQWHTMTRTGKSAKLADHLPEPFVDMHPQDALLCGVGEGKLARVATRWGAMVARVRHGGGIPRGSVFVPIHWNGQFSSDARVGALVNPVVDPVSGEPEFKHTPVSVEPFGVNWHGFVLSRRELPADTLTYWTRVQGKRFQRYEFAGREAIVDRAAWARSLLGVTDPEADWLEYEDRSAGTYHAGYVVNDRLEACVYVATRPELPSRSWLAELFGRDRLEDADRIGLLMGQPIEKGADAGPTVCSCFGVGRNTICDAVRKHGLTTPAEITACVKAGGNCGSCVPELKKLLVEVRVAEVA

SEQ ID NO: 5378 - protein, 400 aa, Escherichia coli
MKEKTIIIVGGGQAAAMAAASLRQQGFTGELHLFSDERHLPYERPPLSKSMLLEDSPQLQQVLPANWWQENNVHLHSGVTIKTLGRDTRELVLTNGESWHWDQLFIATGAAARPLPLLDALGERCFTLRHAGDAARLREVLQPERSVVIIGAGTIGLELAASATQRRCKVTVIELAATVMGRNAPPPVQRYLLQRHQQAGVRILLNNAIEHVVDGEKVELTLQSGETLQADVVIYGIGISANEQLAREANLDTANGIVIDEACRTCDPAIFAGGDVAITRLDNGALHRCESWENANNQAQIAAAAMLGLPLPLLPPPWFWSDQYSDNLQFIGDMRGDDWLCRGNPETQKAIWFNLQNGVLIGAVTLNQGREIRPIRKWIQSGKTFDAKLLIDENIALKSL

SEQ ID NO: 5379 - protein, 310 aa, Rickettsia akari
MKITTKVLIIGSGPAGLSAAIYTARAALKPILINGMRPGGQLTITTNVENYPGFVETVQGPWLMEQMSMQAQNVGTEIISDYVEKVDLSKRPFKVFTGSGNEYEAESIIICTGAEAKWLGIASEQDFMGFGVSACATCDGFFFKNQEIVVVGGGNSAVEEALYLTNHASKVTIVHRRDSFRAEQILQDRLFKNPKISVIWDHVVDEIVGRNKPKSVTGVKIQNVHTKEISLLNCSGVFIAIGHVPNTGLFTGQIAMDDDNYIITESGTTKTNVEGVFAAGDVQDKIYRQAVTAAGTGCMAALEAEKFLNK

SEQ ID NO: 5380 - protein, 712 aa, Bacillus anthracis
MSQEKQVFSIDLAGRQLTVETGQLAKQANGAVLVRYGDTAVLSTATASKEAKNVDFFPLTVNYEERLYAVGKIPGGFIKREGRPSEKAILASRLIDRPIRPLFADGFRNEVQVVNIVMSVDQDCSSEMAAMLGSSLALSISDIPFEGPIAGATVGRINGEFVINPTVEQQEQSDIHLVVAGTKDAINMVEAGADQVPEETMLEAIMFGHDEIKRLIAFQEEIVQAVGKEKSEVKLYEVDADLNQAVREMAEKDMHSAIQVHEKHAREDAINEVKKRVIEHYEAQEADADTLGQVNEILYKIVKEEVRRLITVEKIRPDGRKGDEIRPLASEVGILSRTHGSGLFTRGQTQALSICTLGALGDVQILDGLGVEESKRFMHHYNFPSFSVGETRPMRGPGRREIGHGALGERALEPVIPSEKDFPYTVRLVSEVLESNGSTSQASICGSTLAMMDAGVPLKAPVAGIAMGLVKTGEHYTILSDIQGMEDHLGDMDFKVAGTAHGVTALQMDIKIDGLSREILEEALQQAKVGRVHILNHMLSVIAEPRTELSAYAPKIITMTINPDKIRDVIGPSGKQINKIIEETGVKIDIEQDGTVFISSINQEMNDKAKKIIEDIVREVQVGEIYEGKVKRVEKFGAFVELFSGKDGLVHISELALERVGKVEDVVKIGDVITVKVIEIDKQGRVNLSRKVLLKEEQEKEAAKEENKQEQQ

SEQ ID NO: 5381 - protein, 715 aa, Arabidopsis thaliana
MKSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVSSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMLENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKLIRGVKVRQPSGQKPEAPPSSAATKRQNKSQRNINNNSPSANVVVASPTSQTVK

SEQ ID NO: 5382 - protein, 572 aa, Cryptococcus neoformans
MSIPYETEKDKSISGGSQGAMTPINGKSGNEVLVTPALGEKGGFEGSGGNPGEGTVHRTLKQRHMAMIALGGAIGTGLFVGSGSALATGGPVGFWLGYVFMGLMVYSMMVALGEMASLYPVAGAFTHYAARFVDPALGFATGINYWYSYAITIPTEIVAATIVISYWDATTNAAVYITVCFVSIIAINFLGARAYGEAEFWFSSIKIVTIVGLIILGIVLMCGGGPNHDAIGFRYWRDPGPFAQVTIENGAGVIPGRWGQFLAFWNVFVQAAFSFIGTEIIATTLGEAENPRKTVPRAIKQVFFRILFFYVMGTFVISVLVPYTEPDLLNGSGTAAASPFVIAINNAGIKALPSIVNAVLLIAAWSAGNSDLYAASRTLYALALERQLPRVFRRCTKRGLPIWCVTVTALFGAFAYLNTGGEAAEEAFNWLYNLSAITGILTWWAILLSYLRFYYGLKKQGISRDDFPYRAPLQPYLSWLGFIFFTLVTIFSGFTVFLKGNWDTSSFFATYITIPIFVGCWIGWKVVKKTKIVPLEHMDFTTGRRELDELEALDAERFKAETKYQKIISILF

SEQ ID NO: 5383 - protein, 468 aa, Idiomarina loihiensis
MREAIWFRSDLRILDNPAVFSACHGDEPPLAIFFVCHETWKSHDWAPIKVDFIWRNLECLQQDLAEKGIELQVQLVPKFSQVPGALRSFCRENKIARVHINAEYALDEKRRDAATNAVLSNDDIELVSHHGNLLVSPGEVRTQQGDYYKKFTPFNRRWRQVLSEKTYSEPLQIKSYSRVTAKGLPECPLGRKDSSDWSAGEQQVLGKLGQFVGHSVDDYQQARDLPAENGTSQLSAYLAQGVIGPQTAVRALHKFSPEFPFGLASGADTWLTELAWREFYQHLMYFVPRLSKGESFQSETDSIQWLEDDDAFQRWCDGRTGYPIVDAGMRQLTSTGWMHNRLRMITANFLVKDLLVDWRKGEAFFMQHLIDGSFPANNGGWQWSASVGTDAVPYFRVFNPVKQSEKFDPDGQYIRKWVEELKEVPTKYIHWPHSWLQQQSSNNYCDPMVEHKFARERFLTTFKQVKNG

SEQ ID NO: 5384 - protein, 123 aa, Vibrio fischeri
MQFLHTMIRVTDLKQSIEFYTKVLGMKVLDHSENSEYRYTLVFVGYEEGGTSIELTYNWDTDNYDMGNAFGHLALGVQDIYAACDNIKALGGNVTREAGPVKGGTRVLRLLQILMVIKLSLFN

SEQ ID NO: 5385 - protein, 520 aa, Unknown
  Mycobacterium sp. JLS
MTTTEPAPPESATGRPSPRWRALLLAAVAACAACGLVYELALLTLSSSIHGGGIVATSLIVAGYVAALGAGALAVKPLLGHAAITFVAVETLLGVIGGLSAAALYVTFAFIGGSTWVLVVGTALIGGLVGAEVPLLMTLLQRGRTAGAADSGRVLANLNAADYFGALVGGLLWPFLLLPHLGMIRGAAATGVINLVAAAGVAVFLLRHIVSGRQLAVALGALSAALVLLVTLLIRADGIETTTRQRLYNDPIVAFARSPYQEIVVTRRGDDLRLYLDGGLQFSTRDEFRYTESLVYPALGQGARSVLILGGGDGLAARELLRQNQIRDITQVELDPAVIDLARTTLREANRGALDDPRVTVVVDDAMTWLRSVDRTFDAVIVDLPDPDTPVLGRLYSTEFYALVTRALAPDGLMVVQAGSPYSTPTAFWRTVSTIESAGFAVTPYHVHVPTFGDWGFALARRGPTPPAPTVPEGVGPLRFLNQEVLDAATVFSADVARQRLEPSTLEHPRIVDDIRKGYR

SEQ ID NO: 5386 - protein, 471 aa, Rhodobacter sphaeroides
MMADAPLILWFRRDLRLADNPMLAEAAATGRPLIPLFILDPETEALGAAPKWRLGLGVEAFARALEGLGSRLVLRRGPALAVLEALVAETGAAGVHWSRLWEPDWRARDEGVKAGLRQAGIEAASHAGHTIFEPREVETGQGGFYRVYTPFWKAVKDRPVAASSPPPARLLSPAEWPVSERLACWDLGRAMHRGAAVVAPHLAVGEAAAAERLTRFLSGPLDRYAAERDRPDAPVTSRLSENLTYGEISARSLWHAGMRARAEGRAGAEKFLQELAWREFGWHLLYHTPEIARRNWRGDWDAFPWRGDNPDAERWRRGMTGEPFVDAAMRELFVTGTMHNRARLIAGSYLTKHLLTDWRVGQAWFEDCLIDWDPASNALGWQWVAGSGPDASPYFRIFNPATQAEKFDPESAYRQRFLAEIARRPGPEALAFFEAVPRSWGLRPDRCYPRPVVGLAEGRERALAAYGRRNN

SEQ ID NO: 5387 - protein, 991 aa, Solanum pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 5388 - protein, 708 aa, Oryza sativa
MEAMDDMAALTEDILLQIFSRVGSIKDLFKFAVTCRRWLRRFTDPAFLRGLCLDSGEGHRARLLGFFFQQTRFYRCEKMIKMRVTQQSSVCPPTFLPAPWSPLGLTDRTLTSFLATDDDTFNYAEPLAARCGIVLMRLVPRTALMIACSHLLGVCNPITGECHVLPPLNLSGLHRYLTSYAIITSTDSDLDGKQPPSSSSSGRSTFSQLYLVVQHKKDCNEYFYSYSAATCSWSAPTMCVDGRRFSLVGERSAVVHKGAAHWLFIDRVSSATQDDILYKLTAAVDTSEISLTRLPFGAGGSPLLCVSGDGKLSVACVFPIHMRVWTQQDDTPATWLRTVIRIPLAVPYPDYSHICQPREKWFNFNRGSMLVLYRSNGVFILDLEKKVMEKVMDCLLPLFSDKLNRTAVAYEMDLVEFFVLQLSGYIWKLSLLVITVTGLTPWQKAQNLNPKKEQPTTTALQKRGPLHIFLCNVSDPHGNASQPSNRKGTGRHTFIHVIDPRDKPLHQSAPTFTHYKLTAPVSSFHTAISQHISTHRSKAKPTDPLPLPEKKREASMAPKAEKKPAAKKPAEEEPAAEKAEKAPAGKKPKAEKRLPAGKGEKGSGEGKKAGRKKGKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 5389 - protein, 107 aa, Apium graveolens
FDFVLFMGAVTRPPNLSIITEYLPRGSLYRLIHRPHSQIDEKRRIKMALDVAKGMHCLHASRPTIVHRDLKSPNLLVDKNWNVKVGDFGLSRLKHNTFLSSKSTAGT

SEQ ID NO: 5390 - protein, 423 aa, Zea mays
MAITPRLAAIFFSLLCCRSASSLRPPNLISNSSGGVITHLPGFQGPLPFHLQTGYVEVDEDNGVHLFYYFVRSEREDSPGDDPVVLWLTGGPGCSVLTGLAYEIGPLSFDLNGYVGGLPKLVYKQDSWTKWFDKYPQFFSSPLYIAGDSYSGMIVPTVTSEIARGKEEGSQPNLNLKGYLVGNPVTDFNFDGPSRIPFAHGMGLISDEIYECIKGISPNHVLEPLCAFASPKPKLISSGAREMLQLPVPVHTEEEEEELRLSEISLQCRTAGYMMSSMWANDASVRQALGIHKGTVPSWSRCNYDIPYTNDIPSAVKYHLDVTTKGYRSLVYNGDHDMVVPFIGTQAWIRSLNFSTVDEWRPWFVDGQVAGYIIQPGYLCRFTRSYSNNLTFATVKGGGHTAPEYMPRQCFAMFVRWVSGDPL

SEQ ID NO: 5391 - protein, 112 aa, Magnetospirillum magnetotacticum
MKLIMAIIKPFKLDEVREALTPLGVQGLTVSEVKGFGRQKGQTEIYRGAEYVVNFLPKVKIEVAVNDDLVDRVVEAIQTAARTGKIGDGKVFVTEIQQAYRIRTGESNAEAL

SEQ ID NO: 5392 - protein, 73 aa, Vicia sativa
KGKVDVADDVTLEYLGSVHVQKGVIDLHFMVFKKAMLKTIKMAVEDKWSEELDCAWGKAYDELAAAIKKAMGW

SEQ ID NO: 5393 - protein, 848 aa, Solanum pimpinellifolium
MMMVSRKIVSSLQFFTLFYLFTVAFASTEEATALLKWKATFKNQNNSFLASWTPSSNACKDWYGVVCFNGRVNTLNITDASVIGTLYAFPFSSLPYLENLDLSNNNISGTIPPEIGNLTNLVYLNLNTNQISGTIPPQIGSLAKLQIIRIFNNHLNGFIPEEIGYLRSLTKLSLGINFLSGSIPASLGNMTNLSFLFLYENQLSGSIPEEIGYLSSLTELHLGNNSLNGSIPASLGNLNNLSFLFLYENQLSGSIPEEIGYLSSLTELDLSDNALNGSIPASLGNLNNLSSLYLYNNQLSDSIPEEIGYLSSLTELNLGNNSLNGSIPASLGNLNNLSSLYLYANQLSDSIPEEIGYLSSLTNLYLGNNSLNGLIPASFGNMRNLQALFLNDNNLIGEIPSYVCNLTSLELLYMSKNNLKGKVPQCLGNISDLRVLSMSSNSFSGDLPSSISNLTSLQILDFGRNNLEGAIPQCFGNISSLEVFDMQNNKLSGTLPTNFSIGCALISLNLHGNELADEIPRSLDNCKKLQVLDLGDNQLNDTFPVWLGTLPELRVLRLTSNKLHGPIRSSGAEIMFPDLRIIDLSRNAFSQDLPTSLFEHLKGMRTVDKTMEVPSYERYYDDSVVVVTKGLELEIVRILSLYTVIDLSSNKFEGHIPSVLGDLIAIRVLNVSHNALQGYIPSSLGSLSRVESLDLSFNQLSGEIPQQLASLTFLEFLNLSHNYLQGCIPQGPQFRTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 5394 - protein, 361 aa, Unknown
  Populus tremula x Populus alba
MEGGDGGSSTTSCMMAFGDNSNGLCPMMMTPLMSSSSAHHHHRANEGDSSVSNTLFLPLPPTNNQGHNRIHSNASGSSSMIIDDHNHNNTVTATGCYFMDNNDGSSSSVKAKIMAHPHYHRLLAAYANCQKVGAPPEVVARLEEACASAASMAPANTGCIGEDPALDQFMEAYCEMLTKYEQELSKPLKEAMLFLQRVECQFKALTVSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 5395 - protein, 160 aa, Glycine max
  misc_feature (7)..(7): Xaa can be any naturally occurring amino acid
  misc_feature (16)..(16): Xaa can be any naturally occurring amino acid
  misc_feature (62)..(62): Xaa can be any naturally occurring amino acid
  misc_feature (83)..(83): Xaa can be any naturally occurring amino acid
  misc_feature (124)..(124): Xaa can be any naturally occurring amino acid
DGSLPGXYAFHPLRLXRTPHVLKCNKKAEFILGTCAMAASLGIVVGQPWSVVSCFEPGTDPXAIAPFSFGTLLRTQMILMEWXVEIKRWKDFFKPYSQTAQCSTPWSRTSEKFANATGETRYSXRKFSAPLMLAGTIKDGLHIPHTNKLKKMKLTEINDA

SEQ ID NO: 5396 - protein, 716 aa, Erwinia carotovora
MKKITSVCPYCGAGCKLKLVVEDNKIIRAEAADGVTNQNELCLKGYYGWDFLNDTQLLTPRLTQPMIRYEKGGRLTPVSWDEAIRYTAQRFSEIKAKYGPRSIMTTGSSRGTGNETNYVMQKFARAVLNTNNVDCCARVCHGPSVAGLQEVLGNGAMSNSISDIENSKCLLIFGYNSADSHPIVARRVVKAHQNGAKIIVCDPRRIEAARIADQHLQLNNGSNMALVNAFGYVLLEEKLYNQHYVDRFTEGLDTYREIVKDYAPEAVEHLTGVPAADVRQAMRTFAAAPSATIMWGMGVTQFGQAVDVVRGLAGLALLTGNLGRENVGVGPIRGQNNVQGACDMGVLPNMFPGYQSVTDPDVRAKFADAWGISPAVMDENIGTRITEVPHMALEGKIKAYYIMGEDPLQTEADLSLVRRGVEALDFLVVQDIFMTKTAEVADVLLPATSWGEHGGVFTCADRGFQRFEKAIEPKGNVKRDWEIISLIASEMGYPMHYADNQQIWDEMRSLCSLFYGVTYEKMGDMGHIQWPCPTLDHPGTPYLYQDSHFDTPTGKGKLFATQWRAPAEVPDEAYPLVLCTVREVGHYSCRSMTGNCAALQALADEPGRVQMHPQDANRLGIKDRSLVWVSSRRGKVISRADISERINKGTIYMTYQWWIGACNELTQDNLDPISKTPETKYCAAKVDVIEDQRWAEDFASTSYNDMKARLRAAVAH

SEQ ID NO: 5397 - protein, 715 aa, Unknown
  Burkholderia sp. 383
MSMFNKVVKEFQWGQHKVRLETGEVARQASGAVIVDVEDTVVLATVVGAKSAKPGQDFFPLTVDYLEKTYSAGKIPGGFFRREGRPSEHETLTSRLIDRPLRPLFPEGFYNEVQVVIHVLSVNPEIPADIPALIGASAALAVSGLPFNGPVGAARVAYIDNAYVLNPTRDQIKASSLDLVVAGTERAVLMVESEADQLSEDVMLGAVVFGHEQMQVAIDAIHELVREGGKPEWDWQPAPKNEPLIARVTELAQNDLLAAYQLRDKQARSTKLKEVYAATSAKLEEDASAAGTVAADKATVGNVLFDIEAKIVRSQILNGEPRIDGRDTRTVRPIEIRTGVLPRTHGSALFTRGETQALVVATLGTKGDEQIIDALEGEYRERFMLHYNMPPFATGETGRVGSPKRREIGHGRLAKRALVKCLPSADEFGYSIRVVSEITESNGSSSMASVCGGCLALMDAGVPMKAHVAGIAMGLILEGNKFAVLTDILGDEDHLGDMDFKVAGTEQGVTALQMDIKIQGITKEIMQVALAQAKEGRMHILGKMTSAVSGANTQLSEFAPRMITIKINPEKIRDVIGKGGSVIRALTEETGTTIDISDDGVVTIASTNSDGMAEAKKRIENITAEIEVGQVYEGTVLKLLDFGAIVNLLPGKDGLLHISEIVNERVKDINDYLKEGQQVKVKVIQTDEKGRVRLSAKALLNEAAAASQSDTPPQQ

SEQ ID NO: 5398 - protein, 297 aa, Triticum aestivum
MSSSSSSGASAAFTPVSQQQQQMAPENLSSELQPPAPMQPEAPSEQLCYVHCHFCDTVLVVSVPSSSLFKTVTVRCGHCSSLLTVDMRGLLFPTTTTTVAAESAASAVTTTTSPPPAAAAHHGQFHYPSSLNLAPGNPPRHSLLDEISSANPSLQLLEQHGLGGLIAAAGGRNAAAPAPLPPPPVAGGKGGKEPSPRTNPVVNRPPEKRQRVPSAYNRFIKDEIQRIKAGNPDISHREAFSAAAKNWAHFPHIHFGLMPDHQGLRKTSLLPQDHQRKDGHGLLKEGLYAANMGIAPY

SEQ ID NO: 5399 - protein, 256 aa, Burkholderia vietnamiensis
MTTGKVTLLGAGPGDPDLLTLKAAKALAAADVLLLDDLVAPGIVELAPQARVIRVGKRGGCRSTPQAFIEKLMRRYALRGAHVVRVKGGDALLFGRAGEELATLRAAAIPVEIVNGISSGFAAAASLGISLTHREHCQGVTFVTAHRQDHGEPDWAALAATGTTLAIYMGMSRVDSIATGLLAALPAATPAAAVQWAGTPHERRWTGTLGGLARGIDDARLGSPAVILVDGAIGAACAQRTDTDPDTAAAPMSWAA

SEQ ID NO: 5400 - protein, 498 aa, Burkholderia vietnamiensis
MAWHDACVSCLGRINGDSSAVPNTDAPGNGLHGQRRPTHRVSTRSDVQDAVFRLADDMTDKATRIDLFSFRSAPMRAFHMTWMAFFVCFFAWFACAPLMPLISREFHLTAAQVANINIAAVAATIAVRLLVGPLCDRFGPRRVYVGLLLLGAIPVFAVSFVHDYLSFLICRLGIGAIGAGFVITQYHTSVMFAPNVVGTANATTAGWGNAGAGATQAMMPLLVAAGLLLGFGDDASWRIALVVPGIAMLAMAWAYWRFTQDCPQGDFVALRKQGVTVDSGKKGGWASFFAACGNYRVWMLFVTYGACFGVEVFIHNIAALYYVDHFKLSLKDAGFAVGLFGLLALFARALGGWLSDRIAARRSLDVRATLLCALIIGEGLGLLWFSHAQGIGMALVAMLTFGLFTHMACGATYALVPFIDRRALGGVAGIVGAGGNVGAVAAAFLLKGVGDVQHALSLLGLVVTATALCAMAVRFSAEHKAREAELRDRALATANAAN

SEQ ID NO: 5401 - protein, 857 aa, Burkholderia vietnamiensis
MKLIVIGHGMVGHKLLECLAAQADAAGTLQVTVLGEEPRPAYDRVHLSEFFAGKSADDLSLVEPGFFERHRQFDLRLNARVASIDRDAHTVTLASGATLAYDKLVLATGSRPFVPPVPGHERDGCFVYRTIEDLEAMQARGAHATRGVVVGGGLLGLECAKALRDMGLDTHVVEFAPRLMAVQVDDGGGRMLRAKIESLGVTVHTGKNTLEIVDGEQHAHRMAFADGSHLDADMIVFSAGIRARDELARACGLEIGPRGGVAIDDACRTSDADIYAIGECAAWNGMVYGLVAPGYDMARVVAKQLGGKMTDAADAAFAGADMSTKLKLMGVDVASIGDAHGATAGSRTYQYADERRQVYKKLVVSDCGKFLHGAVMVGDATEYGTLLQMMLNRIELPAQPEFLILPSSDGAAKPALGVDALPDGAQICSCNNVSKSQICAAVADGATSLGALKSCTGAGTSCGGCVPLVTQIMKAEMKKQGLAVNNHLCEHFAHSRQELFHLIRVERITTFDELLHKHGRGLGCDVCKPAVAGILASCFNEFVLKKEHAGLQDSNDYYLANIQRDGTYSVVPRMAGGEVTPEGLIAVGQVAKKYGLYTKITGGQRVDLFGARVEQLPSIWEELIAAGFESGHAYGKAVRTVKSCVGSTWCRYGVDDSVGLAIDIENRYKGLRAPHKIKFGVSGCTRECAEAQGKDVGIIATEKGWNLYVCGNGGMKPRHAELLASDLDRATLIRYIDRFLMFYVRTADRLQRTSVWRDNLEGGLDYLIDVVVHDRLGIAAELEADMQHVVDTYECEWKKAVTDPETRKRFRHFVNSDAPDTTIAFVETRGQIRPATPDERPGGKPVAIPVVAEPATV

SEQ ID NO: 5402 - protein, 479 aa, Salmonella enterica
MSILVKNNIHWVGQRDWEVRDFHGTEYKTLRGSSYNSYLIREEKNVLIDTVDHKFSREFVQNLRSEIDLADIDYIIINHAEEDHAGALTELMAQIPDTPIYCTANAIDSINGHHHHPEWNFKVVKTGDTLDIGDGKQLIFVETPMLHWPDSMMTYMTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGINEVDPNVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDLDALELCRQHGRDIARQWALAPLPETTQKTAPVEETTTCTAADLGPKMQCSVCQWIYDPALGEPLQDVAPGTPWSDVPDNFLCPECSLGKDVFDVLATEAK

SEQ ID NO: 5403 - protein, 377 aa, Salmonella enterica
MSRGIIIIGSGFAARQLVKNIRKQDAHVPLTLIAADSMDEYNKPDLSHVISQSQRADDLTRQLAGEFAEQFNLRLFPHTWVTDIDADAHVVKSQDKQWQYDKLVLTTGATAFVPPIAGRELMLTLNSQQEYRACETPLRDAQRVLIVGGGLIGSELAMDFCRAGKTVTLMDNAASLLASLMPPEVSSRLQHHLTDMGVHLLLKSQLQKLEKTEAGIRATLVSQHSIEVDAVIAATGLRPETALARRAGVAVNRGVCVDSYLQTSHPDIYAIGDCAEINGQVLPFLQPIQLSAMYLAKNLLGGNAPLKLPAMLVKVKTPELPLHLAGETQRRDLSWQITAESDGMIAKGMSGEGQLRAFVVSEDRMKEAFALLKTLSV

SEQ ID NO: 5404 - protein, 1402 aa, Burkholderia vietnamiensis
MSATPVKSVCPYCGVGCGMVLHVEADEVVKVSGDSEHPTNFGRLCTKGSSAHVALRRSGRLDRAFVRRAREDDLVPLPARDAIAETARRLRAVLDAHGPDALSFYVSGQMSIEAQYLVNKLAKGFVGTNNIESNSRLCMASASTGYKQSLGADGPPGSYQDFDRANLFFVIGANMADCHPILFLRMMDRVKAGAKLIVVDPRRTGTADKADLFLQIRPGTDLALLNGLLHLLHANGRTDAAFIDAHTEGWDAMPAFLADYTPERVAEITGLAPDDLRTAAQWIGDAPEWTSCWTMGLNQSTHGVWNTNAICNLHLATGTICRPGSGPFSLTGQPNAMGGREMGYMGAGLPGQRSVASDDDRRFVENLWRVPAGTLRQETGSGTVDLFERMAAGDIKACWIICTNPVATVPNRQNVIAGLQAAELVIAQDAFLDTETNRYADILLPGALWAEGDGVMVNSERNLTLMRAAVAPPGDALPDWRIVAEVARAMGFGAAFDYASAADVFDEIVRFSNPATGYDLRGASHAALRDGPVQWPVAPGAARERHPIRYLNDGVSQTLRPAADGGAAPRIAFPTPSGRARFFARPHVAPAELPDDTFPIVLNTGRLQHQWHTMTKTGKVAMLNKLNPRPFVELHPDDARALGIAAKDSVEIRSARGRAVLPAVVTERVLRGNCFAPMHWNDVYGDELCINAVTNDAIDAESQQPELKYCAVALTRADTNAFAPADDDTARLDAAAADAAHAAAAADAQAAPVSLAASQESDMADLDTFAAALGVADLAPPPLSDAERLYVAGLVGGLRASAGRRDGGVPVLPAGAPLTPPVRYWLDGMLAGLFSRSAPAPATERAAPALPADAAAPGGVRIVRTRPKVTLLWASQTGNIESLTEDYATQLMNAGFEIRTACMSDYPVASLASAQYVLLMTSTFGDGDAPDNGSEFWDALQAAGAPRVEGMQFAVLAFGDRNYDQFCGHGRRLDARLAELGATRLCARVDCDVEFQRDADQWLERVVARIKEADAALHAVPSAGASASGLLPSKAHPAPSKLVANLRLNRPGAAKDTRYVSLSTEGANLEYEAGDALGVWPTNCPELVDELLAVTALKADTPVSVAGVGDVRLADALARHFDITRPHPDTLAFIASRSANGALKALLGDDRKADLKQWLWGQQLADVLHEFPVELSGMELVGILKRLQPRLYSIASSPSAHRGEIHLTVSAVRYHNGRRARKGVASTFLADRADDGRVPVFVQKSAHFRPPVNGDVPVVMVGPGTGVAPFRGFLHERQARGARGRNWLFFGEQHAQTDFYYGDELSAMRDSGFLTRLDLAFSRDQADKIYVQDRMREHGAELYSWLEDGAHFYVCGDAARMAKDVDTALKAVVAEHGGMSDEAANDYVARLAKARRYVRDVY

SEQ ID NO: 5405 - protein, 371 aa, Helianthus annuus
MAGVVKEFDSSHDMFKVREEPKVVFNNKDLSEEMMKIKEEPMLVFDEHEDFVGGEEAPKPIEGLRDGGPPPFLKKTFEMVDDPTTDSIISWSSSKNSFILWDPHKFSTDLLPQRFKHNNFSSFVRQLNTYRFKKIDPDRWEFANEFFQKGKKHLLRDIKRRTNQPQNTQKQEEIRKQEQQQCCGHQTNSTMETELKNLRKERITLKQEILKMKQQQENTEKHLEMVEERMLRMEFKQQQLLVFMSKAFRNPIFVKLLQHLVQKQKTGSVEMCKKRKLEQMLNTDDLDRFQEMWNMIEPDAYTVLSSDGSVSPPEDQNTSDKSGSNGSDYNSESFILWEKLMEDELIFGGEQSGKDQTETYLQEWEELIPKA

SEQ ID NO: 5406 - protein, 160 aa, Arabidopsis thaliana
MESEGKIVFTEEQEALVVKSWSVMKKNSAELGLKLFIKIFEIAPTTKKMFSFLRDSPIPAEQNPKLKPHAMSVFVMCCESAVQLRKTGKVTVRETTLKRLGASHSKYGVVDEHFEVAKYALLETIKEAVPEMWSPEMKVAWGQAYDHLVAAIKAEMNLSN

SEQ ID NO: 5407 - protein, 202 aa, Rhodopirellula baltica
MTSSNSNSSREVSLERKTGETDIKLSVNLDGSGAGKRDSGIGFLDHMLDLLAKHALIDLTVEAKGDLHVDDHHTAEDIGIALGTAVDRALGDRAGVRRYGHFTLPMDECLVTSAVDMGGRYAFEYNAPIAASKIGTFDSELVEHFWQSFAVNAKCNLHVLLHHGSNGHHISECVFKATARAIRMAVESDPRSDAIPSTKGVL

SEQ ID NO: 5408 - protein, 624 aa, Triticum aestivum
MAPPLSSWPWASLGIYKYFLLGPLVWKVAQEWAEQGGAPLGSRWLHLLLLFSARGLTYQFWFSYSNMLFLTRRRRVVPDGVDFRQVDHEWDWDNFLVLQTLIGAALVNGPLPLLPGLEDLRVWDPRGLGIALLLHVGFSEPVFYWAHRALHGAPLFGQYHAGHHSTPVTQPLTAGFGTPLEALLLTLTMGVPLAGAFLMGAGSLGLVYVHLLTFDYLRSMGYSNVEVISHRVFEALPPLRYLIYTPTYLSLHHREKDSNFCLFMPLFDLLGGTLNSKSWELQKEIYKGKNDRVPEFVFLVHVVDIMSSMHVPFVLRSISSVPFENHLILLPFWPVALVYGMLMWCCSKTFLVSFYYLRGRLHQTWSVPRHGFQYFIPAAKAGINRQIELAILRADRMGVKVLSLAALNKNEALNGGGTLFVDKHPDLRVRVVHGNTLTAAVILNEIPSNTKEVFLTGATSKLGRAIALYLCWKKIRVIMLTMSSERFLKIQREAPAEFQQYLVQVTKYQAAQNCKTWLVGKWLSPREQRWAPPGTHFHQFVVPPIIGFRRDCTYGKLAAMRLPKDVQGLGSCEYSMERGVVHACHAGGVVHFLEGWEHHEVGALDVDRIDVVWKAALKHGLTPV

SEQ ID NO: 5409 - protein, 776 aa, Unknown
  Pseudomonas sp. SMP1
MKCPKILAALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNTTYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 5410 - protein, 275 aa, Pyrococcus abyssi
MPRRAREYPEEGEFVVATVKRIHNYGAFLELDEYPGKEAFMHISEVASTWVRNIRDYLKEGQKVVAKVIRVDPRKGHIDLSLRRVTQQQRKAKLQEFKRAQKAENLLKLAAEKLGKDFETAWREVWVPLEEEWGEVYAAFEDAAKDGIDVLKGHVPDEWLPVLKEIIDNYVEVPTVTIDAEFEITVPKPNGVEIIKEALIRARDRANKEKDVEVKFTYLGAPRYRIDITAPDYYKAEEVLESIAEEILRVIKEAGGEATLLRKEKRIKKVKKRKK

SEQ ID NO: 5411 - protein, 260 aa, Mesorhizobium loti
MALPDFSMRQLLEAGIHFGHQTHRWNPKMAPYIYGARNNIHIIDLSQTVPLLHQALKQVSDTVAKGGRVLFVGTKRQASDIVADAAQRSAQYYVNSRWLGGMLTNWKTISNSIQRLRKLDEMLAGEAQGLTKKERLNLDREREKLDKALGGIKDMGSTPDLMFVIDTNKEAIAILEAKRLGIPVVAIIDSNCDPDKIDFPIPGNDDAARAIQLYCDLIAKAAIDGIARQQGALGVDIGASVEAPVEPALDPAPSTEAPQA

SEQ ID NO: 5412 - protein, 363 aa, Borrelia burgdorferi
MSFYKVIGGVFMKISVIGAGAWGTAISKSLADKFDFNIFLWVFEEDVKNDINNDNVNTKYLKGIKLPKNLVASSDLFEVVTMSDYIFIATPSLFTVDILKKLDQFLHFLEIKPKLAILTKGFITFDGKTQTVIEAAERIMKGYKDEITYIVGPSHAEEVGLGVITGLVAASNNRENAYLFINLFSKTPISLFYSNDVFGVQIAAALKNVFAIAFGILDAYKLNYPNLIGNNTESFLFSISLNNIKDIAMELGGRNIETFLFLSGSGDLDVTCRSMFGRNRRFGNEIVSKNILESFLSIDDLISNIEKIGYLPEGVLAAKSIFFFFKQLNRDLNPNSLLSVIYKILNKELEPKSVIEYMRDVRQ

SEQ ID NO: 5413 - protein, 163 aa, Oryza rufipogon
MEELEGHRGAGRLPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 5414 - protein, 308 aa, Unknown
  Synechococcus sp. WH 5701
MTWTTASIPDQSGRIALITGANSGLGLESARALASHGATVVLACRSRRRGEEARAELLPAAVAGLEVLELDLADLASVRAGARWMQEQYGRLDLLLNNAGVMGPPRQLTRDGFELQFGTNHLGHFALTTALLPLMEGRADARVVTVTSGAQYFGKLAFDDLQSERRYDRWAAYSQSKLANVTFALELQQRLAAAGSTVSSLAAHPGLARTNLQPASVASSGSRFESLAYRLMDPLFQSAAMGALPQLYAATAPEARGGEHYGPDQWGGMRGGPTQVRIAPAALDPQIRQRLWEVSEQLVGQAAPAEAA

SEQ ID NO: 5415 - protein, 319 aa, Bacillus subtilis
MKRIGVLTSGGDSPGMNAAVRAVVRKAIYHDVEVYGIYNGYAGLISGKIEKLELGSVGDIIHRGGTKLYTARCPEFKTVEGREKGIANLKKLGIEGLVVIGGDGSYMGAKKLTEHGFPCVGVPGTIDNDIPGTDFTIGFDTALNTVIDAIDKIRDTATSHERTYVIEVMGRHAGDIALWAGLAGGAESILIPEADYDMHEIIARLKRGHERGKKHSIIIVAEGVGSGVEFGKRIEEETNLETRVSVLGHIQRGGSPSAADRVLASRLGAYAVELLLEGKGGRCVGIQNNKLVDHDIIEILETKHTVEQNMYQLSKELSI

SEQ ID NO: 5416 - protein, 227 aa, Coccidioides immitis
MANDEYDFLFKGTSYTPRPAMSNPILRALVLIGDSGVGKSNLLSRFTRNEFNLDSKSTIGVEFATRSIQVDSKTIKSQIWDTAGQERYRAITSAYYRGAVGALLVYDISKHQTYENVTRWLKELRDHADSNIVIMLVGNKSDLRHLRAVPTEEAKQFASDNNLSFIETSALDASNVELAFQNILTEIFRIVSSKALDSGDSAQNPLSDRKVVEITKTQDPESKQGCC

SEQ ID NO: 5417 - protein, 161 aa, Oryza glaberrima
MEELEGHRGAGRLPPPPPLLPFPKVSVQVYTVPSSSTAASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 5418 - protein, 709 aa, Haemophilus influenzae
MNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADVLTEEQMLAAVVFGHQQQQVVIEAIKEFAKEAGKPRWDWVAPQPNTDLINKVKAIAEARLGDAYRITEKQARYEQIDAIKADVIAQITAEDEEISEGKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIIAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 5419 - protein, 374 aa, Glycine max
MDNDLAGDMLCQNVNYNSAYRKLARSYHPDVNKEPDAEQKFKELSNAYEVLSDDEKRSIYDTYGEAGLKGSGMGMGDFSNPFDLFETLFEGMGGMGGSRGSWNGAVEGEDEYYSLVLNFKEAIFGVEKEIEIRRLESCGTCNGLGAKPGTKSSKCSTCGGQGRVVTSTRTPLGIFQQSMTCSSCSGTGETSTPCSTCAGEGRVRKTKRISLKVPAGVDSGSRLRVRNEGNAGRRGGSPGDLFVVLEVIPDPVLKRDDTNILYTCKVSYIDAILGTTIKVPTVDGMVDLKIPAGTQPSSTLVMAKKGVPLLNKKNMRGDQLVRVQVEIPKKLSKEERKLIEELADLSKGKTAATNSQLGAAAIHFRTVVGLVSIY

SEQ ID NO: 5420 - protein, 534 aa, Saccharomyces cerevisiae
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 5421 - protein, 159 aa, Oryza meridionalis
MEELEGHRGAGRLPPPPPLLPFPKVSVQVYTVPSSSTAAAGGARQAVAPATRDGGGGGRAAGVLDDPVKARIVSHPRYHRLLAAFLDCHKVGCPAEAAEEIAAAARVREARQRAAAAASHMPPAPDDPELDQFMEDYCKLLVECKEELSRPLQEAEEFL

SEQ ID NO: 5422 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNNLARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 5423 - protein, 613 aa, Haemophilus influenzae
MTDKITFNDLGLPEFILKAVSDLGFETPSPIQQSCIPHLLNGNDVLGMAQTGSGKTAAFALPLLAQIDPSEKHPQMLVMAPTRELAIQVADACEQFVKYAQGTRIVTLYGGQRYDIQLRALKQGAQVIVGTPGRILDHIRRGTLNLSELRFIVLDEADEMLRMGFIDDVETVMAELPENHQTALFSATMPEPIRRITKRFMNDPQEVKIKVNNENAPDIEQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQENIAAAMLMLLQGKQKLILPPDPPMEKRRRERNDRGDRRENPRSAERRGECKGYGNPQPMDLYRIEVGRADGVEVRHIVGAIANEGDINSRYIGHIKLYDDYTTVELPQGMPKELLQQFGKTRVLNKQMQMSFLGAVKSDNSRGSDDFNGKRKGRGGDFRGERGRERGNDNRGNRKFNEKSNRTFSDKPRRDRRSSF

SEQ ID NO: 5424 - protein, 417 aa, Escherichia coli
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 5425 - protein, 149 aa, Cordyceps bassiana
RVVIHKEDGALRFEHPTQPALMPGGWMERVKAAGGNLINGFWGEKTAAEEEQVPTEPEKEICMTNPKVDRIISLEELKAHEGETEPWFVVNGHVYNGTPYLEDHPGGATSIINAAAQDATEEFMTIRMFSCSLSSHARRLTRIQIAKMP

SEQ ID NO: 5426 - protein, 390 aa, Triticum aestivum
  misc_feature (162)..(162): Xaa can be any naturally occurring amino acid
  misc_feature (169)..(169): Xaa can be any naturally occurring amino acid
MALQLLPSTLSVPKKGSSMGAVAVKDTAAFLGVSSKAKKASLAVRTQVATAPSPVTTSPGSAAAKPSGKKTLRQGVVVITGASSGLGLASAKALAETGKWHVVMACRDFLKASKAAKAAGMADGSYTIMHLDLASLDSVRQFVDAFRRAEMPLDVLVCNAAXIYRPTAXRTPTFTADGHEMSVGVNHLGHFLLARLLMEDLQKSDYPSRRMVIVGSITGNSNTLAGNVPPKASLGDLRGLAGGLSGTSGSAMIDGDESFDGAKAYKDSKVCNMLTMQEFHRRYHEETGITFSSLYPGCIATTGLFREHIPLFRTLFPPFQKFITKGFVSEAESGKRLAQVVAEPSLTKSGVYWSWNKDSASFENQLSQEASDPEKARKVWELSEKLVGLA

SEQ ID NO: 5427 - protein, 263 aa, Thermosynechococcus elongatus
MAVLSLAQMLEAGVHFGHQARRWNPRMAPYIFTVRNGVHIIDLVQTAQLVEEAYNYIRNAAEKGKRFLFIGTKRQAAGIVEQEALRCGSYYVNQRWLGGMLTNWTTIKTRVDRLKELESMEESGLIDLRPKQEASALRRELARLQKYLGGIKQMRRLPDIAIIVDVKREYNAVAECHKLGIPIVALLDTNCDPTQVDIPIPANDDAIRSIKLIVGKLADAIYEGRHGQLEEPEADLADEDDNGMTTSDDGDAEALDIPDDSDA

SEQ ID NO: 5428 - protein, 79 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (48)..(48): Xaa can be any naturally occurring amino acid
  misc_feature (50)..(51): Xaa can be any naturally occurring amino acid
  misc_feature (58)..(58): Xaa can be any naturally occurring amino acid
  misc_feature (60)..(60): Xaa can be any naturally occurring amino acid
  misc_feature (63)..(63): Xaa can be any naturally occurring amino acid
MAYSMLSSAXXXTSPXQXTMDAPFTGXLKPSSAFPVTRKVNNDITSIXSXXGRVSCMXVXPPXGKNKFETLSYLPDLTE

SEQ ID NO: 5429 - protein, 161 aa, Oryza glumipatula
MEELEGHRGAGRLPPPPPLLPFPKVSVQVYTVPSSSTSASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 5430 - protein, 149 aa, Cordyceps bassiana
RVVIHKEDGALRFEHPTQPALMPGGWMERVKAAGGNLTNGFWGEKTAAEEEQVLAEPEKEICMTNPKVDRIISLEELKAHEGETEPWFVVNGHVYDGTPYLDNHPGGATSIINAAAQDATEEFMTIRTFPSSLNSHARRLTHIQIAKMP

SEQ ID NO: 5431 - protein, 584 aa, Gloeobacter violaceus
MQQTIQKRLTVQSGAVAPETVAMRCLDWDRDRFDIEFGLQNGTTYNSYLIEGEQVALVDTSHEKFRSLYLDLLKGHIDPKRIDYLVISHTEPDHSGLVADVLALAPQATVVASRMALQFLANMVHRRFPQRAVKSGDTLDLGGGHVLEFVSAPNLHWPDTMFTFDRGTGVLYTCDAFGMHYCNERMFDEDLSAIEPDYRFYYECLMAPNARSVLTALKRMEPLGEITAIATGHGPMLKLHLGELVDRYRRWSQEQSEATTSVAVFYVSDYGYSDRLSQAIAQGITKSHVATELVDLRATPLAEIQEIVRQSAGVVIGTPPTAGPAAQATQAALGVILANVKEKQAFGIYEACGGFDEPAFPLSSRFADLGLVRAFAPIRIPGREGALAEAEATGTPTPALYKLCEESGTDLAQWLTRDRTVQQMKAVAVGLDKAMGRLSGGLYVLTAAKGELKGAMLASWVNQASFAPLGVTIAVAKDRAIEALMQVGDLFALNVLEEGKYAPLMRHFLKRFAPGEDRFVGVETLTGTGGTPILADALAYMECRVASRMECSDHWLVYGVVEDGRVSNLEGLTAVHHRKVGNHY

SEQ ID NO: 5432 - protein, 154 aa, Candida albicans
MSADHTRDPCPIVILNDFGGAFAMGVIGGCVWHGIKGFRNSPYGERSYGALSAIKARAPVVGGNFGVWGGLFSTFDCTVKAVRKREDAWNAVIAGFFTGGALAIRGGWKHTRNSAITCACLLGVFEGVGMMMQRLQAQPTMAPVYPEEPTALAA

SEQ ID NO: 5433 - protein, 579 aa, Gloeobacter violaceus
MTPAQTPVRDIQTVAVAPDTWALRSRSFVRLKFEVEYARQRGTTSNAFLFQGPDRTVLLSPPGETFTALFLAELERLIALEQIHAVVLGHINPNRAKTLIALLARAPRLEIICSNPGAIALRPLLEGEAADLQTQIRIVRGQEVLELGGDRRLQCIPAPTPRWPDGLCLFDQKHSALYTDKFFAAHVADDALFDESGTATGEDARYFYDCLMASQARQVEAVLDRLAEWPARVIAPVHGPLLRSGGLDLISHYRRWNRAQIEKTLTVALLYASAYGSTATLAQALAHGITKAGVGVETINCEFATPEEIREVVSRADGFVIGSPTLGGHAPTQIQTALGIVLATAPKSQLTGVFGSFGWSGEAIDLLEGKLRNAGYSFGFETIRVKFKPNAGTLQECEEAGTDFAQTLKKTRKARQGRAPAASTPVEQAAGRIVGSLCVVTARREEVSSAMLASWVTQATFNPPGLTVAVAKERAIESLLYPGDAFVLNILEDGQHLPLMKHFLKPFAPGQDRFAGVATRAAANGSPILSEALAYLECRVEGRMDCGDHWLVYCVAEGGDVLNPNGKTAVHFRSTGTHY

SEQ ID NO: 5434 - protein, 371 aa, Oryza sativa
MAKPGLNDKLRHSGIIDIHFRREGSNPVYFAVLVKYEDLDGDVVQVDLMESKSAYGGAIEVWTPMRESWGSASAATPARPFVTNNLCGVLGGVLAMEMVIVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 5435 - protein, 332 aa, Rubrobacter xylanophilus
MSEQYDVVVVGSGPAGYTAALYAARANLRTLVFQGFEAGGQLMLTTDVENYPGYPEGVTGPEMMEDFERQAARFGAEMRPDNVDRVDFSGRPFRLWAEGQEEPVLARAVIVATGAKARWLGLPGEQRLMGRGVSGCATCDGFFFKDKRVAVVGGGDTAMEEALFLSRYASEVVIIHRRDEFRASKIMLGRARKNPKISFITDTVVTDVLGEDAVEGLSLRNVKTGEESTLEVEGFFVAIGHDPATEIFRGQLEMDEGGYLLQKEHTMTSVPGVFAAGDVADRRYRQAVTAAGDGCRAAIDAERWLEEQGEAQEAEDPGVWTAGKDRSPAGSG

SEQ ID NO: 5436 - protein, 149 aa, Cordyceps brongniartii
RVVIHKEDGALRFEHPTQPALMPGGWMERVKAAGGNLTNGFWGEKTAAEEEQVPAEPEKEICMTNPKVDHIISLEELKAHEGETEPWFVVNGHVYDGTPYLDDHPGGATSIINAAAQDATEEFMTIRTFLSSLNSHARRLTHIRIAKMP

SEQ ID NO: 5437 - protein, 131 aa, Chromobacterium violaceum
MSVFSVEFKVRDYECDMQGIVNNGVYFNYLEHARHEFLLAKGIDFAQLARDKINLVVVRSEMDYKASLTSGDRFAVTVAFEPVSRVRFGFRQQVVREADGKVVLDGLVIGTAINERGRPAIPEGFAERLTA

SEQ ID NO: 5438 - protein, 357 aa, Thermosynechococcus elongatus
MTSSSTSFSLHGGNSFLRNIWYYGLPAADLKPGRCQAKVLLGEPILFCRTTSGKPFALRNLCPHRGMPLHYGRFDGKEVECPYHGWRFNAHGHCTLIPSLTSDSDVDLKNFGVLSYPVREVQGNLWIFFPANGRNVSEPTLEVPLVPGFSAETQPQAVQKFIFPGHLDQVFINFMDPSHAPFVHGAWWWRKRGKLFEKAKTFDPSPYGFTMRRHPLLRKSWAHHLLGGHPEVEIIYRLPGIRIETNYSDRHTFCFLITLTPINDQETELTATYYWTFPWLAPLKPLLAPLAREFLNQDLRIVAKQSEGLKYKPPLTLIKEADYQAKWYYQLKREYEKATQEEREFVNPLKTQVLRWR

SEQ ID NO: 5439 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPDVNDFFGGDLQGIVDKLDYLEDLGVNGIYLTPIFSAPSNHKYDTLDYFSIDPHFGDPELFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLNGENDPLCRKCMVWEKEKQNQDMLQFMKRLIALRKQENTLLTEGHLEWNLLDDKNDFISFSRTLDEKILIYFFNQGNVVQHVSLRELNIDRNKKICDAWTEQPLQHHDVIAVQPGEFLILSAAAPV

SEQ ID NO: 5440 - protein, 343 aa, Oryza sativa
MAKPGLNDKLRHSGIIDIHFRHHLESTLTTNPFDSPSTRTCSVLDEEPAPWHDRLDGLGGVMVPACSTTTGKERGAGGIEQDEILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRTLQRSDVEAVIKKTDIFDFLVDIITDDKMKDDGMGFQAASMVSPYTSGGMGFSFDLYPNQHHLAYMWPPQEQQEQWPPQEQQEQKQKQDSDGGGQDE

SEQ ID NO: 5441 - protein, 150 aa, Glycine max
  misc_feature (129)..(129): Xaa can be any naturally occurring amino acid
  misc_feature (142)..(142): Xaa can be any naturally occurring amino acid
  misc_feature (146)..(146): Xaa can be any naturally occurring amino acid
MSDGGKRQGGRALPPPPRGPPPPPPSRPRLEPVDREKTCPLLLRVFTKIGSHHSMEDFAVRGKEPKDEVQIYTWKDATLRELTDLVKEVAPAARRRNAKLSFAFVFPDKNGRFKVQEVGKTLSYGNGRXDDGKGLTELGFEXGDYXGFMT

SEQ ID NO: 5442 - protein, 571 aa, Unknown
  Candidatus Desulfococcus oleovorans Hxd3
MSRRIVVVGGVALGSKAACRAKRVDPEADVYLIDRDEYISYGGCGIPFYISGDVSDVSELRSTSFHMLRDERFFLKDKGVVALTGTEVTRIDRQGKTVAIRRKDGTTDTLAYDKLVLATGTTPRMLPLPGRDLENVFTVANLHDALAIKEKVTEGSIGKAVVVGGGFIGLEMAEALADMWEIETSIVEVFDQIMPGFVSPSLATMARKTIEDKGVRVYTSEKVEALVGEGAVSAVKTDKRTLDADMVIMAVGVVPNTGLAKEAGLEVTPQGWIVVNDQMQTSDPDIYSGGDCAAVKNLVTGELGYFPLGSMANRQGRVIGTNVTGGSARFDGAVGSFVVKIFDNALAGAGLTADRASAAGFDAVGIQVAQFDRAHFYIEKEVIFLELVVDEKTRRVLGIQGFGGKDSGMVARINAVAPLLKYKPGVEEISNLELAYSPPFASAMDIINALGNAASNYLDGRYRPMTMEAFAACWENRSCGDTFFLDCRANADAQPFADKYPEIWKSIPHDQLVDRMDEVPKGKKLVLLCNTGVRSYEAQLNLNAKGITDNVSAGAGIAGLKTWGVDFGLDK

SEQ ID NO: 5443 - protein, 308 aa, Bacteroides thetaiotaomicron
MSVEPGKWGVIYNPKAGTRKVQKRWKEIKEYMDSKGVNYDYVQSEGFGSVERLAKILANNGYRTIVIVGGDGALNDAINGIMLSDAEDKENIALGMIPNGIGNDFAKYWGLSTEYKPAVDCIINHRLKKIDVGFCNFYDGKEHQRRYFLNAVNIGLGARIVKITDQTKRFWGVKFLSYVAALFSLIFERKLYRMHLRINDEHIRGRIMTVCVGSAWGWGQTPSAVPYNGWLDVSVIYRPEFLQIISGLWMLIQGRILNHKMVKSYRTRKVKVLRAQNASVDLDGRLLARHFPLEIGVLSEKTTLIIPN

SEQ ID NO: 5444 - protein, 487 aa, Solanum pimpinellifolium
  misc_feature (96)..(96): Xaa can be any naturally occurring amino acid
MMMVSRKVVSSLQFFTLFYLFTVAFASTEEATALLKWKATFKNQNNSFLASWIPSSNACKDWDGVVCFNGRVNTLNITNASVIGTLYAFPFSSLPXLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSSLYLYNNQLSGSIPEEIGYLSSLTELHLGNNSLNGSIPASLGNLNNLSSLDVH

SEQ ID NO: 5445 - protein, 487 aa, Solanum pimpinellifolium
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSSLYLYNNQLSGSIPEEIGYLSSLTELHLGNNSLNGSIPASLGNLNNLSSLDVH

SEQ ID NO: 5446 - protein, 251 aa, Cyanidium caldarium
MTHNKTIKKVYIVGAGPGDPELLTLKAQRVLREADVVIYDALVNPEILQHCKPNAEIIKVGKRRNNHSFSQLQIASLLIDRAKKGERVIRLKGGDPLIFGRLGEEILELFSKNIEIEIIPGITSAFAVAADMKFPLTHRQLGSSITFLTGEEFYEKTTNKLKWERIIWGADTIIVYMILYNLPKIIKKFLSVGYSAEKPIVLVQWASLKKKNFLIGTIGTIIHQVIESKFGPPSLAIIGEVIEISSIIQKL

SEQ ID NO: 5447 - protein, 354 aa, Picrorhiza kurrooa
MAAMAATLTSSLTKSSFLDTKSSIYGSPLSSRATIQRVKSSPQNLSVTMSAATPAYDLDNLTFAPIKESIVSREMTRRYMMDMITYADTDVVVVGAGSAGLSCAYELSKNPNINIAIIEQSVSPGGGAWLGSQLFSAMVVRKPAPKFLDELEIAYDEQDDYVVIKHAALFTSTIMSKLLARPNVKLFNAVAAEDLIVKGGRVAGVVTNWALVSMNHDTQSCMDPNVMESKIVVSSCGHDGPFGATGVKRLRSIGMIDSVPGMKALDMNTAEDAIVRLAREIVPGMIVTGMEVAEIDGSPRMGPTFGAMMISGQKAAHLALKALGQPNALDDSYDGLKAEEFVLAAADAGDIVDA

SEQ ID NO: 5448 - protein, 487 aa, Solanum pimpinellifolium
  misc_feature (371)..(371): Xaa can be any naturally occurring amino acid
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSXNGFIPASFGNMSNLAFLFLYENQLASSVPEEIGYLRSLNVLDLSENALNGSIPASLGNLNNLSSLYLYNNQLSGSIPEEIGYLSSLTELHLGNNSLNGSIPASLGNLNNLSSLDVH

SEQ ID NO: 5449 - protein, 237 aa, Cyanidium caldarium
MNRIRFISLILNLDSCDSNIQEYSRLAYVHDLNKLMDENFVSLLLIILKLAKNSKRLQPTYHNVYLFNLLKSYALSEIDGYVLGHFSRGFVNTLMHYKNAQYETLESLLSANNFFEANKFTQQILLELAGEQSKQRNWMYFTDVHSINHQSVSDLNHLWELYSQGNFGFSIQKRIWISVNKNWKKFWKKIGWINSNSKWLKYPGEFMWAVNAPPGHLPLFNQLRGVYVLEFIFDYYL

SEQ ID NO: 5450 - protein, 540 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRVVLGQQDGCQWRKCLELASIICKLGIRYRLWRDAIERGVDRLPFSNQSESGS

SEQ ID NO: 5451 - protein, 257 aa, Burkholderia mallei
MGKVYLIGAGPGAADLITVRGARLLEQADVVLHDALVEPAMLDYAPRARRIAVGKRCGQRSSAQHFINKQLVDAAREHAVVVRLKGGDPMLFGRADEEMRALEAAGIDYEVVPGITAALASAAALKRSLTLRGVARSVAFATKSRAPGSDEIREQVSADSLVYYMGRDNAPGIARQLIDAGRAGATPVAIVEACSTPRERMLTLTLADMAAGAAQAWLDPAQPSLLMIGDAFAERAPRLADEPPGDAGGKRGMRDAA

SEQ ID NO: 5452 - protein, 399 aa, Pyrococcus abyssi
MNIMSGDEVQFHENYDDYITYLKRRIRQLELQVRMLEADKERLERELSRLRSEMSRLRQPPAFAGTVIEVLDDDRAIVQNYNGPRFVVRIAPWIERDKLRPGARVALDQRTMAIIELLPSSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKNVDLRVIAEITEGASGADLKAIATEAGMFAIRERRTYVTQEDFLKAVDKVLGNERKLLQQITSHEIIYG

SEQ ID NO: 5453 - protein, 364 aa, Solanum lycopersicum
MIFQATIQNSYDKMSDLIAFDDTKAGVKGLVDSGINKVPQVFILPPKYRVKTCETHISFPVIDLKGIDEDPIKYKEIVDKVRDASETWGFFQVVNHGIPTSILEKTLLGTRQFFEQDTEIKKQYYTRDIGEKVIYTSNLDLYSPSVPAASWRDSIFFFMAPNPPSPQEFPTACGEILMDYSKYVTELGFSLLELLSEGLGLDRSYLKDYMDYCHQSCLCHYYPSCPQPELTMGISQHSDTEFITVLLQDDIGGLQVLHQNQWFDVPPIRGALVVNIGDFLQLMSNDKYMSVEHRAIAKKDGSRMSVACFFGENPLQSSKLYEPITELLSEDNPPKYHATTVIDYKNYVLNKGLDGTSALLSYKI

SEQ ID NO: 5454 - protein, 135 aa, Yersinia pestis
MRLLHTMLRVGDLQRSIDFYTKVLGMRLLRTSENTEYKYSLAFVGYSDESKGSVIELTYNWGVDQYDMGTAFGHLALGVDDVAATCDQIRQAGGKVTREAGPVKGGNTIIAFVEDPDGYKIELIENKSAGDCLGN

SEQ ID NO: 5455 - protein, 963 aa, Bordetella pertussis
MAQALPTMDRRTFLRRSGLGVGAGLAATQLSLVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKDRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMHQLAEKLGFGKELSKNYKMQKVKGMDEPVVEDILREINASVWAIGYTGQSPERLKAHMRNMHVFDVKTLRAKGGKDAETGYDLTGDYFGLPWPCWGNPSLKHPGTANLYDTSLHVMDGSGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 5456 - protein, 250 aa, Acanthus ebracteatus
MVKNYPVVSEEYLIAVDKAKKKLRGFIAEKNCAPLMLRLAWHSAGTFDQCSRTGGPFGTMRFKAEQAHSANNGIDIAIRLLEPIKEQFPILSYADFYQLAGVVAVEVTGGPEVPFHPGRPDKEEPPVEGRLPDAYKGSDHLRDVFIKQMGLSDQDIVALSGGHTLGRCHKERSGFEGPWTENPLIFDNSYFKELVCGERDGLLQLPSDKALLADPVFHPLVEKYAADEDAFFADYAEAHLKLSELGFADA

SEQ ID NO: 5457 - protein, 490 aa, Schizosaccharomyces pombe
MSPKQEEYEVERIVDEKLDRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 5458 - protein, 844 aa, Candida albicans
MSNNNFQESSNNTSSPSKRSTPMLFLDAENKTQEALTTFELLNACTYQNKYVGSANVTTTATTSTKTSNSTSTKSHQQQHRRKLEYMTCDCEEEWDSELQMNLACGPDSNCINRITCVECVNRNCLCGDDCQNQRFQNRQYSKVKVIQTELKGYGLIAEQDIEENQFIYEYIGEVIDEISFRQRMIEYDLRHLKHFYFMMLSNDSFIDATEKGSLGRFINHSCNPNAFVDKWHVGDRLRMGIFAKRKISRGEEITFDYNVDRYGAQSQPCYCGEPNCIKFMGGKTQTDAALLLPQMIAEALGVTPRQEKAWLKENKSIRNQQQNDESNINEEFVNSIEIEPIENQDGVTKVMSALMKTQHPLIIKKLIERIFLSNDQDDINVMFVRFHGYKTISTILQDLLVAKNSGKESETTDNNDIDNSTGDDDQDKDELIIKILKILVSWPAVTKNKIASANLEEVVKDIQTNNENSNNNDEINQLCTSLLDRWSKLEMAYRIPKQESVPTNNAAAAATTTATATGTTTSASPFERISSHTPEVGGTNTPSSTSQQQQQQNSRDAGLPENWRSAFDKNTGGYYYYNLVTKETTWERPLGSLPLGPKPPSGPGLKGRINKYNEIDLAKREELRIQKEKEMKFIEMQNRDRKLKELIEMSKKSMNNIGGSSGTTITAATINGLSDNGGNNNGNITGIYGDDKHSKHHHHHHDKHLKNGPRNTSTSSSSGNNVEKIWKRIFAKYIPNIIKKYESEIGRDNVKGCAKELVNILTQSEIKHGNSLPSSSSSNGYSMELSDKKLKKIKEYSHGYMDKFLIKFNNSKKHKSTMGSKGSDNHKRKHNGDGDNGVKRSKV

SEQ ID NO: 5459 - protein, 355 aa, Escherichia coli
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGITGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 5460 - protein, 233 aa, Bacillus anthracis
MSVISMKQLLEAGVHFGHQTRRWNPKMKRYIFTERNGIYIIDLQKTVKKVEEAFKVMRDIAAEGGDILFVGTKKQAQEAIKEEATRAGMYFVNQRWLGGTLTNFQTIQKRIKRLKDIERMQEDGTFEVLPKKEVVQLKKELERLEKFLGGIKDMKGLPSALFVVDPRKERIAVAEARKLHIPIIGIVDTNCDPDEIDHVIPANDDAIRAVKLLTSKMADAILEAKQGEETVTA

SEQ ID NO: 5461 - protein, 298 aa, Oryza sativa
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRILDSIYIVFRLTCKPPFVFKYAILDLLSVYYPVNALRNL

SEQ ID NO: 5462 - protein, 225 aa, Zea mays
GADDLKVLGLWTSPFVIRVRIVLNLKGLAYEYVEDDLGNKSALLLSSNPVHKTVPVLLHAGRPVNESQIILQYIDEVWAGTGPAVLPRDPYERAAARFWAAYIDDKVKSAWLGMLFECRDEGERAEAVARAGEALGTLEGALRGKPFFGGDGVGFVDAVLGGYLGWFGAVGRIIGRRLIDPTKTPLLAAWEDRFRAADVAKGVVPDDVDKMLAFLETLLANYYSK

SEQ ID NO: 5463 - protein, 225 aa, Unknown
  Rhodococcus sp. 4N4
GGNKLRKLEYIVPDALAQGADTLVSIGGVQSNHTRQVAAVAAKLGLKAVLVQEKWVDWPDSVNDKVGNILLSRIMGADVRLDPSGFGIEFKDSWQKAIEDVERAGGKPYAIPAGGSDHKLGGLGFANWAYEVQKQEEELGVFFDTIVVCSVTGSTHAGMIAGFAGQERPRRVIGIDASAKIAQTRDQVARIARNTAELIELGRELRDDEITVLESWAGDYYGISV

SEQ ID NO: 5464 - protein, 504 aa, Zea mays
VGGAQQFVDRSKVRILLCDGDATSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFNDNFELVLSEPSDANTNSTTLLSDETDDRPKGNTNQETGTSKQLEYESNPSVAEPDQREKMEGVPGSALDASKKSSPRRAFSRPIKTNLRVAESSAFLAYVKPSTPATSSFDSELQRGGSRLDSLDNQGNCSSATDRSDTGTDVNIRSKEAFEMPAQYPMVWFSSSNMHMERSSEGHNDTSGTPPAYHFPFYYPGMVEHNMALSSAQDFQANINNAQAHTPPAMLPQYNVYPQCHGLPVIPSFQFNPSGMSTHSSHLPTQNVWSSASSTPPVPEETCSRSERRAAALAKFRLKRKERCFDKKVRYVNRKKLAETRPRVRGQFVRQPTNTDVISIGDDISEDEDDDPSSREVDMVSSPE

SEQ ID NO: 5465 - protein, 487 aa, Solanum pimpinellifolium
MMMVSRKVVSSLQFFTLFYLFIVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSSLYLYNNQLSGSIPEEIGYLSSLTELHLGNNSLNGSIPASLGNLNNLSSLDVH

SEQ ID NO: 5466 - protein, 332 aa, Vibrio fischeri
MSTAIYMLFGVTAGLSMWISNTATTAMMLPLVLGVLNKVNSKSGHNTYVFVLLGIAYCASIGGISTIVGSPPNAIAAAEVGLSFTEWMAFGVPVTLVLLPTTVALLYFMLKPNLNEVFELNQEPIAWDKGKVVTLMIFALTVTLWIFSKPINAMLGGFSKFDTIVALMAIILVGFARVVQWKDIEKTTDWGVLLLFGGGICLSNILKATGTSTFLAHSLSDILSQAGILFTILTVAAFVVFLTEFASNTASAALLIPVFASVAEALGISPVVLSAMIAISASCAFMLPVATPPNAIVFGSGHIKQSEMMRVGIYLNLVCVVVLTGFAAIFWA

SEQ ID NO: 5467 - protein, 334 aa, Chromobacterium violaceum
MKLAILGAGAWGSALAIAFARHHQVTLWARDAEQIRQLGEERVNRRYLPDCPFPEQLKLSSDLAEAAHDAELVLIVTPMAGLRPTLKALTALDAPLPPILWACKGFEAGSSLLPHQVAEEELPADHLYGALSGPSFAREVAQGLPAAVTIASDHAEFAASVARELHSPLLRLYANDDLVGVEVGGAVKNVMAIATGVADGLDFGMNARAALITRGLAEITRLAMALGASPQTMMGLSGMGDLILTCTGALSRNRQVGLKLAEGKPLQQVLEELGHVAEGVATAREVLTMAERLQVDMPITAAVCGLLYQGHDPQQVVDGLLRRSPKSESGGLLD

SEQ ID NO: 5468 - protein, 517 aa, Unknown
  Acidovorax sp. JS42
MHTASQALAIERQASAQPSLAERVSRPKTRAILGLMRLNFLSVIRDTESFVYCYSWDKELLQEMHITTRYVTQPQILSYLEHVADRHNLRPDIQLNTGITAAHFNEATNLWEVKTDTGEAYTAKFLVTALGLLSATNVPKIKGLDTFQGEWLHTGNWPDDVQYAGKRVGVIGTGSTGTQVITAIAPKVEHLTVFQRSPQYSVPVGNGPVTPEYVAEVKKNYDEIWDQVMGSVVAFGFKESTVSAMSVSEEERQAVFQKAWDNGGGFRFMFETFCDIATDERANKAAQDFIRSKIAEIVKDPETARKLMPQDLYAKRPLCDSGYYATYNRPNVDLVDVKANPIVEITPKGVKTTDGVEHELDMLIFATGFDAVDGNYTKIDIRGRNGLTIQEQWKSGPSSYMGVANANFPNMFMVLGPNGPFTNLPPSIESQVEWIAALIKDVNAKDLKTVEATTAAEAGWTKTCQDIANMTLFPKADSWIFGANIPGKTNTVYFWLNRDSSGNGSCLMGSMEPRVTG

SEQ ID NO: 5469 - protein, 487 aa, Solanum pimpinellifolium
  misc_feature (373)..(373): Xaa can be any naturally occurring amino acid
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINXFIPASFGNMSNLAFLFLYENQLASSVPEEIGYLRSLNVLDLSENALNGSIPASLGNLNNLSSLYLYNNQLSGSIPEEIGYLSSLTELHLGNNSLNGSIPASLGNLNNLSSLDVH

SEQ ID NO: 5470 - protein, 182 aa, Burkholderia vietnamiensis
MPSRCVRRVASGRAATRVDRRHAARGAVPTSRGAARITAIDRPIIASHRALLAGRARRPSERLESRHPPATVPLPGTAPTNAQPSRSFTLSGGIGLAKEELLELDGIVDEVLPDSKYRVTLENGVVVGAYASGRMRKNHIRILAGDRVTLELSVYDLTKGRINFRHKDANSPRPPRAGQARR

SEQ ID NO: 5471 - protein, 487 aa, Solanum pimpinellifolium
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNKISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSRLYLYNNQLSGSIPEEIGYLSSLTELHLGNNSLNGSIPASLGNLNNLSSLDVH

SEQ ID NO: 5472 - protein, 487 aa, Solanum pimpinellifolium
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSRLYLYNNQLSGSIPEEIGYLSSLTELHLGNNSLNGSIPASLGNLNNLSSLDVH

SEQ ID NO: 5473 - protein, 316 aa, Bacteroides thetaiotaomicron
MAEIEKVKCLIIGSGPAGYTAAIYAGRANLCPVLYEGLQPGGQLTTTTDVENFPGYPEGISGPQLMEDLRAQASRFGTDVRFGIATAADLSKAPYQITIDGDKVIETEALIISTGATAKYLGLEDEKKYAGMGVSACATCDGFFYRKKVVAVVGGGDTACEEAIYLAGLASKVYLVVRKPYLRASKIMQERVQKHEKIEVLFEHNVVGLFGDNGVEGMNVVKRWGESDEERYSLPIDGFFLAIGHKPNSDIFKEYIDTDEVGYIITDGDSPRTKVPGVFAAGDVADPHYRQAITAAGSGCKAAIEAERYLSAKGII

SEQ ID NO: 5474 - protein, 602 aa, Listeria monocytogenes
MDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAALSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYILGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKIAADHTTDIVLLRDIVQQLQAYKTDENTVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQHYFEKGTITRKEMKVYRDNLLAIEANMQLEF

SEQ ID NO: 5475 - protein, 136 aa, Unknown
  Burkholderia sp. 383
MTDVNDDAPSQPTAFELVGGEARVREMVDRFYDLMDLEPEFAQIRALHPDSLDGSRDKFFWFLCGWLGGPDHYISRFGHPRLRARHLPFPIASVERDQWLRCMAWAMDDIGLPEPLRERLMHSFYDTADWMRNRPG

SEQ ID NO: 5476 - protein, 279 aa, Pyrococcus abyssi
MEFIEWYPRGYGVAFKVKEKIFEGHSKFQKIEVYETEGFGRLLALDGTVQLVTEGEESYHESLVHPVMLAHPNPRRVLVIGGGDGGTIREVLRHEEVEEAIMVEIDEEVIEVAIKFIGIDGGLLDKMMKGECKRAKLIIGDGVEFIKENSGFDVVIVDSTDPVGPAKMLFSREFYERAYEALNDPGIYVTQAGSVYLFTDELVTAYENMSRVFDKVYAYSFPVIGYASPWAFLVGIKGDLDFRKIDLERAKKLNLKYYDPENHETIFQMPRYVREMLKP

SEQ ID NO: 5477 - protein, 568 aa, Solanum tuberosum
  misc_feature (471)..(471): Xaa can be any naturally occurring amino acid
MASSALISDTESWKDLRAHVEEINKTHLRDLMNNTNRCQSMMVEFDGILIDYSRQRATFDTLNKLFSLAEAARVKEKIIRMFNGEHINSTENRSVLHVALRAPRDAVINSDGKNVVPEVWHVLDKIRDFSERVRSGAWVGATGKTLKDVVAVGIGGSFLGPLFVHTALQTEAEASECARGRQLRFLANVDPIDVARNITGLNPETTLVVVVSKTFTTAETMLNARTMREWISSALGPQAVAKHMVAVSTNLKLVEQFGIDPNNAFAFWDWVGGRYSVCSAVGVLPLSLQYGFSIVEKFLKGASSVDQHFLSAPFEKNIPVLLGLLSVWNVSFLGYPARAILPYSQALEKLAPHIQQVSMESNGKGVSIDGVPLPYQTGEIDFGEPGTNGQHSFYQLIHQGRVIPCDFIGVVKSQQPIYLKDEVVNNHDELMSNFFAQPDALAYGKTPEQLQKENIPEHLVSHKTFSGNRPXLSILLPSLNAYNIGQLLAIYEHRVAVQGFVWCINSFDQWGVELGKSLATQVRKQLHASRKKGESVEGFNFSTKTLITRYLEASADVPSDPSTLLPNI

SEQ ID NO: 5478 - protein, 403 aa, Candida albicans
MYTTANNRLTQLTQILSPIVNDADSSFAQYLLQNPTFAPNPESSLNPEKPFKIAVVGSGNWGTTIAKIVAENALARPHLFSHYVNMWVFEEKINGENLTQIINQRHENIKYLPGVKLPNNLIAQPDIVTAVKGADLIIFNLPHQFLPKILKQLKGNVPKTTRAISCLKGLEVSKDGCKLLSTYITEELGIVCGALSGANLAPEIARGKWSETTVAYKLPNDYRGAGKDIDKLVLKACFHRPYFHVNVIEDVAGVSVAGALKNIVALAVGFVEGLGWGDNAKAAIMRVGLLETIKFSETFFPQSQADTFTAESAGVADLITTCAGGRNVKVGRYMAETGVSAEEAEKKLLNGQSSQGIVTAKEVHELLTYVNKLEEFPLFEATYQIAFGSESIENLPNLLNTTA

SEQ ID NO: 5479 - protein, 617 aa, Solanum lycopersicum
  misc_feature (84)..(84): Xaa can be any naturally occurring amino acid
  misc_feature (189)..(189): Xaa can be any naturally occurring amino acid
MASSSLSSIYSPSSSFKSEVKSIHKITSSQLGSIYLPNKSRFHVHAVAREVSASLSAGNNDVVHKLKKENVGLEKNPNALWKRXVEWLYQHKELGLYLDISRVGFSDGFLEEMEPRLQKAFKDMVDLEKGAIANPDEGRMVGHYWLRSPHLAPNSFLRLQIENTLEAVCEFANDVVSGKVKTPSGGRFXQILSVGIGGSALGPQFVAEALAPDNPPLKIRFIDNTDPAGIDHQIAQLGPELASTLVIVISKSGGTPETRNGLLEVQKAFREAGLIFAKQGVAITQENSLLDNTARIEGWLARFPMFDWVGGRTSEMSAVGLLPAALQGIDIREMLAGAALMDEANRTTVVRDNPAALLALCWYWATDGVGSKDMVVLPYKDSLLLFSRYLQQLVMESLGKEFDLDGNRVNQGISVYGNKGSTDQHAYIQQLREGVHNFFATFIEVLRDRPPGHDWELEPGVTCGDYLFGMLQGTRSALYSNDRESITVTVQEVTPRSVGALVALYERAVGIYASLVNINAYHQPGVEAGKKAAGEVLALQKRVLQVLNEASCKQPVEPLTLDEIAERCHCEDDIEMIYKIIAHMAANDRALIAEGNCGTPHSIKVYLGECNVDDLYA

SEQ ID NO: 5480 - protein, 446 aa, Unknown
  Synechococcus sp. WH 5701
MNRSQRTSLITSSDPPPSDAAVLRVPVVVIGAGQAGLSVASCLQQQGLTPVVLERHRVAHSWQHQRWDSFCLVTPNWQCRLPEFPYDGDDPEGFMGRDAIVDYLRRFAYHAAVPVREGIAVERLQPLETGGYRLSTSDGVIETPQVVIATGAYHRPRRHPLAARLPARLLQLDARDYRRPDQLPDGPVLVVGSGQSGCQIAEDLFLAGRRVHLSVGSAPRSPRRYRGKDVVDWLDRMSYYDTPIEQHPDPRSVRRKTNHYLTGRDGGREIDLRRRALEGMVLHGRLEEISVSGFRFAPDLAANLDGADAVYRRIRASIDTYIESNGLEAPEDPAYEPCWQPPPQDPPLDLGDEPLAAVIWCTGYRSDFRWVEVPIFDGAGEPVHQRGVTPAAGLYVLGLPWLHTWGSGRFCGVGSDAAYLAGLIRRQVDRRDANQERLECTALLGS

SEQ ID NO: 5481 - protein, 350 aa, Schizosaccharomyces pombe
MTCRIAIRKYSFILCLAVGSVTIYTSEVIGTPLYFVNKELYNKYIAFTKSFAGILFTALVQLFSPTPVTLTYDPELRNLFYLDRNGCLETIAAERNIVIANHQLYSDWMYVWWLSYTAKQHGHVYIMLKNSLKWLPVIGWGMQLFRFIFLSRKWDKDYETMSRHFKFIRNVRDSVSLILFPEGTNLVESTYQRSRVYADKIGVKMPKHLMLPRVRGLFYSISQLRDSMTYLYDYTFYFSDPSPKKYAADAFSLPKLFFEGVPIKRLHIHVRRFPISEIPTEEDQFTDWLYQRWYEKDKLIDTLLETGNFPGPKKLHTTVRLKHRLEILSLFSVLFTCIVAGLFLKLFISH

SEQ ID NO: 5482 - protein, 553 aa, Unknown
  Synechococcus sp. WH 5701
MSIEKDHWWNGCVIYQLMPRSFADANGDGIGDLDGITSQLPYLQWLGVDAIWLTPIYPSPLRDGGYDITDFTAIHPDLGNLDDLARLLDQAHRHGIRVLLDLVLNHTSVLHPWFQRARWSPAGSSERDFYVWRDDDRGYPEAQVLFRHFESSNWQWDSVARQYYLHRFLHHQPDLNYDNPAVAEAMLEVVDFWVERGVDGFRLDAVPFLHEREGTRCEGLPETHAFLKRLRARVDSSGRDLLLIAEAIQPVKESAPYLADDELHAAFDFALTAQLFAAVARGRCDKLRNCLQHAQEMVPGCRWALPLRNHDELWLGDGHLVEDEVVQAVMTGFPEAREHWLNWGINRRLAPLLNGDPRPNTLLHGLLYSLPGLPCLYYGDELGMGDWPGLRDRDANRTPMAWTSERNGGFSTAPDPLLVLPPITSPGYDYRVVNVEVQKQLSGSLLNWHHRMLTSRRLLPALRQGSFELLESAHPSVLCYARHSDGMTVVVAANLAATGASSRLDLGQWQGSRMRDTLWGCEFPPASEAWFVYLPAYGFFWWLVGEDSSDANS

SEQ ID NO: 5483 - protein, 516 aa, Coccidioides immitis
MDQSVYATYPPELSPEQRRYLVATVKDWTIHHGLTVRPSPDLVSKASDSNAVLATNAPVTLFPSLFPRSCYQSAVSVQTAYNELYAAITADEAWLGEIIEDLVDVDDFVANLWKVHKAVKQEGYVQPLSLGLFRSDYMLHIPEGSTEPSLKQVEFNTISSSFGGLSCLVSKMHSDLLSCPPGTPIAYPPHQLLKENSIPENKAVATLTAGLAAAHEAYGCSKSSPSLPLCILFVVQDGERNIFDQHELSTRLTQFHKIPVFRVITTDVLRLTSVPQDNPSRPLVYAPPYAPSVSFEVTTIYLRGFYGPRDYQDGSAWEARTHLERSAAIKCPTVLNQLSGCKKVQQVLAQPTGPDHLARFLPNADPQTIKQIRDTFAPQYDISISGQGQDLALNPSTAAKHVLKPQREGGGNNIYREAIPGFLRAMPEKDWKGWILMELIQPPSAAKNVALRSDGEVLTGNVVGELGIFGTILWNNETGKVMRNEQGGWLMRTKADDSDEGGVAAGFSSLDSILLI

SEQ ID NO: 5484 - protein, 458 aa, Gloeobacter violaceus
MLRSLTLAWGGDQCFCNIEYSCLNPFVKGRSMVTSLNDSPSPAYICPNDMACSNLDRAAQILRLDPGVVEVLGTPHRVLTVSVPVRMDNGRIRVFAGHRVQHCNVLGPYKGGMRYHPDVTLREVSTLAMLMTWKCALMGIPYGGAKGGIAVNPTTLSVGELERLTRRFTSELVRDIGPQIDIPAPDVGTGPREMAWMMDTYSMSIGHASPGVVTGKPLSIGGSKGRDAATGRGVVIATREALDTAGLALRGATIAIQGFGKVGKAAALIFQQHGARVIALSDGSGGIYNPDGLDIEQAADFVRDGSRLAQYPFPGVKPIANPELLTLPCDVLVPAALEHQITEANAARVRARLVVEAANAPTTMEADRILEERGVTVLPDILANAGGVVVSYLEWVQGLSYLFWDEEKVNLELEKLMVGAYARVLQQATQFRLPLRPAAYTLAVGRVVEAFNHRGLYP

SEQ ID NO: 5485 - protein, 853 aa, Mycobacterium tuberculosis
MPTAGSSRAPAAAREIVVVGHGMVGHRLVEAVRARDADGSLRITVLAEEGDAAYDRVGLTSYTESWDRALLALPGNDYAGDQRVRLLLNTRVTQIDRATKSVVTAAGQRHRYDTLVLATGSYAFVPPVPGHDLPACHVYRTFDDLDAIRAGAQRTLDGGHTDGGVVIGGGLLGLEAANALRQFGLQTHVVEMMPRLMAQQIDEAGGALLARMIADLGIAVHVGTGTESIESVKHSDGSVWARVRLSDGEVIDAGVVIFAAGIRPRDELARAAGLAIGDRGGVLTDLSCRTSDPDIYAVGEVAAIDGRCYGLVGPGYTSAEVVADRLLDGSAEFPEADLSTKLKLLGVDVASFGDAMGATENCLEVVINDAVKRTYAKLVLSDDATTLLGGVLVGDASSYGVLRPMVGAELPGDPLALIAPAGSGAGAGALGVGALPDSAQICSCNNVTKGELKCAIADGCGDVPALKSCTAAGTSCGSCVPLLKQLLEAEGVEQSKALCEHFSQSRAELFEIITATEVRTFSGLLDRFGRGKGCDICKPVVASILASTGSDHILDGEQASLQDSNDHFLANIQKNGSYSVVPRVPGGDIKPEHLILIGQIAQDFGLYTKITGGQRIDLFGARVDQLPLIWQRLVDGGMESGHAYGKAVRTVKSCVGSDWCRYGQQDSVQLAIDLELRYRGLRAPHKIKLGVSGCARECAEARGKDVGVIATEKGWNLYVAGNGGMTPKHAQLLASDLDKETLIRYIDRFLIYYIRTADRLQRTAPWVESLGLDHVREVVCEDSLGLAEEFEAAMQRHVANYKCEWKGVLEDPDKLSRFVSFVNAPDAVDSTVTFTERAGRKVPVSIGIPRVRS

SEQ ID NO: 5486 - protein, 698 aa, Leptospira interrogans
MTHTISGQYGRDTIVLETGSWAKQAHGAVVYKSGNLVLLATVCAADEAKEGQDFFPLTCEYTEKLYSVGRFPGGYFKREAKPPEHEILISRIIDRPIRPLFPEGYFCEVQLQVQVLSADGDVSVAGHALNAASAALAVSDIPFNGPIAGARIGRVNGELILNPTTKEILNSDLDLVVAGTKTHIVMIEGEAKELSNEEMIAALRFAQKHIAEFVTLQEEYAKKIGVVKREVKLKVRDEELLSKVKEYAFAKLTTANQTPDKTARNKEISNVNKEVVEFFKDTIEDSDKIKDIKAYLHELEYEIVREQVLTKGTRFDGRKLDEIRSISVEINPLPGPHGSAVFTRGQTQSLGVVTLGTGSDNQRYETLEGQKEKSFMLHYNFPAFSVGEVRRSSGPGRREIGHGNLAERALKLVLPKPDEFPYVIRVVSEILESNGSSSMASVCSGSLALMAAGVPIQGSVSGIAMGLFSDSSGKYAVLSDIAGLEDHFGDMDCKIAGTRKGITAFQMDLKVTGVSFDVLESVFEQAQRGRFHILDIMEKHISKASSTLAGTAPRIIVRNIPKDRIGELIGPGGKNVRGISELTGAELYIEDDGKVTISGSNQESAEKAAKMVDGFFAEVEVGKIYEGKVKRIADFGAFVEILPGKEGLCHISKIDFKRVNSVKDIVKEGDIIRVKVLNVDKTGKIDLSRKDALEEEQV

SEQ ID NO: 5487 - protein, 416 aa, Nitrosomonas europaea
MFSQSLTIEQVDPDLWQAIKGEVQRQEDHIELIASENYASPAVLQAQGTVLTNKYAEGYPGKRYYGGCRYVDIVEQLAIDRLRNLFNAEYVNVQPHSGSQANAAVYLSALKPGDTLLGMSLAHGGHLTHGSAVNMSGKIFNSISYGLNPETEEIDYAELERLAHEHKPRMIVAGASSYARVIDWKAFRQIADNVGAYLFVDMAHYAGLIAAGYYPNPVGIADFVTSTTHKTLRGPRGGVIMAKPEHEKALNSAVFPQTQGGPLMHVIAAKAVAFKEASSQAFKDYQKQVIENARVMARVLQQRGLRIVSGRTDCHMFLVDLRAKNLTGREAESALEAAHITVNKNAIPNDPQKPFVTSGIRIGTPAITTRGFKEPESEELANLVADVLDAPANTAVLDQVARKAQALCTKFPVYGN

SEQ ID NO: 5488 - protein, 729 aa, Unknown
  Bradyrhizobium sp. BTAi1
MAAAMSATSARSMPLKINSSTSSSRPWQRYFSSRKPDAMRLSAGSHARLGATWDGRGTNFALFSANAEKVELCLFDSQGRREIERIELPERTEDVWHGYLNDVSPGQLYGYRVYGPYEPERGHRFNANKLLLDPYAKRLAGRLVWSDAHFAYRAGSPREDLSFDRRDNARGMPKAVVIDETFNWGRREMRPQIPWEDTIIYEAHVKGLTNRRDDVPPNLRGTFGGLSAPAMIKHLKRLGVTTIELLPIHAFIDDRMLVEKKLVNYWGYNTISFFAPEQRYAQDNPLDAFRTTVARLHDAGIEVMLDVVYNHTAEGNHLGPTLCYRGIDNASYYWLQPDNPRFYDDFTGCGSSVNLTHPRVLQMVMDSLRYWVEVCHVDGFRFDLATTLAREKHGFDRRSGFLTAVRQDPVLAGVKLVAEPWDVGLGGYQVGAFPSQWSEWNDRYRSAMRRYWSGEGSLIGEVSSRMTGSSDIFNHDGRTQRASVNHVTVHDGFTLADLFSYNSKHNEANGEDNRDGSNDNHSNNCGHEGPSSDPAINALRRQLRKNQLACLFLAQGLPLLLAGDEVGNSQSGNNNAYCQDNEVGWVDWSGIGREGDDLTDFIAHMTELRRRFGQIRARRWLDGRRADGSFGVLWLTPSAEEMTQTDWTFPDGRFLAYVLAPVEQEQAPIFIVLNAAPEEIGFKLPKLAEYKTWQQVLDTTEIQQKPADFAAGADLKAPPRSVLAYAGVS

SEQ ID NO: 5489 - protein, 168 aa, Sinorhizobium meliloti
MTKRAVLAGGCFWGMQDLIRKLPGVIETRVGYTGGDVPNATYRNHGTHAEGIEIIFDPERISYRRILELFFQIHDPTTKDRQGNDIGTSYRSAIYYVDDEQKRIAQETIADVEASGLWPGKVVTEVEPVRDFWEAEPEHQNYLERYPNGYTCHFPRPNWVLPRRSAAE

SEQ ID NO: 5490 - protein, 1101 aa, Unknown
  Bradyrhizobium sp. BTAi1
MNLMSSLDAPNLQTATDGDGLWYKDAIIYQLHVKAFADSNNDGIGDFVGLTEKLDYLQDLGVTALWLLPFYPSPGRDDGYDIADYGSINPDFGTMKDFKRFIQEAQRRGLRVITELVVNHTSDQHHWFKRARRSPPGSSARNWYVWSDTDQKYLGTRIIFTDTEKSNWTWDPEAGQFYWHRFFSHQPDLNFDNPRVVSAIIQVMKRWLDAGVDGFRLDAIPYLCERDGTNNENLPETHAIIKRLRVELDNYAKDKLLLAEANQWPEDVQEYFGQGDECHMAYHFPLMPRIYMAIAQEDRFPITDILRQTPDIPATCQWALFLRNHDELTLEMVTDVERDYLWSTYANDPRARINVGIRRRLAPLMDNDRRKIELMNSLLMSFPGTPIIYYGDEIGMGDNIYLGDRNGVRTPMQWTPDRNGGFSRADPARLYAPMIMDPVYGYEAVNVEAQSRSLSSLLNATKKLISVRKSTPAFGRGTMSFIRPANRSVLAYVRQYKDEVILCVANLSRSAQATELDLSAFKDRVPIEMLGRSRFPAIGELPYMITLAPYGFYWFQLREREKSEPVVQRAVPEFETLVVPVGSTWVSLARTRSLFERDVLPGHLARTRWYPERSADAIHPTLTSAIPFCDIGDNRPWLIFFKAAERNDELRYLLPMWIDWVRFDRERYNPQAFAAVRQGAREGTVLDAATSPIFLALLLRNLRQSLTVEEDGLRLEFRPTSKFPDRPISESEQVRIIETDRCSSKAVVNNDYFIKIHRELEAGVHPEIDVGHFLTETVGFANVPPLLGSVEFIQDDERRTIGSVHGFIENQGDGWTVTLAYLDRYIDDQRVFTAQGDERQNEERSPYLRYMTQAGRRVGELHAALASRNDIADFAPEPTTADSLDHWIDRLRAQANRVLARLIERRDHFKDPERGLIDQVLARRGELSERLSHLIPHHVGGCDIRLHGDFHLGQILIVKDDIFIIDFDGDEEQPLAERRRKAPPAKDIAGFLRSIDCSVRVALDHALQAAPDDHSKLTTALADWRDQASAAFLAGYREIKAAQGLWPDDPHTAEALLSFFLLEKALGALEYDLAHRPDWLRVALGNLLRVLSVPAPASESS

SEQ ID NO: 5491 - protein, 260 aa, Oryza sativa
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTTFVAGNDFAQVEFNRLPLGRLGKPEDISSLVAFLCMPAASYITGQIICVDGGRMLS

SEQ ID NO: 5492 - protein, 231 aa, Zea mays
MAGGNDLKVLGVWTSPFVIRVRIVLNLKGLAYEYVEEDLGNKSALLLGSNPVHKSVPVLLHAGRAINESQVILQYIDEVWAGTGPAVLPADPYERAVARFWGAYIDDKVESAWLGMLFRCANEEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 5493 - protein, 948 aa, Fulvimarina pelagi
MSLIEEKDYGTPASKAEKLVTLTIDGQSVTVPEGTSIMRAAAEAEILVPKLCASDMLDAFGSCRVCVVEIEGKNTTPASCTTPVGEGMFVKTESDRLSRIRKGVMELYVSDHPGQWDERKGGGDCEVREVAERVGLSDVRYDSSERNHFDAELDESNPYFTFDSSKCIVCSRCVRACNEVQGTFALTVEGRGFDSRISAGTPVDEFLTSECVSCGACVQACPTEALQEKTVKEKGLPTSSKITTCAYCGVGCSFKAEMQGEEVIRMIPYKDGKANRGHSCVKGRFATEYAKHEERVLEPMIRETYKDPWQVVSWDEAISFAANKIKDIQAKYGRGAVGGISSSRCTNEEVYVVQKMVRAGFGNNNIDTCARVCHSPTGYGLATTYGTSAGTQDFDSIEHTDVMVVIGANPTDAHPVFASRMKKRIREGAKVIVIDPRRIDLVKTPHVEADVHLPTRPGTNVAILTALAHVIVTEGLVDEEFVKERCEVDEFEDWKEFVSAENRSPEAMEIVTGVPADLVRRAARLYATGGNGAIYYGLGVTEHSQGSTSVIAIANLAMATGNIGRKGVGVNPLRGQNNVQGSCDMGSFPHEMPGYRHISHDETRKIYEDLWKVKIDREPGLRIPNMFDAAIEGTFRGLYCQGEDILQSDPDTKHVSAGLGALDLLIVQDLFLNETANYANVFLPGSTFLEKDGTFTNAERRINRVRKVMEPKNGYADWEVTQLLARAIGMDMNYAHPSEIMAEIAATTPSFAGVTYELLDKEGSVQWPCNEEHPVGSPVMHVGAFMRGKGKFVRTEYVATDEKVGPRFPLLLTTGRILSQYNVGAQTRRTLNTVWHPEDLLEMHPHDAEERGIREGDFVKLQSRVGETSLKVHITEKMAVGVVHTTFHHPSTQINVITTDFSDWATNCPEYKVTAVQVSPTNGPTEWQEDYRELTETSRRVRSLEAAE

SEQ ID NO: 5494 - protein, 362 aa, Medicago truncatula
MITGNRNVMASLLLLFALFTVHLRLTSAQIGVCYGMMGNNLPSQREAIDLCKSNNIKRMRLYDPNQAALEALRNSGIELMLGVPNSDLQNIATNNDIAIQWVQKNVLNFYPSVKIKYIAVGNEVNPVGGSSQFAKFVLPAIQNIYQAIRAKNLHDQIKVSTAIDMTMIGTSYPPSKGSFRSDVRSYLDPIIGYLVYANAPLFANIYSYFSYKDNPKDISLQYALFTSPNVVVWDGSRGYQNLFDALLDSLHAAIDNTGIGFVKVVVSESGWPSDGGFATTYDNARVYLDNLIRHVKGGTPMRSGPIETYIFGLFDENQKNPELEKHFGVFYPNKQKKYPFGFQGKIDGTNLFNVSFPLKSDI

SEQ ID NO: 5495 - protein, 316 aa, Bacillus subtilis
MSEEKIYDVIIIGAGPAGMTAAVYTSRANLSTLMIERGIPGGQMANTEDVENYPGFESILGPELSNKMFEHAKKFGAEYAYGDIKEVIDGKEYKVVKAGSKEYKARAVIIAAGAEYKKIGVPGEKELGGRGVSYCAVCDGAFFKGKELVVVGGGDSAVEEGVYLTRFASKVTIVHRRDKLRAQSILQARAFDNEKVDFLWNKTVKEIHEENGKVGNVTLVDTVTGEESEFKTDGVFIYIGMLPLSKPFENLGITNEEGYIETNDRMETKVEGIFAAGDIREKSLRQIVTATGDGSIAAQSVQHYVEELQETLKTLK

SEQ ID NO: 5496 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 5497 - protein, 117 aa, Glycine max
MGGGPARCYRQIKNKPSPKSMYCRGVPDPKNRIYYVGMKRKGVDEIPYCVHLVSWEKDTVSSDALEAAFIACNKYMTNSTGKDAFHLPVRVQPFHVLRINKMLSCAGADTLQTGMRG

SEQ ID NO: 5498 - protein, 527 aa, Unknown
  Candidatus Desulfococcus oleovorans Hxd3
MTNTIGDLETADVILATGTNTTENHPVISTFIKRAVEKRGAKLVVIDPRKIRLTNFARKWVRQNLGTDVAWINGLMHVIIKEDLYDKAFVSKRTAGFEDLKAMVEKFTPAFVESITGIAADDIVEIARLYAKARAASIVYCMGITQHTTGTDNVKSLANLSMLCGHLGIEGGGVNPLRGQNNVQGACDMGGLPNVFTGYQPVTSEEARKKLEAAWGVTGIPDKPGYTVTEMIPKAIEGTVKALYIVGENPMVSDPDLHHVKHGLEALDFMVVQDIFMTETAQLADVVLPSACFAEKEGTFSNTERRVQRVRKAVEPPGQARDDWRITAAISTAMGFPMGYDSAEQIMAEIAKLTPSYGGITYERIDRVGLHWPCPTPDHPGTPVLHTVQFPIGKGKFHAIDYIPPAEQTDDAYPLYLTTGRIIYHYHTGTMTRKSEGLNERAPENFVEISAEDAGRYGIEDGSMVTIASRRGKIKAKAAVSEKGVAGTVFIPFHFAESAVNELTHAALDPVSKIPEYKVCAVVLEKA

SEQ ID NO: 5499 - protein, 311 aa, Lactobacillus johnsonii
MKKIHLLVNLKSGSNRGEKALKQIETVLKNEKMDYDIHISNYPGQLVPIATKVANEISSRNEYVIVVGGDGSLNQALNGVKNSEQPNTPLAYFPAGTGNDFARAAKLETDLLKLIRHLKNNPTVTKVDCGKYHDLINGETRYFVNNLGIGFDAYVVNKTNHSKLKTKFNKINIGNLTYGINIVQALKGQDNFKVRVSTNGHTSYYEHAYLVTTTNHPYFGGGVPILPIASIHNHHLDIAIVEKPNLVKFIYLFSKLLINGSHMKSNQFHYFESSAIEVKTDDPEYGQLDGEELSKRKFHLKFEVDHFDLLQ

SEQ ID NO: 5500 - protein, 345 aa, Unknown
  Bradyrhizobium sp. BTAi1
MQLGMIGLGRMGGNIVRRLMRAGHSCVVYDRDAKAVAALVSEGATGAASLDDFVGKLAAPRHAWIMLPAGKITEATVEQLTELMAADDVIIDGGNSFWQDDVRRGKALSERGLHYVDVGTSGGVWGLERGYCMMIGGDKAVVDRLDPIFATLAPGIGDIPRTPGRDGRDPRVEQGYIHAGPTGAGHFVKMIHNGIEYGLMQAYAEGFDILRNANSEALPEAHRFNFDLADVAEVWRRGSVIPSWLLDLTASALARQPGLDKYSGYVEDSGEGRWTVNAAIDEAVPAEVLTAALFARFRSRQEHTFAEKILSAMREGFGGHKEPEQHPDPARQSAPEIVKPKADRA

SEQ ID NO: 5501 - protein, 487 aa, Solanum pimpinellifolium
MMMVSRKVVSSLQFFTLFYLFTVAFASTEEATALLKWKATFKNQNNSFLASWIPSSNACKDWDGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASLGNLNNLSSLYLYNNQLSGSIPEEIGYLSPLTELHLGNNSLNGSIPASLGNLNNLSSLDVH

SEQ ID NO: 5502 - protein, 463 aa, Chromobacterium violaceum
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 5503 - protein, 412 aa, Geobacillus kaustophilus
MNYLPQQDPQVFAAIEQERKRQHAKIELIASENFVSRAVMEAQGSVLTNKYAEGYPGRRYYGGCEYVDIVEDLARERAKQLFGAEHVNVQPHSGAQANMAVYFTVLEHGDTVLGMNLSHGGHLTHGSPVNFSGIQYNFVEYGVDPETHVIDYDDVREKARLHRPKLIVAGASAYPRIIDFAKFREIADEVGAYLMVDMAHIAGLVAAGVHPNPVPYAHFVTTTTHKTLRGPRGGMILCQEQFAKQIDKAIFPGIQGGPLMHVIAAKAVALGEALQDDFKVYAKRVVENAKRLAAALQNEGFTLISGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTEKFPLYQD

SEQ ID NO: 5504 - protein, 225 aa, Zea mays
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFS

SEQ ID NO: 5505 - protein, 226 aa, Achromobacter xylosoxidans
GGNKLRKLEYLIPQALEQGCDTLVTIGGIQSNHTRMVAAVAAKLGLACVLVQENWVDYSDAVYDRVGNIMMSRLMGADVRLVDQGFDIGFRRSWEEALEEVKRRGGKPYAIPAGASDHELGGLGYVGFAEEVRRPEADLGFKFDYIVVCAVTGSTQAGMVVGFAADGRADRVIGIDASATPEQTRAQVLRIARRTADLVGLERPIEDKDVVLDTRYAYPAYGLPSA

SEQ ID NO: 5506 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIATVTGAKKDCLCFIEVIVHKDDTSKELLEWGSRVSAANSRPPNPQ

SEQ ID NO: 5507 - protein, 356 aa, Guillardia theta
MVARAVLSFVALFGAAHAFQLGTPVRHGLSSSSSPLLRTCLHRSASSSAPTVSPRLRSLRMADEARAVGSRDSGRHMEDTSERSEAVSDIYKPFWEWAAKTIKERLGDDLVSYPIPDGYLRKEAMVGKGKRESLAWTQSYGYQTKKMRQIRAAHVNGGASLQVLNLVFFPHMNYDLPFLGLDLVTLPGGHLIAIDMQPLFQTEEYKKKYAEPCMDMYQKHVKNLPWGGDFPEEAKQYFSPVFLWTRPQEDKQVETYVFEAFKDYINKYLDFVEAAKPVTDPDHLARIRERQLSYLQYRAEKDPARGMFTRMYGPEWTERYIHGFLFDLEEKMESGEYKTGELLQCSDPLNFQPTPL

SEQ ID NO: 5508 - protein, 436 aa, Bacillus anthracis
MIGRGWDDMFCYQCEQTPTGGCKVMGVCGKNETIASLQDTIVFGLKGIAAYRTHAAQLGYTDAFVDATTQEALYMTLTNSNFNEQEHIDMAMKVGKSALRVMELLDKAHTNHFGVPEPVQITQNRVEGKAIVVTGHNLFALEELLKQTEGKEINIYTHSEMLPAHGYPQLKKYKHLKGNIGKAWYDQRRLFEKFTGAILATTNCVMPIKGSYSDRFFSYDIAGLEGVQKIENDNFAPLIQKALELPEVHMESDEQLVTGFHHNTVLSLAPEIIEAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGSKAPEFISAGVLDVLQETFGLKLITTAAEDMEMMLS

SEQ ID NO: 5509 - protein, 599 aa, Bacteroides thetaiotaomicron
MENLKNVAPIEDFNWDAYENGEAVTSASHEDLEKAYDGTLNKVNDREVVDGTVIAMNKREVVVNIGYKSDGIIPLNEFRYNPDLKVGDTVEVYIENQEDKKGQLVLSHRKARATRSWDRVNAALENEEIIKGFIKCRTKGGMIVDVFGIEAFLPGSQIDVKPIRDYDVFVGKTMEFKVVKINQEFKNVVVSHKALIEAELEQQKKEIIGKLEKGQVLEGTVKNITSYGVFIDLGGVDGLIHITDLSWGRVSDPKEVVELDQKLNVVILDFDDEKKRIALGLKQLTPHPWDALDTDLKVGDKVKGKVVVMADYGAFIEIATGVEGLIHVSEMSWSQHLRSAQDFMKVGDEVEAVVLTLDREERKMSLGIKQLKQDPWETIEEKYPVGSKHTAKVRNFTNFGVFVEIEEGVDGLIHISDLSWTKKVKHPSEFTQIGADIEVQVLEIDKENRRLSLGHKQLEENPWDVFETVFTVGSVHEGTIIEMLDKGAVVALPYGVEGFATPKHLVKEDGSQAQLDEKLEFKVIEFNKDAKRIILSHSRIFEDVAKAEERAEKKAASGAKKSSNNKREDAPMIQNQAASTTLGDIDALAALKEQLEGKK

SEQ ID NO: 5510 - protein, 441 aa, Unknown
  Rhodococcus sp. RHA1
MNNSDVAGRASAVDPREARIVVVGASHAAVALADRLRAGGHRGTLTLIGSERHLPYQRPPLSKAFLKGDADVHALALRDIEFFRSHGIALQTGERVVDVRRGKDGSGVLHTLRRHGSADEMSSDSYAFDRLVLATGARPRRLLIPGAGHRNVLALRDLDDAARLRDRIHRGPVVVIGGGFIGLEAAATIKALGGEAVVVEAGPQLMGRAVGADTAAWCAAAHRAMGIGIELLSRPEAIVTDGDQIIGVRLDDGRRIAAATVLIGIGVLPRDELARALGLECADAGGVVVDEHCLASDGVTVAIGDCTIQPRPGVGDGSLIRLESVDNSDEQAARATCTLLGTEPTARSVPWFWSDQGTYKLQMAGLVGDHDDVVLRTDPIRPDRRVFIYLRAGTMTAVECVNSPADFLVLRKALSRQAAIPREVLEDNSSPLKKLLATAQV

SEQ ID NO: 5511 - protein, 150 aa, Unknown
  Photobacterium sp. SKA34
MDSSEYPEQDDFSGVKKAKAPVYGVGDSTLQAAGGELGVKQLVDAFYYYMDTLPVAAKVRAMHSPDLTESKAKLTTFLVGWMGGPSRYAEMYGSINIPGAHRHLDIGLAEKDAWLLCMQKALDDQPYEETFKRYMMVQLSFPAEMCRNRK

SEQ ID NO: 5512 - protein, 325 aa, Robiginitalea biformata
MSESIERIKTLILGSGPAGYTAAIYAARADLKPVVYTGMEPGGQLTTTTEVENFPGYPDGVDGPTMMVQLQQQAERFGTDVRIGIATAVEFSDEPGGIHRVTIDDDKVVEAETVIISTGASAKYLNIPSEQRLRGGGVSACAVCDGFFYKGQDVAIVGGGDTAAEEASYLAKICNKVTMLVRKDHFRASKAMQNRVMSLENIDIRFNTEVDEVLGDQVVEGLRMVNNQTGEKEEVAITGLFIAIGHKPNTDIFKGQLDMDATGYIVTHGKSTRTNKPGVFASGDVQDKEYRQAVTAAGTGCMAALDAERYLSEVEAGEGEEVEQQ

SEQ ID NO: 5513 - protein, 623 aa, Psychrobacter arcticus
MCGLLGLIDYTKTTSEDIFSEMLSCLVKRGPDSEGIDLFYDDSCSVLLGHRRLAIQDLSNHGHQPMKYDNLVTIYNGEVYNFKEIQQQLLEKGYFFESDSDTEVILKAFHCWGIKSVDKFRGMFAFAIYDINKREITIFRDRVGVKPLYYSQTEDSFIFSSELKPFISFPNFDKSIDFEAVSSYLQFGYIHAPKSIFSSAKKLLPGHYLKFDIASKKLSIDCYWDVTDYFEDKTNVTDITAITDELESIIIESFNLRMISDVPVGTFLSGGVDSSLVTAILQKYSDIPINTFTIGFEDKNYDESIYAKAIADHLGTNHTEYICKKEDALEIIKELPKIFDEPFADSSAIPTTLVSKLAKEKVSVILSGDGGDELFCGYSSYTLMEKRFASISKIPFKNSIKKLSDFIPFPLVLLNGINENLYTKFMKFRNLLEHDDIANAFKVSNSVFCKDEIDKIISQEYFFNEDSISHVSTLEKMMISDFKGYLPDDLLVKVDRSTMSVSLEGREPLLDHKIIEFAARMPISLKKNKSILKDILKRYVPEELFLRKKQGFGIPINSWLRNDLKYLLDQYLNEDIIKEYGVFDPKYVTDLLRLFHAGKNDDRKIWTLLMFQMWFSEHLATSK

SEQ ID NO: 5514 - protein, 374 aa, Unknown
  Burkholderia sp. 383
MKVVVAGGSIAGLSAALTLDCIGHDVEIYERSPTPLRGQGGGVAVLRRMMAFLEQHGHHCRAMISVPTRRRQWIDRDGVVTRDEPEMLPFSSWDAVYRSLCSTLPHGQIHYGHAVTGFEQDADGVNIHIDGRQVRADVLIAADGMGSALRAHIFPDYVPSFAGYIAWRGIVDEADFDAAAIATLVENMTLHKAPGELFMAFLIPALDGSLEPGARRFNWLWYRNETNPDALRRHLTDQTGTIHHGSIHPGQLSNDSVASLRQLASERLPAVFSQLVLATRAPFVQAIFDALSPHFAHGRVALVGDAACTVRPHTASGTSKAARDAVSLAESLPADATDVVARLARWSIERRADVTSLLRKGPELATAFGLGHPI

SEQ ID NO: 5515 - protein, 573 aa, Haemophilus influenzae
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPESVELRSYNPTVNGHKGQIKKALKALLVAKKPILFVGGGAITAECSKQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 5516 - protein, 467 aa, Legionella pneumophila
MTEVFTIKQCLDGEISIDETVTVRGWVKTRRDSKAGLSFISLHDGSCFSPIQIVATDQLSNYQKEVTKLTAGCSMIATGKLVASQGKGQFFEIQAESIEVVGWVENPDTYPIQAKRHTLEFLREVAHLRPRTNTISAVTRVRHSLAQAIHRFYHEQGFFWVHTPIITASDCEGAGEMFRVSTLDLLNIPKNDKGQIDFSKDFFGRETFLTVSGQLNVEAYCMAMSKVYTFGPTFRAENSNTSRHLAEFWMIEPEIAFANLEDICKLSQNMLRYLCKTVLEERSDDMDFFNQFVAPGCIERMEHIADSEFEIMTYTDAIKALEASEQKFEFPVSWGLDLQSEHERYLAEVLCKKPVIVTNYPQEIKGFYMRLNDDGKTVAAMDVLAPGIGEIIGGSQREERLEILDRRMDECNLNKEHYQWYRDLRRYGTVPHAGFGLGFERLISYVTGVSNVRDVIPFPRTPGHADY

SEQ ID NO: 5517 - protein, 130 aa, Unknown
  Burkholderia sp. 383
MSKPRIALIAHDAKKDEIVALAGEFRATLAQCRLVATGTTGGRIADAHGLEVERKLSGPLGGDLQIGAELADGRIDIVVFLRDPMTAQPHDPDITALVRACDVHDVPVATNVATARMLLDDLARNMQDVC

SEQ ID NO: 5518 - protein, 651 aa, Psychrobacter arcticus
MCGVNGFFNAHTTIPVQNVIAQMNAAIDHRGPDAGDAWLDENIGLVLGHQRLAIQDLSPAGAQPMHSACGRYVLAFNGEIYNHLQLREQLMIEGHAPAWRGHSDTETMLACFVAWGIEKTLQAMVGMFAIVLWDRQQKVLTLARDRMGEKPLYWGWQGQSLYFSSELKGLKAHPSFKTDINRDAITLLLRHNCIPAPYSIYQGIEKLRPGHWVQLPLSDIQQAKTAQSKAYWRFNDIVEAGLADPFTGSPEQAVDALESALMQSIGGQMQSDVPLGAFLSGGIDSSTVVALMQAQSSRPVKTFTIGFDDAGYNEATHAKAIAKHIGTEHTEMYMRPEDALAVIPKLSSIYCEPFSDSSQIPTFLVNQLAHQHVTVALSGDGGDELFGGYNRYLMAQQVWSKSRKLPRPMRQLAAVSLTALSPKSWDTLVNTLSPVIPKRLNLRTPGDKAHKLAGVLNIDSEQAFYQNLTSHWQDPAQLVIGAQEPATLISDSSCWPTTDSFQHAMMAMDAQTYMTDDILVKVDRAAMANSLETRVPMLDHRIAELAWRMPLDYKIRNGEGKWLLKQVLYRHVPRELIERPKMGFGIPLHDWLRGSLRDWAEALLDRNLLQQQGYFNPAPIRKIWNEHLSGVFNHQHQLWDILMFQAWLETQ

SEQ ID NO: 5519 - protein, 313 aa, Aquifex aeolicus
MGNTLATHLDRKGHEVLLYDINEEVVKKINEGIHPYVEGIRFKNVKATTDLNQINEFKNLICALPVQVIPKVITKVNLKGKNFISASKGIIHENLKRISQLVKEIEPKLKFFVLSGPSFAEEVSKGLPTAIVLAYEDKEEAMKLQDALDSENFNVYLNDDITGVELGGALKNVIAIAVGLSDGMGYGYNARSAIITRGLHEMANVGEKFGARRETFFGLSGAGDLILTSTSDLSRNRTFGKLLGQGYSVEEALKKINQTVEGVKTAEALYEIIKRENIFAPICEGVYRIIKGEDPKKVYPHFLSNHLREEFQR

SEQ ID NO: 5520 - protein, 313 aa, Photinia villosa
GGLGDVLGGLPPAMAANGHRVMTVSPRYDQYKDAWDTNVLVEIEVGGRVETVRFFHCYKRGVDRVFVDHPLFLEKVWGKTESKIYGPRTGVDYMDNQFRFSLLCKAALEAPRVLNLSGNEYFSGPYGDDVVFIANDWHTALLPCYLKTIYKPKGIYKNAKVVFCIHNIAYQGRFPFSDFSLLDLPDNLKGSFDFIDGYDKPVKGRKINWMKAGILESDRVVTVSPYYAQELVSGEDKGVELDNTIRKTGITGIVNGMDVQEWNPATDKYLDIKYDNTTVLDAKPLLKEALQAEVGLPVDRNIPVFGFIGRLEE

SEQ ID NO: 5521 - protein, 274 aa, Solanum lycopersicum
MGRQPCCDKVGLKKGPWTAEEDKKLINFILNNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPITHKPLSTITIDHTNTLEQENQPIEEEKNQDILLAQMDIESSSIDQSTVAKIKSEDDNNNSNNNTMATNCTNNFDSTIVEVNNNGFCIDEVPLIEPHEILVQESTPSTSSSSFSSSSSSNILEDLKFLSSFDEWPLMENNNNNNVGIWMGN

SEQ ID NO: 5522 - protein, 261 aa, Triticum aestivum
MPPLLTSPASLSSSPLRLASHLGGAALRPTSHHHRRFLAPAPQTAARGPTTSGGFAAMSWLGKLGLGGGGSPRASEASAALAQGPDEDKPAPGSEFAQFGAGCFWGVELVFQRVPGVTRTEVGYSQGAFHDPTYEDVCTGATGHNEVVRVQYDPAACKYDDLLDTFWARHDPTTPNRQGGDVGTQYRSGIYYYTSEQEKAALESMEKQQKAQNRKIVTEILPAKRFYRAEEYHQQYLAKGGRFGFKQSTEKGCNDPIRCYG

SEQ ID NO: 5523 - protein, 313 aa, Photinia villosa
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFVFIDGNDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 5524 - protein, 313 aa, Prunus virginiana
GGLGDVLGGLPPAMAANGHRVMTVSPRYDQYKDAWDTEVTVEVKVGEKTEKVRFFHCYKRGVDRVFVDHPLFLERVWGKTASKIYGPKAGEDFKDNQLRFSLLCQAALEAPRVLNLNSSKYFSGPYGEEVVFIANDWHTALLPCYLKAIYQPKGLYKSAKVVFCIHNIAYQGRFAFADFALLNLPDEFKSSFDFIDGYDKPVKGRKINWMKAGILESDKVLTVSPYYAEELVSTVEKGIELDNIIRKTGILGIVNGMDVQEWNPLTDKYTTAKYDASTVTDAKPLLKEALQAEVGLPVDRDIPVIGFIGRLEE

SEQ ID NO: 5525 - protein, 448 aa, Ostreococcus tauri
MSRRVDIRRAVPPRRVPLHNPPLMSTTDTVALARAARDASRKLQQLSSERRAALLRAVANALERREDEIQRANDEDMARAAANKDVEDALLQRLKLKPGKVKQLADGARAIAAMEEPVGRPLKSTELARGLTMTKVTAPLGVLLIIFESRPDALPQIASLALRTGNGLLLKGGKEAASSNAKLREVIVDEFEAFGVPKECVCLIEGREAVADLLALDDVIDLVIPRGSNQLVSYVQNNTKIPVLGHADGVCHVYVDKDADLDMAAKLAIDSKIDYPAACNALETLLIHDSLVANGGAAELMTALRASGVELFGGPRGTKELKLPPAPALRHEYGTLQCSVELVGSMDDAIDYIHANGSGHTDCIITSNQKTADEFINRVDSACVFHNASTRFSDGFRFGLGAEVGISTSRIHARGPVGVEGSICQQGQGRHVHAQGASTAQGRGRTEA

SEQ ID NO: 5526 - protein, 313 aa, Chaenomeles sinensis
GGLGDVLGGLPPAMAANGHRVMTVSPRYDQYKDAWDTSVLVEIEVSGRVETVRFFHCYKRGVDRVFVDHPLFLEKVWGKTESKIYGPRTGVDYMDNQFRFSLLCKAALEAPRVLNLNSNEYFSGPYGDDVVFIANDWHTALLPCYLKTIYKPKGIYKNAKVVFCIHNIAYQGRFPFSDFSLLDLPDNLKGSFDFIDGYDKPVKGRKINWMKAGILESDRVVTVSPYYAQELVSGEDKGVELDNTIRKTGITGIVNGMDVQEWNPATDKYLDIKYDNTTVLDAKPLLKEALQAEVGLPVDRNIPVFGFIGRLEE

SEQ ID NO: 5527 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 5528 - protein, 948 aa, Unknown
  Bradyrhizobium sp. BTAi1
MNPVKALEQHGQAVWLDFLARGFVAKGDLKRLIDEDGVKGVTSNPAIFEKAIGSSDEYDAPIAKALKGGDRSPTQLFEAVAVEDIQNAADVLRPVYDSFNGNDGFVSLEVSPYLAMDAKGTIAEAEQLWKAVDRRNLMIKVPATEACLPAIQHLISRGISVNITLLFAQEVYRQVAEAYLAGLEAYVADGGDPSHVASVASFFVSRIDSVVDKQLDEKIAQANDPTEKERLTALKGKIAIANAKMAYQDYKRLFSGARWERLAAKGAKPQRLLWASTGTKNKDYSDVLYVEELIGPNTVNTVPPATLDAFRDHGKVRDSLEEDVEAAQAALEALAKTGISLDEITAELVIDGVKQFADAADKLYGAVAHKRAVVLGERLGQQSIAVAADLDKKVQAATEDWRKTAKIRRLWHKDSSVWTGKDEHKWLGWLTCVEKADIADYEDYAQRVKGQKFSDAVVLGMGGSSLGPEVLARTFPRKAGFPRLHVLDSTDPAQVRAMEKAIDISKTVFIVSSKSGGTTEPNAMKDYFFARVSEAIGANKAGHRFIAVTDPGSSLEKAAKAQGFARVFHGEPSIGGRYSVLSPFGLVPAATAGIDVRKLVTNAQAMVRSCGPDVPPLQNPGVQLGLAMGLAGLDGRDKVTIFASPRIADFGAWAEQLIAESTGKEGKGLIPIDGEPIGDPADYGSDRFFIDIRVEGDDIPDHDAKLAALEDAGHPVVRIVISSIDQLGQEFFRWEMATAVAGAALGINPFDQPDVESAKIKTRELTAAFEQTGALPAEEPVISVKGCELYTDAQNAESLREHGADGTLASWLKAHLGRASDGDYIALLGYIEHNGANTDALQRIRLKLRDAKHLATCAEFGPRFLHSTGQAYKGGPDSGVFLQITADDAQDLPIPGQKASFGVIKAAQARGDFDVLTERGRRALRVHLKGNLKSGLKMLDSAITEALS

SEQ ID NO: 5529 - protein, 313 aa, Pyracantha coccinea
GGLGDVLGGLPPAMAANGHRVMTISPRYDQYKDAWDTEVTVELKVGDKTETVRFFHCYKRGVDRVFVDHPLFLEKVWGKTASKIYGPTAGVDFMDNQLRFSLLCQAALVAPRVLNLNSSKYFSGPYGEEVVFIANDWHTALLPCYLKAIYKPKGIYKTAKVAFCIHNIAYQGRFAFADFALLNLPNEFKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 5530 - protein, 430 aa, Carboxydothermus hydrogenoformans
MEEFKKLGLITPLLKAVNDLGFEMPTPIQKEAIPLILEGHNLVGQAPTGTGKTAAYLLPVLQRIQRGKKAQVLIVTPTRELALQVADEVAKLGKYLKVRALAVYGGQAIERQIRGLRQGVEVIVGTPGRILDHIGRKTFPAAEIKIVILDEADEMLDMGFIDDIEAILNTLTNRQQTLLFSATLPAPIKTIIKKFLGGYKTVKLVGREKTVPAIRQVYYELPETEKIEGLVSILNSELPIQAIVFCRTKKRVDEVVEQLNFRGYAAKGLHGDMSQRERTQTIKSFKAGKTELLVATDVAARGLDIPDVSHVINFDIPQNPESYIHRIGRTGRAGREGKAITLINYRERKLLKAIEEAINKRLKREILPEPVDLEEARFKKIAKKILDTITKGVPALYLEMAARLLEEEESEQLLGATLYLLEDRSLQNDF

SEQ ID NO: 5531 - protein, 179 aa, Zea mays
  misc_feature (85)..(85): Xaa can be any naturally occurring amino acid
  misc_feature (100)..(100): Xaa can be any naturally occurring amino acid
  misc_feature (107)..(107): Xaa can be any naturally occurring amino acid
  misc_feature (113)..(113): Xaa can be any naturally occurring amino acid
  misc_feature (130)..(130): Xaa can be any naturally occurring amino acid
  misc_feature (147)..(147): Xaa can be any naturally occurring amino acid
  misc_feature (167)..(167): Xaa can be any naturally occurring amino acid
FVEVPTTGRKTVVDAPSIPVLVEETNTSRCLGYVKDCRRRGVPAVRGRFFRLEACLLRLALCLFRCVYVRVRSVWSRVELIPSLXISAEHGVPLFLCRFXFFNFQRXNVAKQXVPSETAKTHFYLRATRXAKEFSILLKSYDTRGIXLGDVLACGSFGHIDSYYFLXATSLNGYDCNFF

SEQ ID NO: 5532 - protein, 650 aa, Listeria monocytogenes
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVMQKLQDLDSNEYNPEIISLYLMNFERALGRGKNKKESNDEALQTTIDLASQIERETIQRYFEKGTITRKEMKVYRDNLLAIEANMQLEF

SEQ ID NO: 5533 - protein, 295 aa, Nitrosomonas europaea
MHNTIENFIGHTPLVRLKRIPSETSNTILAKLEGNNPAGSVKDRPAYSMIMRAQQRGDIRPGDTLIEATSGNTGIALAMAAAILGYRMILVMPENLSLERRQVMSAYGAEIVLTPKEGSMELARDTAEQLCNAGKGIILDQFSNPDNPLAHYETTAPEIWQDTAGTVTHFVSSMGTTGTIMGCARYFREQEQKVEIIGVQPQENAQIPGIRKWPEAYLPKIYQPELVDRILLVSQQEAEEMARRLAREEGLFTGISSGGALAAALKVSAQVQNAVIVFIVCDRGDRYLSTGVFPS

SEQ ID NO: 5534 - protein, 397 aa, Unknown
  Sulfitobacter sp. EE-36
MAARSAAAQSPDPMIVEPQPWAQGLGDGVDVTPYGLPIRFEQDVVRRNVPWLTADTISSINFTPIHALDGTITPQGCAFERHHSGAIELSKQDYRLMVNGLVDRPLVFTYADLERFPRENHVYFCECAANSGMEWAGAQLNGAQFTHGMIHNMEYTGVPLRLLLEEAGYDPAGKWVYIEGADASSNGRSIPMDKALDDVLVAFKANGEALRKEHGYPVRLVVPGWEGNLWVKWLRRIEVTDAPVESREETSKYTDTLADGTSRKWTWAMDAKSVITAPSPQSPVPHGAGPLVITGLAWSGRGTITRVDVSTDGGASWQTARLAQEGTPMALCRFYLDVQWDGTEMLLQSRAMDDTGYVQPTKTQLRAVRGLNSVYHNNGIQTWWLHADGSVENVEVS

SEQ ID NO: 5535 - protein, 544 aa, Leptospira interrogans
MDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 5536 - protein, 747 aa, Rickettsia akari
MFNEITKSVTWNGKVLELSTGKIARQADGAVTVKMGNSVLLCAAVVANKAKEGIGFFPLTINYREMAYAAGKIPGGFFKREGKASDREVLVSRLIDRPIRPLFHPAFVNETHVTCTVLSYDPETPVDILAIIGASAALSLSPAPYLEIVAASKVGLIDGEFVLNPTLELLKTSQLDLVVAGTADSVMMVESEANLLSEEQMLEAVKFGFESFQPIIKIIKELAKEAKKPKFQMQDLYPASLKKEIEKLFVKEIKQAFAIKSKQERSTNLDLIHEKVLTHFVSDIENKKYSNYQIESALKSIESDILRNEILEKNRRIDGRSTTDIRQIACEIGLLPSAHGSALFTRGETQSLVSTTFGTSLDEQLVDSLDGEYKERFMLDYIFPPYSVNEAMPMKAPSRREVGHGKLAWRAINPILPNKVQFPYAIRVVAETTESNGSSSMATVCSSSLALMYAGVPIKAPVAGIAMGLVKEGKKFAVLSDILGDEDYFGDMDFKVAGTSEGITALQMDIKISGVDFKIMKAALEQARLGRLHILDQMNKIISKPNSKLGKNVPSTTTIKIDKDKIRDVIGPGGKVIKEICETSDAKIDISDDGTVSVYASDRDKLKVALDKIKAIAVEPEIGEIFNGTVMKVLDSGAFINYLGTKDGFVHISEIAEERIETVGSVLKQGDIVKVKLIGFDNKGKAKLTIKNADKDKSSNNPKQKNNVNNSKENSEPERRDSSKKRAWNEDNNSDTTEVITERKYFN

SEQ ID NO: 5537 - protein, 194 aa, Bacillus subtilis
MRKAERVRKTNETDIELAFTIDGGGQADIKTDVPFMTHMLDLFTKHGQFDLSINAKGDVDIDDHHTTEDIGICLGQALLEALGDKKGIKRYGSAFVPMDEALAQVVIDLSNRPHLEMRADFPAAKVGTFDTELVHEFLWKLALEARMNLHVIVHYGTNTHHMIEAVFKALGRALDEATTIDPRVKGIPSTKGML

SEQ ID NO: 5538 - protein, 228 aa, Brassica napus
MDQQEHAQSGAMNYGSNPYQTNPMTTTSAGPAAPPGQLGFHQIHQQQQQQQLAQQLQVFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQGPDQPDQEN

SEQ ID NO: 5539 - protein, 305 aa, Oryza sativa
MDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARFYAPSTIFIDEIDSLCTSRGASGEHESSRRVKSELLVQIDGVNNSSTTEDGQPKIVMVLAATNFPWDIDEALRRRLEKRIYIPLPNFESRKALININLKTVEVATDVDIDEVARRTEGYSGDDLTNVCRDASMNGMRRKIAGKTRDEIKNMSKDEISKDPVAMCDFEEALAKVQKSVSPADIEKHEKWQAEFGSA

SEQ ID NO: 5540 - protein, 401 aa, Arabidopsis thaliana
MALQAASLVSSAFSVRKDAKLNASSSSFKDSSLFGASITDQIKSEHGSSSLRFKREQSLRNLAIRAQTAATSSPTVTKSVDGKKTLRKGNVVVTGASSGLGLATAKALAETGKWNVIMACRDFLKAERAAKSVGMPKDSYTVMHLDLASLDSVRQFVDNFRRTETPLDVLVCNAAVYFPTAKEPTYSAEGFELSVATNHLGHFLLARLLLDDLKKSDYPSKRLIIVGSITGNTNTLAGNVPPKANLGDLRGLAGGLNGLNSSAMIDGGDFDGAKAYKDSKVCNMLTMQEFHRRFHEETGVTFASLYPGCIASTGLFREHIPLFRALFPPFQKYITKGYVSETESGKRLAQVVSDPSLTKSGVYWSWNNASASFENQLSEEASDVEKARKVWEISEKLVGLA

SEQ ID NO: 5541 - protein, 184 aa, Arabidopsis thaliana
  misc_feature (38)..(38): Xaa can be any naturally occurring amino acid
  misc_feature (82)..(82): Xaa can be any naturally occurring amino acid
  misc_feature (95)..(95): Xaa can be any naturally occurring amino acid
  misc_feature (154)..(154): Xaa can be any naturally occurring amino acid
MASSMLSSTAVATSPVQDTMVRLHCTGLKSSASFPVTXRKANNYFTSITRNGGKDICMKVCTPVGKNKCETLSYLPDLTDVXELAKEVDYLLRNXRIPCVEFELEHGFVYREHCNTPVYYDGRYWTMCKLPLVGCTDSAQVLKEAEECKKEYPXVFIMIIGFDNARIVQCIRFIVQKPPRFPKA

SEQ ID NO: 5542 - protein, 408 aa, Unknown
  Burkholderia sp. 383
MNNSTSANRKAVIVGGSLGGLFAANLLLRNGWDVDVFERVPEELSGRGAGIVTHPELFEVMLAAGVRLDETIGVKVESRITLGQDGTIVSEHRLPQTLTAWSKMYHVLRSALPDQHYHSGAVVTSVTDGSDRASVMLSDGSVVHADLVIAADGFRSAVREKFLPGTPLQYAGYVAWRGLADELSLSDSTHAALFENFAFGLPPREQILGYPVAGHGNSTKPGERRYNFVWYRPASEEEDLPNLLTDATGKLWEGGIPPTFIRREVIADVEEAAQALLAPQFAEVVSRATQPLFQPIFDLEVPQMAFGRIALLGDAAFVARPHCGMGVAKAAGDAMALVTALATRTDTLDALSEYSQIRTQFGIAIVQHARHLGAYMQAQLKNDTEREMAERYRTPEVVMRETAVPPHF

SEQ ID NO: 5543 - protein, 243 aa, Cyanidium caldarium
METSLSELLDASAHIGHSTSKWNPKFFPFIHMTKKGIHIIDLIKTIQQISVACMFLKKEVRNGKRVLFVGTKNQASKVVEREAKKCQEFYINQRWPGGLLTNWPTIKLSLKKLQLLEEKEKLDHLGSTSKKEEASMKREIQKLNKYLNGIKGMKKPPDIIILVDPSREKTTISECQKLNIPTIGILDTNCNPKSVNVPIPANDDSIKAIDLIVSKLSTSIFKAKLENNQFIENSTENLNEHVK

SEQ ID NO: 5544 - protein, 274 aa, Glycine max
MCTALKTNYQLSEEIGRGRFGTIFRCFHPLSNEPYACKLIDKSLLHDSTDRDCLQNEPKFMTLLSPHPNILQIFHVFEDDQYLSIVMDLCQPHTLFDRMVDGPIQESQAAALMKNLLEAVAHCHRLGVAHRDIKPDNILFDSADNLKLADFGSAEWFGDGRSMSGVVGTPYYVAPEVLLGREYDEKVDVWSCGVILYIMLAGIPPFYGDSAAEIFEAVVRANLRFPSRIFRTVSPAAKDLLRKMICRDSSRRFSAEQALRHPWILSAGDTAELT

SEQ ID NO: 5545 - protein, 151 aa, Lupinus luteus
LTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 5546 - protein, 113 aa, Cyanidium caldarium
MFSKLEAIIRPFKLEEVKVRLMTFGVPGITVTNVMGCGKQIGGIERSKGVEYDSELIEKVKIEIVVMNEHIDELIEIIINAVWTGEIGDGKIFVSPVSSVIRIRTQDKDLDAI

SEQ ID NO: 5547 - protein, 236 aa, Pisum sativum
MASMAFSTTFFTPLRDFNQPRTNSTPSTSLPFTKSSIASSKSPFFQLGFSQQASSNFPIVPSKTRSFSVNAKAIKDKTIYDFTVKDIDKKDVSLSKFKGKVLLIVNVASRCGLTSSNYTELSHLYENFKNKGLEVLAFPCNQFGMQEPGSNEEIKQFACTKFKAEFPIFDKVDVNGPFTAPVYQFLKSSSGGFFGDIVKWNFEKFLVDKNGKVVERYPPTTSPFQIEKDIQKLLAA

SEQ ID NO: 5548 - protein, 663 aa, Legionella pneumophila
MEKMLINAMQTEEIRVALIKNNQLFDLDIECPGEIKKKGNIYKAIVTRREPSLDAVFVEYGSKRQGFLPLKEIAPEYLSKNPEEFGDEKPPITSLIREGQELLIQVDKEERGNKGAALTTFITLAGCYLVLMPNNPHSGGISRRIEGDERDELRETLNALTLPEDMGLIIRTAGVGKSLEELQDDLNMLCNQWQSIKEAYNSELAPCLIHQEGDVIIRSIRDNLRKSISEIIIDDQISYIKAKQYIERVKPEFLPNLKLYNSSIPLFNFYQIESQIETAYQRQVMLPSGGALVIDRTEALVSIDINSAKATGGADIEATALNTNLEAADEIARQLRLRDLGGLVVIDFIDMSSSKNQREVENRLKEALQADRARIQVGRISRFGLLEMSRQRLRLSLGETAQEICPRCEGRGTVRSIQSHGLSITRLIEEEALKEKTAEIQVQLPPEMATFIMNEKRNFIRDIEKRHGVSVVVIANPYMHPPQYTITRLKEDNVGKSKKPSYSLIQQPEVHVPSSDKEPVSHDEPAVKSFAEHRVIKHPQTSFIKRLWTSLFGGHSVAHTVTQEPGKKHHRAQNQGKHPSSKSSGGDKRQQGSNANRRRRSGGGQQRSSSGNTNAAASTHQQRKKSNPNQQSHGSQQSNRSIPAKNEGNKKREAILAKEQEEK

SEQ ID NO: 5549 - protein, 349 aa, Solanum lycopersicum
MGSEALEFFSCANNNNNNNGFSYEPKKNIIMEETDNLSINIHDGSWFEEEIDVDLKWSFALNSVLHKGTSEYQDIALLDTKHFGKILVIDGKMQSAEVDEFIYHECLIHPALLCHPNPKNVFIMGGGEGSAAREALRHKSMEKVVMCDIDKEVVDFCKKHLTANHEAFLNKKLNLVINDAKAELEQRQEKFDIIVGDLADPVEGGPCYQLYTKSFYQNILKPKLNDTGIFVTQAGPAGVFTHKEVFSSIYNTTKQVFKYVLAYTAHVPSFADTWGWVMASDKPFCLDAGKLDKKIAERIEGELLYLNGASFFSSTILNKTVAKTLKNESHVYAEDDARFIHGHGLGFRN

SEQ ID NO: 5550 - protein, 388 aa, Arabidopsis thaliana
MVLSVKQTLSPKIGLFRRNPSSSLGRSPVSLSFPSTELPKRTVLAVSKPLHLSSSLKAKSPVVRCEAYEADRSEPHPIGDDAAAAETKSEAAKKLKIGIYFATWWALNVVFNIYNKKVLNAYPYPWLTSTLSLAAGSLMMLISWAVGIVETPKTDFDFWKTLFPVAVAHTIGHVAATVSMSKVAVSFTHIIKSGEPAFSVLVSRFILGETFPTSVYLSLIPIIGGCALSALTELNFNMIGFMGAMISNLAFVFRNIFSKKGMKGKSVSGMNYYACLSMLSLLILTPFAIAVEGPQMWVDGWQTALATVGPQFVWWVVAQSVFYHLYNQVSYMSLDQISPLTFSVGNTMKRNSVIVSSIIIFRTPVQPVNALGAAIAILGTFLYSQAKL

SEQ ID NO: 5551 - protein, 360 aa, Arabidopsis thaliana
MASSMLSSATMVASPAQATMVAPFNGLKSSAAFPATRKANNDITSITSNGGRVNCMQVWPPIGKKKFETLSYLPDLTDSGGRVNCMQAMGEPNLNPAYTLDQAIANLQQTEDASARYYAAWWIGRFRAAQPETIAALLVALEDETDRSPDGGYPLRRNAAKALGKLGDRQVVPALIKALECEDYYVRESAAQALEGLGDARAMAPLMAKLTGGLAAAQLVEGKPHLAQPYEAIIEALGTLQAVESIGLIEPFLEHFSPKVQYAAARALFQLTGDNRYGDLLITALGGTDLQLRRSAMMDLGATGYLPGAQAIAKAFAENSLKLIALRDLWATHRQRQASSESKALSPASRQILELMDSLL

SEQ ID NO: 5552 - protein, 263 aa, Triticum aestivum
MPPLLTSPASLSSSPLRLASRLVGAALRPTPSSSSRSRRFLAPTQTAAPGTTTSGGFAAMSWLGKLGLGGGGSPRASEASAALAQGPDEDKPAPGSEFAQFGAGCFWGVELVFQRVPGVTRTEVGYSQGAFHDPTYEDVCTGATGHNEVVRVQYDPAACKYDDLLETFWARHDPTTPNRQGGDVGTQYRSGIYYYTSEQEKAALESMEKQQKVQNRKIVTEILPAKRFYKAEEYHQQYLAKGGRFGFKQSTEKGCNDPIRCYG

SEQ ID NO: 5553 - protein, 91 aa, Glycine max
MSGQRRSSRTSKFTEIEINELVSRLQVLLLQGNQRGNSRQSASKILQETCCYIRKLQEEVEQLSERLSELMDSVDISDIDRRTLQNLLQQY

SEQ ID NO: 5554 - protein, 489 aa, Unknown
  Burkholderia sp. 383
MNEEILINLTPQETRVALVQQGAVQELHVERTLSRGRVGNIYLGKVVRVLPGMQSAFIDIGLERAAFLHVADIWHPRLAGEPQSGTPHQPIEKIVFEGQTLMVQVIKDPIGTKGARLSTQVSIAGRTLVYLPQEPHIGISQKIESEAEREAVRARLTAVIPADEKGGYIVRTIAEDATSDELAGDVTYLRKTWATIVAQAQRLPATSLLYQDLDLAQRVLRDFANDDTTRIQVDSRETYQRLSEFAGEFTPAVSPKLHHYTGERPLFDLYNIETEIQRALSRRVDLKSGGYLMIDQTEAMTTIDVNTGGYVGARNFDDTIFKTNLEAAHTIARQLRLRNLGGIIIIDFIDMENAEHRDAVLSELKKALSRDRTRVTVNGFSQLGLVEMTRKRTRESLAHVLCEPCPTCQGKGQVKTSRTVCYDILREILRESRQFNPREFRVIAAQQVIDLFLDEESQHLAMLIDFIGKPVSLQVESNLSQEQYDIVLM

SEQ ID NO: 5555 - protein, 317 aa, Corynebacterium glutamicum
MSEEQSAVAPKIHDVAIIGSGPAGYTAAVYAARADLNPIMFEGYEYGGSLMTTTDVENFPGFEKGILGPELMENMRAQAERFGTDMHMELVDRVDLTGDIKKLWVGDDEYHARAVILSMGSAPRYLGVKGEQELLGRGVSACATCDGFFFRDQDIAVIGGGDSAMEEATFLTKFARSVTIVHRREEFRASAIMLERAQKNEKIRFVTNKTVEEVIEADGKVSGLKLNDTVTGEDSVLDVTAMFVAIGHDPRSEILAGQVEVDPSNYVLVQEPSTRTNLDGVFAAGDLVDSHYQQAITAAGSGCRAAIDAEHYLASLA

SEQ ID NO: 5556 - protein, 472 aa, Bifidobacterium longum
MATTAGAKKGLWSTIRRIAASDRISGLIMLGFALTGLVLANLPATAHAFETVAETHLFIPYTNLDLPIGHWAQDGLLTIFFLTVGLELKQELTTGSLANPKAAAVPMLCAVGGMIAPPILFLAVTALFSQIGPGEPGTLILTTTGSSIPFSEMSHGWAVPTATDIAFSLAVLALFAKALPGSIRAFLMTLATVDDLLAIILIAVFFSSINAWYWFIGIAVCAAIWAYLVRLKKVPWIAVGIVGILAWIMMFEAGVHPTLAGVLVGLLTPSREMHGELSPRAERYANKLQPFSALLALPIFALFATGVHFESMSPLLLASPLVIALIVALVVGKPLGIITTAWLSTHVGGLKMAKGLRVRDMIPAAVACGIGFTVSFLIASLAYKNAELSAEARFGVLVASLIAAAISGVLLSRQSKRFEKTAAAAAADEEDDESIDGDGIGQPSHTTEPTTPTEHPGTLADGTASVEIDFRH

SEQ ID NO: 5557 - protein, 259 aa, Bordetella bronchiseptica
MISLPYLQRFALSGQVALVTGSARGLGLRIAQALAGSGAHVLLNGRDAHAVEAAVSDLRQQGLRASALPFDVSDEQATEQAFARIDAEHGRLDILVNNVGARNRKPLAETSPAEIRAMMDTNLVAGILLARLAAQRMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 5558 - protein, 145 aa, Physcomitrella patens
  misc_feature (66)..(66): Xaa can be any naturally occurring amino acid
  misc_feature (74)..(74): Xaa can be any naturally occurring amino acid
  misc_feature (138)..(138): Xaa can be any naturally occurring amino acid
MAAAAMTSIVPVASIAPVSKVANVRPSSVSVAKAFGLKSRSMGRLTCMATYKVTFLDGETGAENVXECSDEEYXLDAAERAGMDLPYSCRAGACSSCAGIIKAGEVDQSDQSFLDDSQIDDGFVLTCVAYPASDCIIXTHQEENM

SEQ ID NO: 5559 - protein, 281 aa, Ostreococcus tauri
  misc_feature (1)..(1): Xaa can be any naturally occurring amino acid
XRPGTRGRSHIGTYPTALTETFWRALAEESGMSLRLTKRRGDNAHHIVESTFKAFARGLRAAMDSVEGIDVYDSKTPSEEAPRKSEIKRSTKETSIDVELDLDGDASTSKISTGIVALDGLLSSIQREANIQLVINASGDLWIDDHHTAEDVSIALGQALNKALATKKGCNRMGSAMSTEGDATVECVMDLSNRPYLGYGLEFDCDKVGGDLSVEMVEHVFMSLAFNGQMTVHLIEHSRGVNEDEVATAAAKAFGKCLRQCAAIDPRRAGSVASSKGTLSV

SEQ ID NO: 5560 - protein, 313 aa, Pyracantha coccinea
GGLGDVLGGLPPAMAANGHRVMTVSPRYDQYKDAWDTGVPVEIQVGGRVETVRFFHCYKRGVDRVFVDHPSFLERVWGKTGSKIYGPSAGEDYKDNQFRFSLLCQAALEAPRVLNLNSNKYFSGPYGDDVLFIANDWHTALLPCYLKAIYKPKGIYENAKVVFCIHNIAYQGRFPISDFSVLDLPENLKGSFDFIDGYSKPVKGRKINWMKAGILESDRVVTVSPYYAQELVSGEDKGVELDNIIRKTGITGIVNGMDVQEWNPATDKYLDTKYDNKTVLDAKPLVKEAPQAEVGLPVDRNIPVIGFIGRLEE

SEQ ID NO: 5561 - protein, 421 aa, Arabidopsis thaliana
MENMFRLMASEEYFSERRCVWVNGPVIVGAGPSGLATAACLHDQGVPFVVVERSDCIASLWQKRTYDRLKLHLPKKFCQLPKMPFPDHYPEYPTKRQFIDYLESYANRFDIKPEFNKSVESARFDETSGLWRVRTTSDGEEMEYICRWLVVATGENAERVVPEINGLMTEFDGEVIHACEYKSGEKFRGKRVLVVGCGNSGMEVSLDLANHNAITSMVVRSSVHVLPREIMGKSTFGISVMMMKWLPLWLVDKLLLILSWLVLGSLSNYGLKRPDIGPMELKSMTGKTPVLDIGALEKIKSGDVEIVPAIKQFSRHHVELVDGQKLDIDAVVLATGYRSNVPSWLQESEFFSKNGFPKSPFPNAWKGKSGLYAAGFTRKGLAGASVDAVNIAQDIGNVWREETKRQKMRRNVGHRRCISVA

SEQ ID NO: 5562 - protein, 409 aa, Pyrococcus abyssi
MVKVWIEKLLEEPELYLLRVDDDRIRYFEATWDIPEGITYNAYLMKLKDVVILFDAWKKDYTEEFIEALSSLVDPKEITHIVVHHTEPDHTGALPKLLELNEYKAQIIGTNFAKNLLQGFYGSDVVKNFHVVRDGEEVKIGDRTFRFITVPWLHWPDTMITYVIEDKLIFSCDAGGGYGIPRAIDDSDEEVVKEYLPYVTKYIVTVIGHYHKYIVQNIKKLKSLGIIESVRMILPGHGLIWRRNPVRIFEHYERVGAGIPTKDKVLVLYDSMYGFVEERMKVVIEELRKYNKKPVIYRFTDKEAPAVSDILGEVPDSEALIIGVSTYEADVHPRIRYTLYEILDKANYDKPVLIVGAFGWGGVAGKKIETLISRSKFELVEVVETKGRPTEEDKEKLREAVRRLIQWIS

SEQ ID NO: 5563 - protein, 313 aa, Pyrus calleryana
GGLGDVLGGLPPAMAANGHRVMTVSPRYDQYKDAWDTGVPVEIKVGGRVETVRFFHCYKRGVDRVFVDHPSFLERVWGKTGSKIYGPSAGEDYKDNQFRFSLLCQAALEAPRVLNLNSNKYFSGTYGDEVVFIANDWHTALLPCYLKAIYKPKGIYENAKVVFCIHNIAYQGRFPISDFSVLNLPENLKGSFDFIDGYNKPVKGRKINWMKAGLLESDRVVTVSPFYAQELVSGEDKGVELDNIIRKTGITGIVNGMDVQEWNPATDKYLDTKYDSTTVLDAKPLVKEALQAEVGLPVDRNIPVIGFIGRLEE

SEQ ID NO: 5564 - protein, 313 aa, Pyrus calleryana
GGLGDVLGGLPPAMAANGHRVMTISPRYDQYKDAWDTEVTVELKVGDKTETVRFFHCYKRGVDRVFVDHSLFLERVWGKTASKVYGPVAGVDFEDNQLRFSLLCQAALEAPRVLNLNSSKHFSGPYGEEVVFIANDWHTALLPCYLKAVYKPRGIYSTAKVAFCIHNIAYQGRFAFADFALLNLPDEFKSSFDFSDSSEKPVKGRKINWMKAGILESDKLLTVSPYYAEELVSAVEKGVELDDIIRKTGIFGIVNGMDVQEWNPLTDKYTTIKYDASTVADAKPLLKETLQAEVGLPVDRDIPVIGFIGRLEE

SEQ ID NO: 5565 - protein, 313 aa, Pyrus calleryana
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFVANDWHTALLPCYLKAIYKPKGIYKTAKVAFCIHNIAYQGRFAFADFALLNLPNEFKSSFDFIDGYDKPVKGRKINWMKAGILESDKVLTVSPYYAEELVSSVEKGVELDNIIRKTGIQGIVNGMDVQEWNPITDKYTTVKYDASTVADAKPLLKEALQAEVGLPVDRDIPVIGFIGRLEE

SEQ ID NO: 5566 - protein, 459 aa, Listeria monocytogenes
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVKEGFRPDAVIVDPPRSGCDQGLIKSLLDVEAKQLVYVSCNPSTLARDLALLAKKYRIRYMQPVDMFPQTAHVETVVLLQLKDK

SEQ ID NO: 5567 - protein, 312 aa, Rhaphiolepis indica
GGLGDVLGGLPPAMAANGHRVMTVSPRYDQYKDAWDTSVLVEIEVGGRVETVRFFHCYKRGVDRVFVDHPLFLEKVWGKTESKIYGPRTGVDYMDNQFRFSLLCQAALEAPRVLSLNSNKYFSGPYGDDVVFIANDWHTALLPCYLKTIYKPKGIYKNAKVVFCIHNIAYQGRLPFSDFSLLDLPDLKGSFDYIDGHDKPVKGRKINWMKAGILESDRVVTVSPYYAQELVSGEDKGVELDNTIRKTGITGIVNGMDVQEWNPAADKYLDIKYDNTTVLDAKPLLKEALQAEVGLPVDRNIPVFGFIGRLEN

SEQ ID NO: 5568 - protein, 94 aa, Plantago major
LRCIISKNVGPYEQGIAQGCMMGISSLANVLSPLIYSPLSAVFLSDNAPFDFPGFSILCVGLAWLIGFVLSTMIKIIPHFSRDRTMSSEPCLLA

SEQ ID NO: 5569 - protein, 119 aa, Plantago major
MATSSEEGQVYSVHSVEEFKDHLEKSKEAKKLVVIDFTASWCGPCRFIAPILAELAKKTPHVMFLKVDVDELKAISVEYEVEAMPTFVFLKDGKPIDRLVGAKKEDLLAKITTHGTVVA

SEQ ID NO: 5570 - protein, 148 aa, Haemophilus influenzae
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTA

SEQ ID NO: 5571 - protein, 783 aa, Oryza sativa
MGKTKGKQRQDKFYHLAKEQGYRSRAAFKLLQLDARFRFLPTARAVLDLCAAPGGWVQVAVNHAPVGAFVVGVDLVPIRPIRGAHSLTEDITTTKCRAAVRRLMDSNGVAAFDVVLHDGSPNVGGAWAQEATAQSSLVIDAVRLATMFLAPKGAFITKVFRSQDYNAIMYCLKQVRDPLKPDRQKRNRDGYEEGNTTLRKAGLASDFIWSEGQTPLEFLGSFNAISFDDPASLPIKNHELTTDEIKALCEDLYVLDKNSFKHILKWRIRIRKALSSSEVTKKTDDTAVEVNVKDDDQLLQEMEELTSVIDRKKKREKKRQSKRRAKDKARKATGMQIDATGDNYGDPDLFSISAIKGGKELQAIESAELNVEDAQGDTYERYVTKKGGEVKQERKRAKRVNTDADEELLEGGEDDGDDVDMDQGSDEEQDQETNPLLLSLDAEKPTKEQMMEQWFSQDVFTEAGTGVVEQSDSEDEREQLTRIAKKKADSGKKEKSAKAKRLQQDDFEIVPAEPVRTEDDSSPSSDESDELDEDLDDDTKAEVLAYARKMLRKKQREQILDDAYNKYMFDDEGLPKWFAEDEKRHNQPMKPVTKEEVAAMRAQFKEIDARPAKKVAEAKARKKRVAMKKLDKARQKADAIADQNDINEQSKRKMIDRIYKKAIPKKPQKEYVVAKKGVQVRAGKGKILVDKRMKKDKRASKVKGGKGAKGKGKKGGGQKGDTEDAAMFKGFNTMIKGEVDRIIQAGASSEVSTSGKEFQEPNISVDQKQTIDNDKHSLDFGPT

SEQ ID NO: 5572 - protein, 853 aa, Nitrosomonas europaea
MKRMLFNATQPEELRVAIVDGQKLIDIDIETLGKEQRKSNIYKAAVTRLEPSLEAAFVDYGAGRHGFLPYKEIAPTCFDRNTDWSGHRVADLLREGQELIVQVDKDERGNKGAALTTYISLAGRYLVLMPNNPQGGGISRRVSAEERAELREVINNLQVPEGMSIIARTAGIGRNEEELQWDLNYLVQLWRAIEEAASNEKGVFLIYQESSLVIRAIRDYFHAEIGEILIDNPEIYEQAYQFMANVMPANVDRLKLYQDDIPLFSRFQIEHQIETAYSRQVTLPSGGSIVIDHTEALVSIDVNSARAIRGSDIETTALNTNLEAADEIARQLRLRDLGGLVVVDFIDMEVTRNQREVESSLLKALRLDRARVQIGKISRFGLLELSRQRLRPSLGEGNYIPCPRCHGTGHIRGTDSSALHILRIIQEEAMKEQTSMLQVQLPVDVATFLLNEKRSEIYRLEARLKVGIILIPNIYMETPNYTITRLRHEDIKSTELPPSYEMVEKTSEEVTLPSISQETRATRPKAAVTGIKPEQPAPVPEEKPREQLSFLDKFFSLFRPAGSNRTETDQAAEESQTKPSRGERSRNRRDRGRSKRTKTSTQVTANGSLQEAGHSSLLDHPVVVEHPVTDRATDNDRQHRKNGRQNPPQKLEVASDQLDVSTTPADTAATADSTSERKTEKRGRSRRRRGSLHRDREDQINLNTATGQDEVIPIGENETVEPVVSSDDDSKDTENILLLPVEPVGDTSSTPTNDIIENQVTASAEIIETETIHTRGEPDSEYQVTVEPHPHQTIELPDLAQSGLIMIETAPDKISETEEVPPAPSRRPRSRPRRSVEPAADNAEPLVQVETRD

SEQ ID NO: 5573 - protein, 302 aa, Lactobacillus johnsonii
MTKKARLIYNPVSGHEQMLQNVADILNVLEQAGFEASAFRTTPEPLSAQNEAKRCAIAGFDLLVGAGGDGTINEVVNGVAPLEKRPKLAVIPAGTTNDFARALKIPRDDLVEAAKVILTGKTQKMDIGRAGKQYFMNIAASGSLTELTYGVPSEVKSVLGYSAYLLKGAEMLPKISSNKMRLTYDEGVYEGDLSMFLLGMTNSIGGFERIMPDAQLSDGLFQLIVVKTANPVDVLRLMAMALNGNHVNDPQIIYTKTKNLKVELLGESKDKDPIPVNLDGEIGGHLPIDFENLKQHIEFYIG

SEQ ID NO: 5574 - protein, 237 aa, Gloeobacter violaceus
MIFKGFCHTMPLRRLAFVRFLGRALPIVALSAGTLACSASSATTPDPATDAALTSAVGPQTAVFAGGCFWGVEAVFEHLKGVEDAVSGYAGGDASTAKYAAVGSGRSGHAEAVRITYDPSKITYGQLLKVFFQVAHDPTQLNRQGPDQGTQYRSAIFFTDGEQQRIAQTYIEQLDKARVFPQPIVTQLAPLQKFYLAEPYHQDFVKLNPAHPYVVFHDLPKLAQLRKQFSNLYQDQS

SEQ ID NO: 5575 - protein, 711 aa, Fulvimarina pelagi
MFNSHKVEIDWAGRRLTLETGKIARQADGAVLATYGETVVMATVVSEKQPKAGFDFFPLTVNYQEKTFAAGKIPGGFFKREGRPSEKETLTSRLIDRPIRPLFAEGYKNDTQVVLTVLQHDLENDPDVVAMVAASAALTLSGVPFMGPIGGARVGYINGEYKVNPNVDEMPESALDLVVAGTKDAVLMVESEAHELSEDVMLGAVMEGHRSFQPVIDAIIKLAEVAAKEPREHNAPDHSALEGEMLKLAEDDLRAAYKITDKQERTNAVATAKEKVVAHFLPEGEDEPKFTKEEVNAVFKSLQAKIVRWNILDTQSRIDGRSLDTVRKIVSEVGILPRTHGSALFTRGETQALVVATLGTGEDEQFVDALTGTYKERFLLHYNFPPYSVGETGRMGSPGRREIGHGKLAWRAIRPMLPAAEQFPYTLRAVSEITESNGSSSMATVCGTSLAFMDAGVPLKRPVAGIAMGLIKEGERFAVLSDILGDEDHLGDMDFKVAGTEEGITSLQMDIKIQGITEEIMKVALDQAKGGRVHILGEMNKALGEARSELGEFAPRIEVMQIPTDKIRDVIGSGGKVIREIVEKTGAKINIDDDGVIKIASSSGKEIEAAKKWIHSIVAEPEVGEVYEGTVVKTVEFGAFVNFFGSRDGLVHISQLGEGRVAKTTDVVKEGDKVWVKLMGFDERGKVRLSMKVVDQDSGEEIKKSKEDDAA

SEQ ID NO: 5576 - protein, 524 aa, Unknown
  Rhodococcus sp. RHA1
MTTTIGDRDEAARTPRRRRHLFSRALAGVIAAGVVLGVGELLSVLIDPNSSPFYAVGSTTVDRSPAWAREFAIDTFGTNDKPALFVGMTILIVLLAATAGIVERPRAPFGSAILAVLGLVGIVASTQRPSATWMFALPTVVGVVAGIAVLRVLTTAARAPEDSDAEDSWLPRRTFLLLAAAAAATAAAAGAAGRYLGQQAAGALDNRRAFALPEVSDRAAPIAPGTDVDVPGATPFVTSNEDFYRIDTALRVPRLTTDDWQLHIHGMVDRELTLTWDDLVARTPVERVITLTCVSNEVGGNLAGNATWIGYPIKDILDEAGVHPGADMLLSTSSDDFTAGTPVDALRDGRDAILAVAMNGQPLPFEHGYPVRQVVPGLYGYVSATKWVVDWELTRFDEAEAYWTQRGWSAKGPIKTASRIDVPASFAPTPPGPVLVAGTAWAQHRGIAKVEIRVDNGEWQTATLAPQYTIDTWRQWTWEWQATSGLHTLQVRATDLDGNVQVEERTPPIPGGATGWHTRSFTVA

SEQ ID NO: 5577 - protein, 229 aa, Zea mays
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRDCGGQGKPFFGGDSVGYVDVVLGGLLGWVRASEELHGVRPFDPERTPLLAAWSERFGALDAVQTVMPDVGRLLEFGKALMARLAA

SEQ ID NO: 5578 - protein, 246 aa, Achromobacter xylosoxidans
GGNKLSKLEFLLGDAVANGADTVITVGGLQSNHARLTAAAAAVLGLACELVLSRAVPIDDLEYERNGNMLLDPLFGARVHIAPAGMDSLASAQARAEELRAQGRRVVVLPTGGSTALGSLGYVSCAQEIAQQERELGVQFSTVAVANGSGGTQAGLVAGFHALGRDPGMVQAYGVLATEPQTLATTHALVGGACELLGLAPPAESAIRVDGSHRGERYGAPTSGMLGAVMAVARSEGWLLDPVYAG

SEQ ID NO: 5579 - protein, 162 aa, Unknown
  Bradyrhizobium sp. BTAi1
MASPTASIYDFTAASLTGEEVPLKRFAGQVLLIVNTASACGFTPQYRGLEALHRAYADRGFAVLGFPCNQFGAQEPGTAEEIGAFCSTKYDVTFPLFAKIDVNGAEAHPLYKFLKGEKTGLLGSAIKWNFTKFLVDRQGNVVSRHAPTTTPEALKKEIEALL

SEQ ID NO: 5580 - protein, 415 aa, Unknown
  Shewanella sp. MR-4
MSLIKQISADAAHAAHILAQLDESLKNTVLLDMARSLREKSYEIQSANLIDVHRAIQDNLSSAMVDRLTLNQHRIEAMAQGIETIAALPDPVGHERYIGKRPNGLSISKMRVPLGVVCMIYEARPNVTADAGALCFKSGNAVILRGGKEALHTSQVIASILQAVLTAYGLPKALISVIPDPDRALMLELMQQREFIDVIIPRGGEGLINYVTENSSIPVIQHFKGVCHLYVDKDANQDIALDLLLNGKTQRTGVCNALEGLLVHKDIAPRFLPRVAKALAEHQVKINACPPAAAYFDACTYMAEEDFGQEYLDLEIAIRQVDSFEVATQHIAKFGSHHTEVICTDNELTAAHFQRAVDASVVMVNASSRFSDGSELGLGAEIGIATTKLHAYGPMGLEALTTEKYLVSGTGQIRA

SEQ ID NO: 5581 - protein, 283 aa, Musa acuminata
APAFMALLVSVLAAVPTRVQSMGVCYGMMGNNLPPPSEVIQLYKSNRIGRLRLYDPNHGALNSLRGSNIEVILGLQNGWKKHIASGMEHARWWVQKEVKDFWPDVKIDYIQGGNEIPPVTGTSSLTSFQVPALVGEAGLGNDIKVSTSVDMTLIGNSYPPSQGSFRNDVRWFTDPIVGFQASNGAPLLVNVYPYFSYSGNPGQISLPYALFTAPNAVVQDGRQYRNLFDAMLDSVYAAMTAGGGQWVGIVVSESGWPSAGYHGTAYNLIQHAKEGSPRKPYLN

SEQ ID NO: 5582 - protein, 387 aa, Unknown
  Rhodococcus sp. RHA1
MSAIQNGTDEVRVIDTGAPPTRFARGWHCLGLASEFSDGKPHQISAFGTELVVFAGEDGKLNVLNAFCPHMGGNLADGTVKGDTIACPFHDWRWRGDGKCADIPYARRVPPLARTKSWLTLERNGQLFVWNDPQNRKPPAEVTIPEISVFGDEGWTDWVWNKLEVRGSHCREIVDNVVDMAHFFYVHYGMPTYFKNVFEGHVATQVMRSKPRADAVDVKLGTNYDTESASDASYFGPSYMIDKLWTEGDDSGEPNIMLINCHYPISADSFMLQYGVMVKKPEGVPDAVANGIAAQVAAGVAIGFEQDVEIWKKKSSIDNPLLSEEDGPVYQLRRWYEQFYVDVEDINPEMTNRFEFEIDTDRALKNWQVEVDANLAAGRSAIPSPVS

SEQ ID NO: 5583 - protein, 472 aa, Bacillus anthracis
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 5584 - protein, 601 aa, Arabidopsis thaliana
MLEFRDSPVFQYINDLSPIEPVKPGRPENILHSLVFTSPSSSSSLFCSPQLNSYRDSRFFIKRHRSLDLSSPVVLIGETLKNSPDALWEEKLKCRPEKLENVSEPKPFKEQISLAIELANSLKHGRDGCDIQMVSCDEVPMDADDEIGSGGGSRELSDELCRQSFDPLDFDADSDGVLHTDEMEAESGFGKEVIMFDVADIQNYEQQIPRTTDPRFYSLASEPQQFSIYCNNSNYVEEREGSCSVQVAAGAPDINLSCSSKVAAIDSTAEAEDKEDKDLQPSGKQRSVRRRCLTFDMGGSHKRIPLRDSTNDLPLDSTSINKAPSPQNCLDTSKQDTDEILPIPRTIGLHLNGFVNPSVSSGRKKKKIKDGQAFPSTTFHYNIEDEFSTPVSTKRDLVVFSDVKIMEPPERSVEGECFDQLMAMENRYCECFSAGLFCGEPCSCQNCFNKPIHEDLVMKSREVIKARNPLAFAPKVVSTSDTVIDLWVENSKTPASARHKRGCNCRKSGCSKKYCECFMMGVGCSSNCRCMGCKNTFGHTNEQCAGDSDVVTINDEAKHYGDHGDASRQNEEILTSERNRLLLPGSVAFRSLTSLSNLSEL

SEQ ID NO: 5585 - protein, 607 aa, Oryza sativa
RGRRRRRRRRRRRRQGWAWLPRRLYGFSVSLVVACWVVLLLLNPLVGHGNGQRDEGIFADEGSSDPSFDSVEPTLSEGSVDSVVQQENGENHALPGDSCAKPDENHVLSEETLLEKDQLCSNDEAQGDSMDALPKDNVDQGENLPRTDDDSVVHPEGEVESEGVPRPARLSRVVPPGLDEFKTRAIAERGKGVPSGQPGNVIHRREPSGKLYNYASAAKGAKVLEFNKEAKGASNILDKDKDKYLRNPCSAEGKFVIIELSEETLVDTIAIANFEHYSSNLKEFEMLSSLNYPTDSWETLGRFTVANAKIAQNFTFPEPKWARYLKLNLLSHYGSEFYCTLSMLEVYGMDAVEKMLENLIPVENKRLEPDDKMKEPVDQQTQLKEPTEGKESSHEPLDEDEFELEDDKLNGDSSKNGAHDQVTETRPIQAGRIPGDTVLKVLMQKVQSLDVSFSVLERYLEELNSRYGQIFKDFDADIDTKDALLEKIKLELKHLERSKDDFAKEIEGILSWKLVASSQLNQLLLDNVIIRSELERFREKQADLENRSFAVIFLSFVFGCLAIAKLSIGMIFNTCRLYNFEKFDRVKSGWLVLLFSSCIIASILIIQ

SEQ ID NO: 5586 - protein, 434 aa, Pyrococcus abyssi
MIEKTYCQDIKPELDGKRVKLAGWVYSNMRVGKKIFLWIRDSTGIIQTVIAKNVVGEDVFETAKKLGRESSVIVEGIVKADERAPGGAEVHVEKLKVIQAVSEFPIPENPEQASPELLLDYRHLHIRSPKVSAIMRVKETLIMAAREWLLREGWHEVFPPILVTGAVEGGATLFKLKYFDKVAYLSQSAQLYLEAAIFGLEKVWSLTPSFRAEKSRTRRHLTEFWHLELEAAWMDLWDIMKVEEELVSYMVQRTLELRKKEIEMFRDDLTTLKNTEPPFPRISYDEAIEILQSKGVKIEWGDDMGADEERVLTQEFDRPFFVYGYPKHIKAFYMKEDPNDPRKVLAADMLAPEGYGEIIGGSEREDNYDKLVQRIKEEGMDPKDYEWYLDLRKYGSVPHSGFGLGVERLVAWVLKLDHIRWATLFPRTPARIYP

SEQ ID NO: 5587 - protein, 275 aa, Musa balbisiana
APAFMALLVSVLAAVPTRVQSMGVCYGMMGNNLPPPSEVIQLYKSNRIGRLRLYDPNHGALNSLRGSNIEVILGLQNGWKKHIASGMEHARWWVQKEVKDFWPDVKIDYIQGGNEIPPVTGTSSLTSFQVPALVGEAGLGNDIKVSTSVDMTLIGNSYPPSQGSFRNDVRWFTDPIVGFQASNGAPLLVNVYPYFSYSGNPGQISLPYALFTAPNAVVQDGRQYRNLFDAMLDSVYAAMTAGGGQWVGIVVSESGWPSAGYHGTAYNLIQHVKEG

SEQ ID NO: 5588 - protein, 130 aa, Brassica napus
  misc_feature (119)..(119): Xaa can be any naturally occurring amino acid
  misc_feature (123)..(123): Xaa can be any naturally occurring amino acid
  misc_feature (127)..(127): Xaa can be any naturally occurring amino acid
MAAVTSTLSLSSSKPQRLFDSSFHGSSISASPVSVGLKPRSASTVSVRATAGYDLNAFTFAPIKESIVSREMTRRYMTDMITYAETDVVVVGAGSAGLSCAYEISKNPNVQVAIIEQSXSPGXGAWXGGQ

SEQ ID NO: 5589 - protein, 329 aa, Legionella pneumophila
MNKKTIAMLGAGSWGTAVAIHLAKIGHKTLLWSHNPQHVALMAEQHSNPAYLPGIPFPENLIPSDNLIECVQSANYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNRVEMPICEQINALLHGIVHAQEAVNNLMSRPAKEE

SEQ ID NO: 5590 - protein, 702 aa, Ostreococcus tauri
MRHRDLDASRSTTHAARARDRAIARAVSPAPRPSSRGVSRRAKGMRARDSRVTLGCLAISSSASGCNSHGTYPEIPGTHFKQSYCSPKTPPTSGAKNVRRGVTFASPRAKKPCLTTLTARSRDACARTVRGHARRRDPIAGSTDVGRRAGDGTPRRGHVASIETMSLARGRPSARPRGMMTSRARVEGGDGARATVVRPRASADREHGSLKKSRIGLCGLAVMGQNLALNVASKGFDISVYNRSGDKTETCVERAKKEGLGEKLRGYQDVGDFVDSLAKPRCVIILVKAGAPVDATIEKLSQFLEPGDCIIDGGNEWYENTERRAREVAEKGLLYIGMGVSGGEEGARNGPSMMPGGSREAYDIIADILKPVSAQTDSGACVTYIGPGGAGNFVKMVHNGIEYGDMQLISEAYDVLKTVGGLTNEELMAAFDDWNKAELESYLIEISSIILGKKDDQPGASGFLVDKILDKTGMKGTGKWTVQQAAELSVAAPTVASSLDARFLSGLKDERVAAEAFYAKLGLAPATAMGAADKKQLIKDVRYALYASKVMSYAQGMNLIRAKSNEQGWDLDLGEMARIWKGGCIIRAGFLDRIKSAYDRDAKLPSLLMDEQFAKEVIEREGAWRRVVTSAIAAGVAVPSMSGSLAYFDAYRRARSPANLVQGQRDFFGSHTYERTDMEGWYHTLWSDANSADSITTSGYKA

SEQ ID NO: 5591 - protein, 1139 aa, Populus trichocarpa
MKRSKVARQFPGHEDPVALASQTAFSVSEVEALFELYKSISSSVVDDGLISKIFELFDVKHKGVIDFSDFVRSLNVFHPNASQEDKIDFSFKLYDLDNTGFIERQEVKQMLIALLCESEMKLADETVEIILDKTFLDADVNRDGKIDKSEWENFVCRNPSLLKIMTLPYLRHLPSPTSARSMATRKNSDPSFSSSSSAPQWKYDVFLSFRGEDTRKKFTDHLYTALIHAGIHTFRDNDELPRGEDISSIISRPIQESRIAIVVFSKGYASSTWCLGELSEILACKSAIGQLAVPIFYDIDPSDVRKQTASFAEAFKRHEERFKENIEMVNKWRKVLVEAANLSGWHLQEMENGHEAKFIEKMVEDVLHKLNCKYLTVASYPVGIDSRVKDVVSMLSVYTDDVRTVGIYGMGGIGKTTIAKAVFNELCNEFEGSCCLLNIKEISEQPSGLVQLQEQLISDLIQSKTFKINNVDRGSALIKERLCHKRVLVVLDDLDQLKQLGALMGERNWFGLGSRVIITTRDEHLLTQLQVHNKYLVEELNHDESLQLFIAHAFKENRPTEEFLGISKGVVQYVGGLPLALEVLGSYLCKRSIGEWRSARKLQISFNALDDDDIKGIFLDITCFFIGMDVDYVSKLLDGCGFHSRIGIEVLMQRSLITTNWYNKLRMHDLLRDMGREIIREMSPDHPGKRRRLCFQKDVLDALRKKMFLNRLKILNLSYSVHLSTPPHFMGLPCLERIILEGCTSLVEVHQSIGHLDSLTLLNLEGCKSLKNLPESICYLKCLESLNISRCINLEKLPDQLGDMEALTMLLADGTAIERLPSSIGHLKNLSNLSLGGFKYDLSSVSWFSHILPWLSPRISNPRALLPTFTGLNSLRRLDLSYCGLSDGTDLGGLSSLQELNFTRNKLNNLPNGIDRLPELQVLCLYHCADLLSISDLPSTLHSLMVYHCTSIERLSIHSKNVPDMYLVNCQQLSDIQGLGSVGNKPLIYVDNCSKLANNFKSLLQASFKGEHLDICLRDSEIPDWFSHRGDGSSISFYVPDSEIQGLIVWIVCGASERRLPLPYASATIRNKSKGVRLFHWSTFIPLYYSKPAYHSWVNYVTFSRLPCAMEGGEVVEHSVKITNGVVVDKCGVHLISKE

SEQ ID NO: 5592 - protein, 396 aa, Myxococcus xanthus
MLEAVAASCSGGPAQHLDRLPSGAMVLNAYFLQEEATRDARRGAAESPVLEEVLAKASALGVRALRTNGHNDALSKVGDTAIQVAPLEYDEVALVGLDWVLTRARFHGVRLVLTLGNYWDAYGGARQYVEWAGLPRPVEGDARFFTDPVVVAHFKAHVARLLNRVNTVDGIRYGDHPAVLAWELLNEPRGRGLDKEGARLRAWIDDVAREVKTHAPGHLVGTGEEGFEPSPDGYDPGFWSRSGSPVLRTPGASFTRNTASPYIDFASVHFYPESWGLGGIDTAEAGARWIREHAAIARNLGKPLFVGELGLRNEGAFDVSQRRALYRGWLECMRKEGVGAGALWMFSTDARPEAWDDYTFYYRDGTQPGDPVNRYADLVMEAAAAERPGAAVSTGR

SEQ ID NO: 5593 - protein, 184 aa, Yersinia pestis
MSHPIYAISVQTIDHQLVKLAKYKGSVLLVVNVASQCGLTQQYEGLESLYKTYQKQGFEVLGFPSNEFAGQEPGSDEEIHAFCRGTFGVDFPMFSKIEVNGPHRHPLYQHLVTAKPVAVKPEGSEFYQRLASKGREPKQPGDILWNFEKFLISRDGTVLARFAPDMAPEAPILINAINQALASH

SEQ ID NO: 5594 - protein, 371 aa, Bacillus cereus
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 5595 - protein, 993 aa, Debaryomyces hansenii
MPIPRNDIEGISFISLITNKNEEFEESANFYNKLGFRLTKNFSKITNNSESKPKLQIGISNDSLKELWLESFPLQNTDENGFIRPWQELLVYDGDGCEKLNSATTLKIRLSTLDDLSNTAKELNFFTTDLPKVKDILTKDLNTEFESPSDTVIKVVDPMGNTLNFSNFENPLSEKSFDSPEDYLKYKTEKLLSSLDRLEHKSVEDQPTEKTKKKKKKIAIMTSGGDAPGMNSAVRAVVRAGIYYGCDVFAIYEGYEGLVQGGDLMRKMEWADVRSYLSLGGTAIGTARCAKFRERPGRLQGAHNMVENGIDALIVCGGDGSLTGADLFRSEWPSLVEELVSNGTFTTKEVEPYRHLTMVGLVGSIDNDMASTDSTIGAYSALERITEMVDYIDATASSHSRAFIVEVMGRHCGWLGLMSGLATGADFIFIPERPPKAGQWQNELKDVCSRHRQKGKRNTTVIIAEGAIDDDLNPITPDEVQKVLVALGLDTRITTLGHVQRGGTAVAYDRLLATLQGVDAVKAVLELTPDDPSPMIGSLENKIVRKPLIEAVKLTKSVATAIENKDFDKAMSLRDSSFEDAYHHFLSSSIYDDGLKILPEAERLNIGVVHVGASSSGLNAATRAAALYCMSKGHKLFAIQNGFSGLINEGEIKELSWLDVEGWHNKGGSEIGTNRSLPSEDFGNVAYYFQKFKLQGLIIIGGFESFSALNELDEKKQEYPIFNIPMVVIPATVSNNVPGTEYSLGGDTCMNQLLKYCDAVKQSASSSRRRVFVVEVQGGYSGFVASYCGLITGSLATYTPESKIDLKTIQEDIDLLYEVFEDDRGEYNNGKMIIRNEQASSVYTTDLIADIIKESAGGRFETRTAVPGHVQQGFTPTSMDRVNACRFAVKSCQYIEDWNTKLGGLILDMDATKTNRRSRSNVKNSIEHILEEKNGSAVVLGIQGAQIKFNSVEALFAKDANIPLRKGRVVHWTEMIEVADMLSGRLLLREKKQ

SEQ ID NO: 5596 - protein, 313 aa, Rhaphiolepis indica
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKTIYKPMGIYENAKVLFCIHNIAYQGRFPISDFSVLNLPENLKGSFDFIDGYNKPVKGRKINWMKAGILESDRVVTVSPFHAQELVSGEDKGVELDNIIRKTGITGIVNGMDVQEWNPATDKYLDTKYDNTTVLDAKPLVKEALQAEVGLLVDRNIPAIGFIGRLEE

SEQ ID NO: 5597 - protein, 313 aa, Rhaphiolepis indica
GGLGDVLGGLPPAMAANGHRVMTISPRYDQYKDAWDTEVTVELKVGDKTETVRFFHCYKRGVDRVFVDHPLFLEKVWGKTASKIYGPTAGVDFQDNQLRFSLLCQAALVAPRVLNLNSSKYFSGPYGEEVVFIANDWHTALLPCYLKAIYKPKGIYKAAKVAFCIHNIAYQGRFAFEDFALLNLPNEFKSSFDFIDGYDKPVKGRKINWMKAGILESDKVLTVSPYYAEELVSSVEKGVELDNIIRKTGIQGIVNGMDVQEWNPLTDKYTTVKYDASTVADAKPLLKEALQAEVGLPVDRDIPVIGFIGRLEE

SEQ ID NO: 5598 - protein, 716 aa, Oryza sativa
MASVDPSRSFVRDVKRVIIKVGTAVVSRQDGRLALGRVGALCEQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 5599 - protein, 313 aa, Sorbaria sorbifolia
GGLGDVLGGLPPAMAANGHRVMTISPRYDQYKDAWDTEVTIEVKVGDRTETVRFFHCYKRGVDRVFVDHPLFLEKVWGKTASKIYGPITGEDYKDNQLRFSLLCQAALEAPRVLNLNSSKYFSGPYGEEVVFIANDWHTALLPCYLKAIYKPKGIYNTAKVAFCIHNIAYQGRFAFAYFSLLNLPDEFKSSFDFIDGYDKPVKGRKINWMKAGILESDKVLTVSPYYAKELVSSADKGVELDNFIRKVGIFGIVNGMDVQEWNPLTDKYTTVKYDASTVTDAKPLLKEALQAEVGLPVDRDIPVIGFIGRLEE

SEQ ID NO: 5600 - protein, 313 aa, Sorbaria sorbifolia
GGLGDVLGGLPPAMAANGHRVMTVSPRYDQYKDAWDTSVLVELEVNGRTESVRFFHCHKRGVDRVFVDHPVFLERVWGKTGSKIYGPRAGEDYKDNQLRFILLCQAAPEAPRVLNLNSNEYFSGPYGEDVVFIANDWHSALLPCYLKTIYKPKGIYKSAKVAFCIHNIAYQGRFPFSDFSLLDLPDQLKGSFDFLDGYNKPVKGRKINWMKAGILESDKVVTVSPYYAQELVSGEDKGVELDNIIRTTGISGIVNGMDVQEWNPATDKYLDIKYDNTTVLDAKPLLKEALQAEVGLPVDRNIPVIGFIGRLEE

SEQ ID NO: 5601 - protein, 313 aa, Sorbus americana
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYENAKVVFCIHNIAYQGRFPISDFSVLNLPENLKGSFDFIDGYNKPVKGRKINWMKAGILESDRVVTVSPFYAQELVSGEVKGVELDNIIRKTGITGIVNGMDVQEWNPATDKYLDTKYDNTTVLDAKSLVKEALQAEVGLPVDRNISVIGFIGRLEE

SEQ ID NO: 5602 - protein, 379 aa, Glycine max
MFTKQMISSEIPMLMSKACEIFIQELTFRAWMHAEKNNKSIVQPCDVAKVIMQTDTMNFLTEIIPNNLGDFSVFDAKEENIANIAEENEVSLSFTAGFMGNPMMKMDSEENAGNIVEGNQATLPYTSGFMGNPMNMMNMDNEYNANGSQVALPYTAGFMGNPMMNMGNEENAINIAEGSQVALPYNADFVGNLMNMMQMGTEDNAGNLANGSQDALPCTAGFMGNPMMNMGSEENVRNIAEGSQASMPYTTGFMGNLMNMMQMDNEDYAGSQVALPYPGFMKNSAMNMEENVGNITEESQVVLPYTDGFMENHIDMMNMSYDLEAGNQLIPQPNMMQPPFMPSDQLPYNFQPNVRGTLLTLYHGPMNVGMHLPLPGVDE

SEQ ID NO: 5603 - protein, 182 aa, Arabidopsis thaliana
LPPPYLLRKIYHRRVNQPFSVVCCTGEPQQDIFTRRRTLTSLITFTVIGGATSSALAQEKWGTRSFIKEKYFMPGLSPEDAAARIKQTAEGLRDMREMLDHMSWRYVIFYIRLKQAYLSQDLTNAMNILPESRRNDYVQAANELVENMSELDFYVRTPKVYESYLYYEKTLKSIDNVVEFLA

SEQ ID NO: 5604 - protein, 307 aa, Bradyrhizobium japonicum
MGPTQKADSREHTLSRMLALLEEAAGRGASLVVFPELAFTTFFPRWLLEGEALDQYFERGMPNPAVAKLFDRARALRVGFYVGYAELTPDGRRYNCAILVDRDGEILGRYRKVHLPGSVEPRPGARYQQLEKRYFEYGDLGFPAFRAGSAWAHAIMGMMICNDRRWPESWRVLGLQGVELVCIGYNSAAYDPNGGATEDGALRTFHSTLVTQANAYMNATWAISVAKAGEEDGSGLIGGSCIVDPNGRIVAQAQTLADEVVVADIDLDLCRQGKDKMFNFAAHRRPEQYRVITERAGVIEPAVLDAD

SEQ ID NO: 5605 - protein, 614 aa, 'Chlorella' ellipsoidea
ELNLDDVGYDDVGGVRKQMAQIRELVELPLRHPQLFKTIGVKPPKGILLYGPPGSGKTLIARAVANETGAFFFLINGPEIMSKLAGESESNLRKAFEEAEKNSPAIIFIDEIDSIAPKREKTQGEVERRIVSQLLTLMDGLKARSHVIVMGATNRPNSIDAALRRFGRFDREIDIGVPDEIGRLEVLRIHTKNMKLDENAELELIGRDTHGYVGADLAALCTEAALQCIREKMDVIDLEDDTIDAEILNSMAVTNDHFKTALGISNPSALRETVVEVPNVNWEDVGGLEGVKRELQEVVQYPVEHPEKFEKFGMSPSKGVLFYGPPGCGKTPLAKAIANECQANFISVKGPELLTMWFGESEANVREILDKARQSAPCVLFFDELDSIANQRGSSQGDAGGAADRVLNQMLTEMDGMNSKKTVFIIGATNRPDIIDSALLRPGRLDQLIYIPLPDDPSRNQIFKAALRKSPVAPDVDINQLVKYTNGFSGADITEICQRACKYAIRENIEKDIEREKRLADNPDSMEEDVDEVPCITRAHFEEAMKYARRSVSDADIRKYQAFAQTLQQSRGFGSDFRFPDRPGQAPATTPAGQAAAPAFASGAAADDDDDLYS

SEQ ID NO: 5606 - protein, 274 aa, Gloeobacter violaceus
MSVVSLPQMLEAGVHFGHQTRRWNPKMRRYIFTDRNGIHIIDLTQTAHLLDEAYSYLREASDQGKKILFVGTKRQAAPVIAQEAKRCGMFWVNQRWLGGMLTNWDTIRTSVDQLKELETMEANGTLDLLPKKEASVTRKKLERLTKYLGGLKNMRRKPDILLVVDQRREQNAVMEARRLNIPIVSLLDTNCDPDLTDVGIPANDDAIRSIRLIVGKLADAIYEGRHGQLEDFSEEEPVPAAAPVAAVAVAVAAPAEAESEDKGEVLYSFDDEEE

SEQ ID NO: 5607 - protein, 356 aa, Raphanus sativus
MSLLTDLINLNLSETTDKIIAEYIWVGGSGMDMRSKARTLPGPVSDPSELPKWNYDGSSTGQAPGEDSEVILYPQAIFKDPFRRANNILVMCDAYTPAGEPIPTNKRHAAAKVFSQPDVVAEVPWYGIEQEYTLLQKDVKWPVGWPIGGFPGPQGPYYCGVGADKSFGRDVVDAHYKACLYAGINISGINGEVMPGQWEFQVGSAVGISAGDEIWVARYILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMEPYIVTSMIAETTILWNP

SEQ ID NO: 5608 - protein, 93 aa, Triticum aestivum
  misc_feature (68)..(68): Xaa can be any naturally occurring amino acid
PKNNSQLLNFSGCGNTLNCNHPVVMELVLDSLRHWVKEYHIDGFRFDLASVLCRGPDGSPLDAPPLIXEIAKDSVLSRCKIIAEPWDCGGLYL

SEQ ID NO: 5609 - protein, 827 aa, Vibrio vulnificus
MESIVIIGNGMVGHQLVEQLVATGSHLEKRIIVIGEERFVAYDRVHLSAMFSGQSHQDLLLSSEEWYQKHGIELILGVAVVGIDRQSKRVTLEDESQLSYDQLVFATGSYPFVPPMAGSERSKVFVYRTLDDLSQIKQACLGAKKGAVIGGGLLGLEAANALRLLGLETHVVEFAPRLMPVQLDEGAGAVLKSKIEQLGLTVHTSTATEKIIDGETAYHRMVFKDAPSLEVDVIVFSAGIRPRDQLARDCGLELGERGGIVVNNACQTSDSEIYAIGECALWQGKIFGLVAPGYAMARVVAQQLRGGSEAEFSGADMSTKLKLLGVDVASIGDAHKATPKATEMVLHDAAAGIYKKLVVDQSGTTLLGAILIGDNQDYDVLLQSYLNKTPLPQPVVSLLFDTSALKGDVSDNTVICSCHNVTKGDLISAIQAGAHELGELKAQTKAGSGCGGCSAMVKSVLDQQLSVMGLEVNTQLCEHFSQTRQALYHICQVEKIRDFDSLLAKHGKGHGCDICKPTAGSIFSSLWNEHIMEPEHSPLQDSNDAFMANLQKDGSYSIVPRIPGGEITPEKLIVLGEVARQYDLYTKITGGQRVDLFGAQVEQLPEIWQTLIDAGFETGHAYGKSVRTVKSCVGSTWCRYGVDDSVGLAIELENRYKGLRAPHKLKFAVSGCTRECAEAQSKDIGVIATEKGWNLYVCGNGGMRPRHADLLAADLSKAELITLIDRVLMFYVRTADRLQRTSVWLENLDGGLDYLKSVVLDDSLHLCEQLEQQMAHVVDTYHCEWQQTLTNPEKLMRFRPFINSTQQSTLLGYQRTRGQRIPVKLEE

SEQ ID NO: 5610 - protein, 416 aa, Herminiimonas arsenicoxydans
MWGHIMTNRRNFLGMAGSAVLAGNGLLMPKSVWSAITSLGPAGLPQGALDESMLAILPGKQALIKRTSRPPNYETPVEGLGDMFTPNGKFFVRWHLSVIPEIARDDWRLRIAGPSAGTEMALRYDELRRLPAVEVIAVNMCAGNRRGLSDPHVAGVEWGHGAMGNARWRGARLKDILHLARIRSDAIEVVFHGEDRGVIPQTPQFIKSLPIWKALDEHTILAYEMNGEPLPMHNGFPVRLIVPGWAGTYWMKQISEITVLPRAYDGFWMKTAYRIPTGKFPGLVRFQSQDTPNATSTPITELVVNSLITNLQDGQSIPYGQPLTVRGVAWDGGHGIAKVEVSIDGGRNWRPASMGRDYGNYSWRQWQFPFQPAQRGQYDIAVRAVGKKGETQSPVLIWNPAGYHNNVPHRVRPQVV

SEQ ID NO: 5611 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 5612 - protein, 323 aa, Burkholderia mallei
MPFVRALSESARARGFSALLPPSIIQTIGTARPAAPAALSTTLLFHPTPDVAYGFPNARRLARIESEYQEIEVWETSLLGRLFTLDGRPMTSVGDEFVYHECMTHPAALAHPAPKKALVLGGGDGGAARQLLRHPCIERIVVAELDAAVVDMARRFLGDVHQGALDDPRVELAIGDAARYVDHACEHFDLAVFDLTPPDSPAAGLYTPAFYTRLKRILTPQGAVSLHLGSPLYHGARIAALLAGLRERFAVVAPLCAHVPLYGSPWLMAIASDTLDAASLFSHDIDARLAERHIEGLRFYDAKLHSALFTLPHALRDTLGMHR

SEQ ID NO: 5613 - protein, 1034 aa, Saccharomyces cerevisiae
MLRTRVTALLCRATVRSSTNYVSLARTRSFHSQSILLKTAATDITSTQYSRIFNPDLKNIDRPLDTFARRHLGPSPSDVKKMLKTMGYSDLNAFIEELVPPNILKRRPLKLEAPSKGFCEQEMLQHLEKIANKNHYKVKNFIGKGYYGTILPPVIQRNLLESPEWYTSYTPYQPEISQGRLEALLNFQTVVSDLTGLPVANASLLDEGTAAGEAMLLSFNISRKKKLKYVIDKKLHQQTKSVLHTRAKPFNIEIIEVDCSDIKKAVDVLKNPDVSGCLVQYPATDGSILPPDSMKQLSDALHSHKSLLSVASDLMALTLLKPPAHYGADIVLGSSQRFGVPMGYGGPHAAFFAVIDKLNRKIPGRIVGISKDRLGKTALRLALQTREQHIKRDKATSNICTAQALLANVASSYCVYHGPKGLQNISRRIFSLTSILANAIENDSCPHELINKTWFDTLTIKLGNGISSEQLLDKALKEFNINLFAVDTTTISLALDETTTKADVENLLKVFDIENSSQFLSEDYSNSFPREFQRTDEILRNEVFHMHHSETAMLRYLHRLQSRDLSLANSMIPLGSCTMKLNSTVEMMPITWPQFSNIHPFQPSNQVQGYKELITSLEKDLCSITGFDGISLQPNSGAQGEYTGLRVIRSYLESKGENHRNVCLIPVSAHGTNPASAAMAGLKVVPVNCLQDGSLDLVDLKNKAEQHSKELAAVMITYPSTYGLFEPGIQHAIDIVHSFGGQVYLDGANMNAQVGLTSPGDLGADVCHLNLHKTFSIPHGGGGPAGAPICVKSHLIPHLPKHDVVDMITGIGGSKSIDSVSSAPYGNALVLPISYAYIKMMGNEGLPFSSVIAMLNSNYMMTRLKDHYKILFVNEMSTLKHCAHEFIVDLREYKAKGVEAIDVAKRLQDYGFHAPTLAFPVPGTLMIEPTESENLEELDRFCDAMISIKEEINALVAGQPKGQILKNAPHSLEDLITSSNWDTRGYTREEAAYPLPFLRYNKFWPTVARLDDTYGDMNLICTCPSVEEIANETE

SEQ ID NO: 5614 - protein, 374 aa, Psychrobacter arcticus
MSKRDFYEILGVSKTADNKEVKRAYRKLAMKYHPDRNSDDPDAEDKFKEASMAYEVLSSEEKRSAYDRMGHAAFENGMGGGGGGGNFQDIFGDIFGNFGDIFGQSRGGGGGRSRRGSDLRYVIELTLEEAVRGCKKEISFTAPAPCDTCDGKGAKNASDIVTCQTCHGQGQVRMQQGFFAVQQACPHCGGTGKQIKNPCSDCHGNGVKDKSRTLEVSIPAGVDDGDRVRLSGEGEAGGAGVQNGDLYVEVRVKPHNVFTRQGADLYMDVPISITDAALGKEVEIPTLDGKVKIKVAEGTQSGKLLRVRGRGVTPVRTTMKGDLICRVVIETPVNLTREQKDLLRQFQDTLDGDSKHQQSPHKKSFFKKIGDLFD

SEQ ID NO: 5615 - protein, 131 aa, Corynebacterium glutamicum
MTTSENFYDSVGGEETFSLIVHRFYEQVPNDDILGPMYPPDDFEGAEQRLKMFLSQYWGGPKDYQEQRGHPRLRMRHVNYPIGVTAAERWLQLMSNALDGVDLTAEQREAIWEHMVRAADMLINSNPDPHA

SEQ ID NO: 5616 - protein, 435 aa, Saccharophagus degradans
MRDLYAKRLSFDPMTVQDYMLTLGKQARAASRQMASADTGKKNAALLAIADAINSARDTIAAENARDMEAGRANGLDAALLDRLELTPERIDGMIEGLNQVAALPDPCGEITDLKYRPSGIQLGKKRTPLGVVGIIYESRPNVTVDAASLCLKSGNAAILRGGSEAIHSNKAVAVCIAAGLKAAGLPETAVQVVETTDRAAVGELITMTKYVDVVVPRGGKSLIERISADARVSVIKHLDGICHVYVDKTANLDKAFNIVINSKTHRYGVCNAMETMLVDEAIAADFLPRAAKEFAARGVELRGCEKTVALLTASDIPVVAALEEDWDTEYLAPILSIKLVANMDEAIEHINNHGSHHTDALVSENYTLARKFLTEVDSSSVMINASTRFADGFEYGLGAEIGISTDKIHARGPVGLEGLTSQKWIVFGDGHIRN

SEQ ID NO: 5617 - protein, 565 aa, Ehrlichia ruminantium
MENLQTSLESENYLQNIKKIKSNKFISHTLETEGYDNNNEDTEFQHALKEFMDSSVKEGQIIEGTIICIDKGYVTIDSGLKSESIISLKEFELGDDYQNIGVGSKVKLYLEKMEGRNGSVVLSREKAIRSELWQKLEEAAENKEDVEGVIFSSIKCGYTVDIKGVVAFLPASHVALRQVKDITPLLGKKQKFRILKMDKKQGNIVVSRKAILEESLADAKSLYLSQLNEGDIIEGKVKSITKYGVFIEIHESPSVGVVDGLLHITDISWSRVNHPSAVFSCGQTVRTKIIKIDRENKKISLGVKQLEESPWSNIEKKYPVDSVHKGIVTSIEEYGIFVELEVGIEGLVHVSEVSWTKSSLPINQLFMRGEEIQVKVLSIDTAKSRMSLSMKRCQDNPWEAFTLKYPLGSIVLTKVKNITNLGIFVSFQDETLNSGIEGLIRITELSWSLPPEAAVKKYSIGDSIEAKILMINTNKSKIDLGIKQLEYDPFLDLLKRTNLGDKIPVTVTKVVEDTGILVDVFNGSNSFNLLIEQEYLPDNKKFFPGDKLEAEVLLIETYNMILSLK

SEQ ID NO: 5618 - protein, 894 aa, Coccidioides immitis
MMLGTQNPYTAVLPSIPSAISSTYMTLPGKGQAGSMLNREGVFSSPTESEFSEGCDGFDSVRLWDEKKVADWLHSIRCGQYEAIFKANHFNGDNLLDCDQKILQEMGIKKVGDRVRISVAVKQLRTKSVSSRKKKNRDSFVALDSSRFTPPSAESPRPSTARQQPSNSRQWPRHENGKGSPRAASPLTEHDRGLRPYRYAGASPVESARREQGGSYFSRPSDPSQSSRAAAHMRQAPSIDGLTMGALPPNSPVIRVIYTGGQTKVLNVKHCKTAEEVMLAVLRKLLLPESHFRNYCFYVLDGLDPDPANCRRISDSELLQICDGSGRSERGRLILRKLHAGEPEAEELQRAAQLAMDENQVAHMNALSTTNVRNQIKLQKLTGESWHNIRQPRSPLTATDRHRDDYPKIATAKAGDRQQSTKLRSFFGARPPSEMIIHELTSYFPSHQKEDIEKTMRLSVRRSQRLSRAASRLSVVSNISLASSLKDAPPIPSIADTWLTGAGQQPTRGSRPLSVSRFNLPQASFRDSIASSNLQPLQEESPVEPNRKSYVSFDSASEIAGGESRQGFLDESICLNAPDTGGSLNERLSIIVAEDGEEDDDGLADFLAGNNFSNKNWMKGSLIGEGSFGSVFLALHAITGELMAVKQVELPSATKGTEFDNKKTTMVNALKHEISLLQGLQHPNIVQYLGTSTDDQYLNIFLEYVPGGSIATMLKQYNTFQEPLIRNFVRQILTGLSYLHSRDIIHRDIKGANVLVDNKGQIKISDFGISKRVEASNMLSAGGSARHLHRPSLQGSVYWMAPEVVRQTAHTKKADIWSLGCLVVEMFIGAHPFPDCSQLQAIFAIGNNKARPPPPENASKEATAFLDMTFEIDHEKRPSADDLLNDPFLETMIG

SEQ ID NO: 5619 - protein, 313 aa, Sorbus americana
GGLGDVLGGLPPAMAANGHRVMTISPRYDQYKDAWDTEVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKGIYKPKGIYKTAKVAFCIHNIAYKGRFAFADFALLNLPNEFKSSFDFIDGYDKPVKGRKINWMKAGILEADKVLTVSPYYAEELVSSVEKGVELDNIIRKTRIQGIVNGMDVQEWNPLTDKYTTVKYDASTVADAKPLLKEALQAEVGLPVDRDIPVIGFIGRLEE

SEQ ID NO: 5620 - protein, 385 aa, Kineococcus radiotolerans
MPSTEPGLAHTITDCDDRSGDATRAGRAVSPALPAPERRLHAVDVVVVGAGQGGLAAAHFLDRAGLSPGRGYVVLDAGEEPGGAWRHRWPGLRMDRVNGVHDLPGFPLGAVDPAAPAREVVPAYFAEYERRLGWPVLRPVAVEEVRSAGARLLVDSTAGTFAARAVVNATGTWTKPFWPSYPGRDSFRGRQLHTADYRGPEEFLGRHVVVVGGGISAVQHLEDLAGLGIATTWVTRREPDFREDFGVEARRAAVEVVARRVAAGEPPGSVVSATGLPLTPAVAALRESGVLKRHPAFARVVPDGVVWADGSAQEADVLLWATGFRPAVDHLRPLRLRERGGGILVEGTRAVREPRLHLLGYGPSASTIGAGRAAREAVREVLAGR

SEQ ID NO: 5621 - protein, 1187 aa, Xanthomonas campestris
MKRMLINATQAEELRVAIVDGQTLYDIDIEQPSKEQKKSNIYKGRITRLEPSLEAAFVDYGAERHGFLPLKEISRDYFQAGVDHNKSTIRELLREGQEVVVQVDKEERGNKGAALTTFISLAGRYMVLMPNSPSAGGVSRRIEGEDRAALKDALDKLDIPDDMGVIIRTAGVGRDAEELQWDLDYLLQTWKAIAEAALSKPAAFLIYQESRLIIRALRDYLRADIGEILVDTPELYADAQEFMQQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASTKHQREVENKLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEDSGKPSYQRGTPRKLPVHALTKAQLNIPVAPAVTSIKPSQPAPVREEAPAAAPAPAPVVALPLPAPVTGVVGWLKRIFGGVDAPAAAPEASQQQRPRQNDAARGNRNDRGERGGQRRDGRDARNGNGGQHRGNGGNGNGNGANKERRDERRQPTAPQTGNQPQQQQVQVAKPARNEPQAPKQPQQGQQPKQTKQQQNQQPRPPRQQDGAPAEKQQRPARQDDAAVAQAVTATAATATTASVAAAIADTATPVSRTVQAHETDAAHPVDVTVTPAASEAPADAAAEGHAQDAPAGDDGANGEGGSRRRRGRRGGRRRRRGAGATGEGGTGADGLESDDLDGDLDSDNDDAGTPAPTSSAPRAGQPEFDFDDDAGTPPARVQAKVERSPEQQTPVTPRPVPKERAETQPPADTAAAAAPSVNSAPTTPQQSVITAQSAPVASPEAAVSSQAGSSQAASQEPAAAPHAASASIEAAPAQEQQRAPVQDAPRVAPEAAAPAPAAVQSVRPEVTAPASPVQPAAPTQPAATASVEPSPAAQVTPAPVAPAEAAVVTVTAPHAEPSSTAGKDVDVAVTSTAAVAQPATDTAPAAPVRKPYAPVQTTLLDALAPQTPQAAAPQAQAETAPAAKVSEHSTPAAAVAPVAAQQPAEARQPTVVVSEASTPAAPSVDAADAADDKDDTEAAASKDDADKPRSDH

SEQ ID NO: 5622 - protein, 313 aa, Sorbus americana
GGLGDVLGGLPPAMAANGHRVMTVSPRYDQYKDAWDTSVLVEIEVGGRVETVRFFHCYKRGVDRVFVDHPLFLEKVWGKTGSKIYGPRTGVDYMDNQFRFSLLCQAALEAPRVLNLNSNEYFSGPYGDDVVFIANDWHSALLPCYLKTIYKPKGIYKNAKVAFCIHNIAYQGRFPLSDFSLLDLPNNLKGSFDFLDGYEKPVKGRKINWMKAGILESDRVVTVSPYYAQELVSGEDKGVELDNIIRKTGITGIVNGMDVQEWNPATDKYLDIKYDNTTVLDAKPLLKEALQAEVGLPVDRNIPVFGFIGRLEE

SEQ ID NO: 5623 - protein, 388 aa, Haemophilus influenzae
MIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIALILLNRFKVSALCAYMVVGAILWASVLKSGVHATLAGVIIGFSIPLKGKKGERPLDDFEHILASWSSFVILPLFAFANAGVSFAGIDVNMISSPLLLAIASGLIIGKPVGIFGFSYISVKLGLAKLPDGINFKQIFAVAVLCGIGFTMSMFLASLAFDANAGESVNTLSRLGILFGSTVSAILGYLFLKQTTKLS

SEQ ID NO: 5624 - protein, 163 aa, Kineococcus radiotolerans
MTSPLDVPLTALTGGPLDPAQLTGRAVLVVNVASRCGSTPQYAGLQELQEEYGERGFTVLGVPCDQFGGQEPGTEEEIAEYCSATWGTTFPMTAKVEVNGPGRHPLYGALTATPDADGTAGDVAWNFEKFLVSPAGEVVARFRTRTTPQDPALRAAIEARLPA

SEQ ID NO: 5625 - protein, 120 aa, Carboxydothermus hydrogenoformans
MKKIEALIRPQKLGEVKEALNKLGISGMTVTEVVGCGRQKGQKEIYRGIEYEINLLPKVKIEIVTVDEKVEEIIKIISESARTGAIGDGKIFISEVLDAVRIRTGERGTAAITSPKEGER

SEQ ID NO: 5626 - protein, 313 aa, Sorbus americana
GGLGDVLGGLPPAMAANGHRVMTISPRYDQYKDAWDTEVTVELKVGDKTETVRFFHCYKRGVDRVFVDHPLFLERVWGETASKVYGPVTGVDFKDNQLRFSLLCQAALEAPRVLNLNSSKYFSGPYGEEVVFIANDWHTALLPCYLKAVYKPRGIYSTAKVAFCIHNIAYQGRFASADFALLNLPDEFKSSFDFIDGYEKPAKGRKINWMKAGILESDKLLTVSPYYAEELVSAAEKGVELDNIIRKTGIFGIVNGMDVQEWNPLTDKYTTIKYDASTVADAKPLLKETLQAEVGLPVDRDIPVIGFIGRLEE

SEQ ID NO: 5627 - protein, 369 aa, Streptococcus pneumoniae
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYV

SEQ ID NO: 5628 - protein, 367 aa, Escherichia coli
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAEIKVGDNDNLSALAAILAGADKLLLLTDQKGLYTADPRSNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 5629 - protein, 320 aa, Desulfitobacterium hafniense
MTVDKTNLEIATFAGGCFWCMESVYSPLPGVLEVLSGYTGGHVENPTYNEVCSHTTGHREAIQIKFNPNIVSYKELLAFFWRQIDPTDPGGQFHDRGESYQTAIFYHSEEQRRLAEESKQALISSSHFDKPIVTEILPAAPFYPAEDYHQGYHQKNAFRYALYRQGSGRDAFINKHWAKEKEQLKKRLTPLQFHVTQEKGTEPPFQNEFWNNKQEGIYVDVVSGEPLFSSKDKFDSGCGWPSFTRPVLKSNIVEKIDLSHNMTRTEVVSRNSESHLGHVFDDGPGPDGLRYCINSAALRFIPKEDLEREGYGDLLRLFRD

SEQ ID NO: 5630 - protein, 571 aa, Thermosynechococcus elongatus
MAVTITKRPPRLTLQVLDIAPETTAIRCLDWDRDRFDIEFALENGTTYNSFLIKGERIALVDTSHAKFGDRYLEQLWQLVNPSDLDYLIVSHTEPDHSGLVKDVLVKAPHVTVVASKVALQFLGDLIHQPFTQQQVKNGDRLDLGKGHVLEFVMAPNLHWPDTILTFDHGTQTLFTCDVFGAHFCNDDPFDSEPELLAPDFKFYYDCLMGPNARSVLSAFKRLESLPPVQLVATGHGPLLRHHLDQWLESYRNWSQEQAKAATTVAIFYAANYGYSNALAEAIERGTAKTGVVVEKMDLLTAEPQDIRELTEIAAGIIIGTPPTTAVAKTALSTIRAAAHAKQAIGVFESGVADAEPAYPLLNQFRDAGLVPSFPVIRVTAAPTDALFQEAEEAGTDMGQWLLRDRTVKQMKALDTDLDKALGRLSGGLYIITAQKGAINSAMLASWVAQASTEPLGVSIAVAKDRAIESFLHVGDTFVLNVLEAENYQPLMRHFLKRFPPGADRFAHVKTYPASNGSPILADALAYMECTVVSRLDAHDHWIVYSTVDSGRVSKPDGMTAVHHRKVGNHY

SEQ ID NO: 5631 - protein, 313 aa, Stephanandra incisa
GGLGDVLGGLPPAMAANGHRVMTVSPRYDQYKDAWDTEVTVELKAGEKTETVRFFHCYKRGVDRVFVDHPLFLEKVWGKTASKIYGPIAGEDYKDNQLRFSLLCQAALEAPRVLNLNSNKYFSGPYGEEVVFIANDWHTALVPCYLKAIYKPKGLYKSAKVAFCNHNIAYQGRFAFADFALLNLPDEFKSSFDFIDGYDKPVKGRKINWMKAGILESDKVLTVSPYYAEELVSTVEKGVELDNFIRKAGICEIVNGMGVQEWNPLTDKYTTVKYDASTVTDAKPLLKEALQAEVGLPVDRDIPVIGFIGRLEE

SEQ ID NO: 5632 - protein, 387 aa, Thiomicrospira crunogena
MSKRDYYEILEVSATASEGEIKKAYRKLAMRYHPDRNPDDEEAEDKFKEASEAYEVLSDAQKRQAYDQFGHAGVDGSAGQGGFGGGGFADFGDIFGDIFGGGFGGGHRGPQPGSDLQYELEVSLEDAVAGTTVDVRIPTKELCESCDGSGAEPGSDVQTCPTCQGIGQVRVQQGFFAVSRTCPNCHGTGKLVKTPCKTCRGEGYKHSSKTLSVKIPAGVDNGDRIRLQGEGEAGEPGAPHGDLYVRIRVKEHKIFQRDGNTLFCDMPLSFATATLGGTMDVPTLNGKANLKIPAGTQSGQRFKLAGKGVKSVRSSHVGDMIVEVHIETPVKLTSEQKELLKAFDESLQGKHHKQHSPKTHSFFDSVKAFFKGDDEDGGNDKKDGPWN

SEQ ID NO: 5633 - protein, 417 aa, Escherichia coli [sequence omitted]

SEQ ID NO: 5634 - protein, 605 aa, Triticum aestivum
MAALVTSQLATSGTVLGITDRFRRAGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDWHTGLLACYLKSNYQSSGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPAKDKFLAANYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIMEGKTGFHMGHLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 5635 - protein, 313 aa, Stranvaesia davidiana
GGLGDVLGGLPPAMAANGHRVMTVSPRHDQYKDAWDTGVLAEIEVGGRVETVRFFHCYKRGVDRVFVDHPLFLEKVWGKTGSKIYGPRTGVDYMDNQFRFSLLCQAALEAPRVLNLNSNKYFSGPYGDDVVFIANDWHTALLPCYLKTIYKPKGSYKNAKVVFCIHNMAYQGRFPSSDFALLDLPDNLKGSFDFIDGYNKPVKGRKINWMKAGILESDRVVTVSPYYAQELVSGEDKGVELDNIIRKTGITGIVNGMDVQEWNPATDKYLDVKYDNTTVLDAKPLLKEALQAEVGLPVDRNIPVFGFIGRLEE

SEQ ID NO: 5636 - protein, 174 aa, Arabidopsis thaliana
MRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 5637 - protein, 950 aa, Unknown
  Rhodococcus sp. RHA1
MIDAGSRTFADRHVGPNAAELAHILELVGADSLDDLASKAVPAVILDGVTAGIADGLDALPAPVSEHEALAELSTLAAQNTVATSMIGLGYYDTLTPPVLIRNIIENPAWYTAYTPYQPEISQGRLEALLNFQTMVADLTGMEVANSSMLDEATAAAEAMTLLRRASKSKSPRFVVDADLFPQTLAVVETRAEPLGIEIVVADLSVGLPDGDFFGVLAQMPGGSGRIVDYTDVIAAAHERGALVAVGADLLALTLLTPPGEIGADACFGTTQRFGVPMGFGGPHAGYLAVHTKHARQLPGRLVGVSVDADGDKAYRLALQTREQHIRREKATSNICTAQVLLAILAAMYASYHGAEGLKAIALRVANTAHSLAAALRKTGAVVVHEHYFDTILVRVDGRAADVVAKAKDAGINLRLVDADHVAIACDEATTADDVTQVLAAFGGEGAVTEEVGTSVPDAQLRGSDYLQHEAFTRYRTETAMLRYLRALSDKDIALDRSMIPLGSCTMKLNATAEMEAITWPAFAGLHPFAPTGDTPGILRIIKDLENWLVAVTGYDAVSLQPNAGSQGEYAGLLAIRNYHLSRGDDHRDTCLIPSSAHGTNAASAVMAGMRVEVVACRPNGDVDLDDLRAKIADHAERLAAIMITYPSTHGVYEHEIADICAAVHDAGGQVYVDGANLNALVGLARPGRFGGDVSHLNLHKTFCIPHGGGGPGVGPIGVRSHLTPFLPGHPLAPELGTAGPISAAPYGSASILPITWAYIRMMGAVGLRRASLTAIASANYIARRLDEYFPVLYTGEGGMVAHECILDLRPITKDTGVTVDDVAKRLADYGFHAPTMSFPVAGTLMVEPTESENLEEIDAFCEAMIAIRAEIDRVGAGEWPVDDNPLRGAPHTSGCLVAEWNHPYTRETAVFPRGKARPKVWPAVRRIDGAHGDRNLVCSCPPISAFEGA

SEQ ID NO: 5638 - protein, 61 aa, Arabidopsis thaliana
PCVYYNYQRENVAKQGLPEQNGKTHIEAGDDRAQEYVSLSKSNDPIGYNTDDGLAWGSIGH

SEQ ID NO: 5639 - protein, 399 aa, Clostridium perfringens
MKHLNIKDDLFWVGALDPNLRVFDIIMYTPYGTTYNSYVVKGSEKTAIFETVKAEFFDQYIARLKDLGVEPSEIDYIVVSHTEPDHAGSIGKILELAPKAKIVASPIAINYIKEIVNGDFESIPVKDGDSISLGNKTLKFMSVPFLHWPDTIYTYVEEDKTLITCDSFGSHYSCEEMFDDLIPNEEEYMEALKYYFDCIMGPFKPYVLKALDKIKGLDIEIICPGHGPILRSNPYKVVNLYKEWSTPAPAKEVKKASIFYVSAYGYTKQLAEKIAEGIKSTGNLDINLFNIIEHDMTELVGEVGSSDAILFGSPTIVNELVEPVRDLMAKLNPVIHGGKIAGAFGSYGWSGEAVPRIESRLKELRMKMPVEGLRIKFKPSEEEAQKAFDFGVEIGNALK

SEQ ID NO: 5640 - protein, 443 aa, Oryza sativa
MAKRSSPDPASSSPSASSSPSSPSSSSSEDSSSPMSMPCKRRARPRTEKSTGKAKRPKKESKEVADPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGMAEYNLFEECNMLEKDISDFLDKDISDFLDKDISISDRERISPQANNISCPQKMISVCN

SEQ ID NO: 5641 - protein, 358 aa, Streptococcus suis
MTEKTIVFKVGTSSLTQENGSLDRIKIARITNQLAQLHQKGYQIVLVTSGSIAAGFRRLGFEKRPTKIAEKQASAAVGQGLLIEEYTQNLMKDGIVSAQILLTQDDFADARRYQNASQALQVLLKQRVIPIINENDTIAIEEIKVGDNDTLSAQVASLLKADLLVLLTDVDGLYTANPNSDPNAKHLPVITEITEDLFAMAAGAGSSNGTGGMTTKLQAAQIATKSGVPVFICSSKEDTALLQAVTQANRGTLFLADDHAMNQRKQWMAFYARTDAAVEVDAGAVDAMLHQGRSLLATGVKALEGDFEVGQVVEVYSQADHRLIGKGRVKLSSKDLQDQLANGRAEGVFIHRNDWVSL

SEQ ID NO: 5642 - protein, 275 aa, Geobacillus kaustophilus
MELWFTEKQTEHFGITARIIRTLHTEQTPFQKLDMVETAEFGNMLILDGMVMTTQKDEFVYHEMVAHVPLFTHPNPENVLVVGGGDGGVIREVLKHPSVKKATLVEIDGKVIECSKTYLPEIAGKLDDPRVEVKVDDGFMHIAKSENEYDVIMVDSTEPVGPAVNLFTKGFYAGIANALKEDGIFVAQTDNPWFKADLIRNVYRDVKEIFPITRLYTANIPTYPSGLWTFTLGSKKYDPLAVSDDRFHDIETKYYTKELHKACFVLPKFVADLVK

SEQ ID NO: 5643 - protein, 82 aa, Oryza sativa
  misc_feature (46)..(46): Xaa can be any naturally occurring amino acid
MESVGTTTSSLLKTYLAGARLPVVDSNPTEFVEPRTGRAICNSISXMTSLPPTTSTAIRFSPINEFIVSRERTRRFMTDMIT

SEQ ID NO: 5644 - protein, 412 aa, Streptococcus suis
MTTTQALLDSLLAHKASINLATTEQKNQALSAMADQLVAQTEAILAGNAIDMEHAQGKISQVMQDRLLLTAERIEAMADGIRALIGLPDPVGLILEESARTDGLNICKKSIPFGLVGMIYESRPNVTSDAAALAIKSGNAVILRGGKEAFHSAQAIVTALKAGLEEVGLSPKVIELVQDTSRASATELMTAKGKIDLLVPRGGAGLIQAVVENATVPVIETGTGICHVYVDKDADLDKALQIMVNAKTSRPSVCNAAEVLLVHEEIASQFLPRLEEALAGQVELRADSQAQALLNQATPAGEQDFDTEFLDFILAVKVVSSVEEAISHIDQHSTGHSEAIVTENSQTAEYFTLYVDSAAVYVNASTRFTDGGEFGLGCELGISTQKMHARGPMGLREMTTYKYIITGDGHIR

SEQ ID NO: 5645 - protein, 245 aa, Unknown
  Achromobacter sp. CM1
WHKTRKLEYLGADALAQGADTLITAGALQSNHVRQTAALAARLGLGCVALLENPLGTDDSNYIGNGNRLLLDLFDTRVELVENLDNADEQLQALAARLRSTGKKPYLVPIGGSNALGALGYVRAGLELAEQIKDTGLAFAAVVLASGSAGTHSGLALALSEALPDLPVIGVTVSRSDEDQRPKVQGLAERTAALLEVNLPSAFKVELWDEYFAPRYGEPNAGTLAAVKLLASQEGLLLDPVYTGK

SEQ ID NO: 5646 - protein, 332 aa, Vibrio vulnificus
MRHQLRVVHSAAQTIFCPCHRAAKPLIHSATKESIMDTSISTQLRDRSYSEHAISSHSLRGSQAKNRPTSTGTAASGFVYLVGAGPGDPELLTVKAVNALQQCDLLVYDRLVSKEILALVPEHVDKIYVGKRCGEPSLKQDEINQILVSFAQLGRKIVRLKGGDPFIFGRGGEEALALVEHNIRYCVVPGITAAIGCAASCAIPLTHREVARSVTLVTGTVVTGSLPAWSAIVEAGQTLVFYMGLESARAIEQGLRGQGVRADFPVAIVTQGSTPEQKTYVTTLATLEKTAVALKGVSPALIIMGEVVKLRERLKTTLAAVAPMANASFVDE

SEQ ID NO: 5647 - protein, 178 aa, Buchnera aphidicola
MKHTLQVIITEKELDIRVRELGQEITKKYRNSRNKMILIALLRGSFIFISDLCRRIHIEHEIDFMTTSSYGRGMLSSGDVKIIKDLDEDIYNKNVLIVEDIIDSGKTLSKVLDILKLRNPKSLSICTLLDKPECREVNINVDFIGFSILENFFIVGYGIDYAQSYRYLPNIGKVVFKK

SEQ ID NO: 5648 - protein, 537 aa, Arabidopsis thaliana
MDALSQAISSGISVPYKNNSSSLVPSHGLTSLILRKSRSPVNPSSRSRVSVRASEIQHSKTSASSIDLSDPDWKLKYEKDFEQRFSIPHITDVLPDAEAIRSTFCLKMRSPTEDFVGGYPSDEEWHGYINNNDRVLLKVISYSSPTSAGAECLDHDCSWVEQWIHRAGPREKIYFRPEEVKAAIITCGGLCPGLNDVIRHIVITLEIYGVKNIVGIPFGYRGFSDKDLTEMPLSRKVVQNIHLSGGSLLGVSRGGPSVSEIVDSMEERGINMLFVLGGNGTHAGANAIHNECRKRKIKVAVVGVPKTIDNDILHMDKTFGFDTAVEEAQRAINSAYIEAHSAYHGIGVVKLMGRNSGFIAMQASLASGQVDICLIPEVPFNLHGPNGVLKHLKYLIETKGSAVICVAEGAGQNFLEKTNAKDASGNAVLGDFGVYIQQETKKYFKEISTPIDVKYIDPTYMIRAVRANASDGILCTVLGQNAVHGAFAGYSGITVGIINTHYAYLPITEVIAYPKSVDPNSRMWHRCLTSTGQPDFI

SEQ ID NO: 5649 - protein, 880 aa, Vibrio vulnificus
MHGCSKTTCPYCGVGCGVEVKPDELVGDKEHPANHGALCVKGAALAESLNMPSRLLYPKLSGEQVSWELASDWIAQRFHQAMEEYGPDSVAMYVSGQLLTEDYYVANKLMKGYVGSANIDTNSRLCMSSAVAAHVRAFGEDVVPVSYDDLEHAELIVISGANTAWTHPVLFRRIQQIRENNPNVKLVVIDPRKTVTAEQADLHLPIANDSDITLFNGLLAYLLKQGSDKGIDTEFIDQHTQGFAALQALVSSGAYQLEQVASHCGIDVQALRTFYQWFSRSNATMTLFCQGVNQAQNGVDKANAIINAHLATGQIGKRGAGPFSLTGQPNAMGGREVGGLANQLAAHRGFDPDSIRAVQQFWQSPRIAEQPGLKALDLFKAVERGEIKVLWIMATNPVVSMPDNRWIRQALERCPCVIVSDITADSDVAHYADLLLPAAGWGEKQGMVTNSERRMSRQRRFISPPGEAKPDWQAICEVGARLSLKLQAKNGFAFESEAAIFREFAGLTAINSDSHYKLDLAQYQNLSDEAYEQWRPTQWGGESPYADGRFSHPDGKARFVAVTELANSSDEPIGRGLWRLNSGRQRDQWHTMTRTGHIEKLAASELEPSVYLNRLSAEKLELQAGELAYITNPQTLQSLLAKVVIDESMAFGELFMSMHWAGRYGGQSQVNAVVSATGDPISGQPAFKSSLVEVEKAPVVSFGVMISDFSPAIATNYCTYQHQDQSGVWRVASLTLPPQQLAEINLPAVSQVRRVSWQHELGWITLQLQSDTDEANQAKLQAIFIASSQPLKADYQQLLKLIGEPINWQALMHAGFATRVSQLVCSCLRVTDTQIEQAIEQKGVTTLTQLQNQLQCGTNCGSCIPQLKQYFAPAIAQPSR

SEQ ID NO: 5650 - protein, 139 aa, Arabidopsis lyrata
STGKRSEREEDTDPQGSRGISDDEDGDNSRKKLRLSKDQSVILEETFKDHSTLNPKQKQALAKQLGLRARQVEVWFQNRRARTKLKQTEVDCEFLRRCCENLTEENRRLQKEVTELRALKLSPQFYMHMSPPTTLTMCP

SEQ ID NO: 5651 - protein, 178 aa, Bacteroides thetaiotaomicron
MDTIQIKDKQFTVSIKEQDIQKEVIRVANEINRDLAGKNPLFLSVLNGSFMFTADLLKHITIPCEISFVKLASYQGVTSTGVIKEVIGLNEDIAGRTVVIVEDIVDTGLTMQRLLDTLGTRNPEAIHIASLLVKPEKLKVNLNIEYVAMEIPNDFIVGYGLDYDGFGRNYPDIYTVVD

SEQ ID NO: 5652 - protein, 146 aa, Glycine max
MAPKAGKKPAEKKPAAAAEKPAEEVAEKAPAEKKPKAGKKLPKEAIGATDKKKKRSKKSIETYKIYIFKVLKQVHPDIGISSKAMGIMNSFINDIFEKLAQEASKLARYNKKPTITSHEIQTAVRLVLPGELAKHAVSEGTKAVTK

SEQ ID NO: 5653 - protein, 497 aa, Burkholderia mallei
MFRQLFIGALPLSSSISIAPAVVWFCDDLRVSDHPALMRAAESGRPVIGVYVFDERAGGRPLGGAARWWLHGSLRALGAALAALGGTLALLRGDEHDTIVSFAAALGAGAVYWSRRYALAARAVDNAVQTALDAQGIAVETFNASLLFEPGDLVNADGRPYQVFSAYWRAAMRRGVPAPPLGAPRRLNGGALPAALARQCVALDALGLEPTGPDWAGGLRDAWRFGEDAAHRRLRAFVDSRLGGYAAERDRPGIASTSRLSPYVRFGNLSARQLWHAAADAYAHGAATQADLDKFLSELGWREFGWTQLHHFPDLPRRNLRHTLDGMPWRDDPAALAAWRRGATGYPFVDAGMRELWATGWMHNRVRMVCASFLVKHLLIDWRAGEAWFWDTLVDADAASNAANWQWVAGCGADAAPYFRIFNPVAQGRKFDPDGAYVRRWVPELAGLPPATIHEPWAAPGAQLAAAGVRLGETYPLPIVAYDAARRRALDAFGAIR

SEQ ID NO: 5654 - protein, 481 aa, Triticum aestivum
  misc_feature (124)..(124): Xaa can be any naturally occurring amino acid
  misc_feature (315)..(315): Xaa can be any naturally occurring amino acid
  misc_feature (382)..(382): Xaa can be any naturally occurring amino acid
MEDVAVAALATTPTPVFSPATAGLTLIAAAAAEPIAAVVAGAMEGVPVTFSVPPVRTTTDDGLPTATGGEGGEASAAGSPCSVTSDCSSVASADFEGVGLGFFGAGVEGGAVVFEDSAASAATXEAEARVAAGGRSVFAVECVPLWGFTSICGRRPEMEDAVVAVPRFFGLPLWMLTGNNMVDGLDPISFRLPAHFFGVYDGHGGAQVADYCRDRLHAALVEELSRIEGSVSGANLGAVEFKKQWEKAFVDCFSRVDDEIAGKATRGGGGNVDTSSVTAMAIADPVAPETVGSTAVVAVICSSHIIVSNCGDSRXAVLCRGKQPVPLSVDHKPNREDEYARIEAEGGKVIQWNGYRVFGVLAMSRSIGDRYLKPWIIPVPEXVTIVPRAKDDECLILASDGLWDVLSNEEVCDVARKRILLWHKKNGVNLSSAQRSGDSPDPAAQAAAECLSKLALQKGSKDNITVIVVDLKAQRKFKSKT

SEQ ID NO: 5655 - protein, 483 aa, Oryza sativa
MREEARTMVATRSTTSRRCLTWWWLACCCFVSWVASSSWTAAACVAVSSLPGFDGPLPFSLETGYVEVNESTGVQLFYYFVRSEKNPDLDPLLLWLTGGPGCSSISGLAHEIGPFQFAAKRYYSGGLPIIIYRPETWTKVSNIIFVDSPVGAGFSYAATEEGSKSSDTNAVKQLLIFLRKWLHDHPRFSLNPLYIGGDSYSGMIVPTLTLAIDESNGSEEKPFFNLKGYIAGNPVTDYKIDEDGRIPFLHGMGLISDELYEHAKETCGEKYSAPSNAQCAHSVQAINDDINRGHILEPLCEELQSPIHNTAARDVMSRLMLESRPAAADDDIIIFECRKASHVLLKIWANDETVRESLGVQKGTVGEWKRCNRDIDYNSDVRSTVEYHLTLMRKGYRAIIYSGDHDSRVPSISTQAWIRLLNLSIADDWRPWYVDGQVAGFTRSFASNNLTYATVKGAGHTAAEYKPKECQEMFARWISGTPL

SEQ ID NO: 5656 - protein, 473 aa, Pseudomonas fluorescens
MPVGNQLPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVVGGIGIIAFGFGNDGVALGISNLWSHGGFMPNGVTGVLMSLQMVMFAYLGVEMIGLTAGEARNPQKTIPNAIGSVFWRILLFYVGALFVILSIYPWNEIGTQGSPFVMTFERLGIKTAAGIINFVVITAALSSCNGGIFSTGRMLYSLAQNGQAPAGFAKTSNNGVPRRALLLSIFALLLGVLLNYLVPEKVFVWVTSIATFGAIWTWVMILLAQLKFRKGLSPAERAGLKYRMWLYPISSYLALAFLVLVVGLMAYFPDTRVALYVGPAFLVLLTVLFYLFKLQPTNVQQGSARSAS

SEQ ID NO: 5657 - protein, 941 aa, Mycobacterium bovis
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGAIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHADIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 5658 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5659 - protein, 456 aa, Unknown
  Vibrio sp. Ex25
MTALAVTLKNWFFTRNSMILNANIVLFIILFNTLPFEPQVVTGLSILVFVAILWLTEAIHVSITALLIPLLAVFLGVFNTQTALNNFSNSIIFLFLGGFALAAALHKQKLDQAIADKVLLLARGKMSVAVFMLFGVSAGLSMWISNTATAAMMLPLVLGVMTKLDAKKNHNTFLFVLLGIAYSASIGGIATLVGSPPNAIAAAEVGLSFTEWMKLGVPISLVLMPIAILVLYTMTKPDLSHKFDLDHQPVEWTNGKMITLAIFLLTVTLWIFSKPINAMLGGFAKFDTLVAIGAILLLGASRAVEWKDIEKTTDWGVLILFGGGICLSNVLKATGTSVFLAHSLSGFLEQAGILLTILAVVAFVVFLTEFASNTASAALLVPVFATIAEALGMSPVILSALIAVAASCAFMLPVATPPNAIVFGTGHIKQKEMMRIGFVLNIACIAALTLFAWLFW

SEQ ID NO: 5660 - protein, 719 aa, Bordetella pertussis
MFNKVTKTFQYGQHSVVLETGEMARQASGAVLVSVEDTVVLATVVAAKKAKAGQDFFPLTVDYIEKTYAAGRIPGGFFKREGKPSEKETLTSRLIDRPLRPLFPEGFYNDVQVVIHTLSVNPDIDPDIPAMIGASAALAISGIPFNGPIGAARVGYVDGQYVLNPTATQLKSSKMDLVVAGTENAVLMVESEAKQLSEEIMLGGVVFGHEQMQAAINAIHDLVRDAGKPDWDWQPAPKNEALIAAVSAAAQEGLNAAYQIREKQARTTKLREVYAAVQAAMAEQAAQAGQPAPDSVGVDNILFDLEARIVRSQILNGEPRIDGRDTRTVRPISIRLGVLPRAHGSALFTRGETQALVVATLGTKQDEQIIDALMGEYRDRFMLHYNMPPFATGETGRIGVPKRREIGHGRLAKRALLPLLPAPEDFQYTIRLVSEITESNGSSSMASVCGGSLAMMDAGVPTNDHVAGVAMGLILDSGKFAVLTDILGDEDHLGDMDFKVAGTETGITALQMDIKIQGITKEIMQVALAQAREGRLHILGKMRDALEGSRTELSAFAPRMLTIKINPEKIRDVIGKGGATIRALTEETGTQIDISDDGTIVIASVDETQAKEAQRRIVELTADVEVGQIYDGSVLRLLDFGAIVQVLPGRDGLLHISEIANYRIANINDVLKVGQPVRVKVIEADDKGRLRLSIKAIGGIEQQQSGTAEPAAQSEPQAE

SEQ ID NO: 5661 - protein, 335 aa, Magnetospirillum magnetotacticum
FRDDVRGYWKGDAGLLPGLASRITASADKFNKRGRRPWASVNFITAHDGFTLNDTVSYNEKHNEANGEGNRDGHGHNLSYNYGVEGPTDDPEIRSVRLRQMRNMLATLFLSKGTPMLLAGDEFARTQQGNNNAYCQDNEVSWVDWGAIGPEERDLAEFTQRLILLRNALPMLSRGRFVTGAYDEEFGVKDVTWLTPTGTEMTPENWNDGNSRTLAVLLDGRAQASGIHKRGGDATLLLFYNAYHDVVDFTFPEAPGGTAWTRLLDTNLPDSQEIASFAVGESYSVTGRSMLMFVLKPVESEGEDHTEMERSYQYVMQAFERANVESVSFGIDDEA

SEQ ID NO: 5662 - protein, 345 aa, Unknown
  Polaromonas sp. JS666
MDLSRFPRRRYTQGPTPLEFLPHFTEALRATCPEGSGPNIWIKRDDMLGLTPGGNKTRKLEFLAADALAQGADTLITCGAPQSNHCRATLCAAIKEGLKCRFVIEERVPNSYRENASGNNFLFRLLGVEAITVVPAGTNMMEAMQKVAADLAKEGRKGYIVPGGGSNAIGGLGYVACAQELQQQFFEQGVQIDKIVVGSGSSGTHGGLLAGFLGNHIHIPLIGIGVSRDPVDQDPLVHKEAQAVADLLGLNMTIPREAVVSYGDWWRPKYSVPNQAMVEAVQMLARTEAILLDPVYTGKIMAGLIGLARKGHFRRDENVLFIHTGGAPSLHAYEAEVLGLTELPA

SEQ ID NO: 5663 - protein, 165 aa, Zea mays
  misc_feature (108)..(108): Xaa can be any naturally occurring amino acid
IPSLIRRRRLLYAAVAGGEAPARCYRQIKNKPYPKARYCRDRPDPTIRIYDVGMKRKGGVEFHYCVHLASWEKENVSSEALEAARIAVNKHMTKSGGKDALHLRVRVXHPFHVLRINEMLSCAAADRLQTVMRGAFGKPHGTCARVAIGQGLLCCSTQGQQCMTC

SEQ ID NO: 5664 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFPSKLPWKETLSFRYQAEENSPKHIEEYFHNRMGEDFAEFGTVYQDYCEAMSTLSLGIMELLGMSLGVSREHFREFFNENDSIMRLNYHPPCQKPDLTLGTGPHCDPTSLTILHQDQVGGLQVFVDNEWRSINPNFDAFVVNIGDTFTALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5665 - protein, 1023 aa, Bifidobacterium longum
MTDVTHVDRASQAWLTDPTVFEVNRTPAHSSHKWYARDPQSGQWSDLKQSLDGEWRVEVVQAADINLEEEPATAESFDDSSFERIQVPGHLQTAGLMNHKYVNVQYPWDGHENPLEPNIPENNHVALYRRKFTVSAPVANAKQAGGSVSIVFHGMATAIYVWVNGAFVGYGEDGFTPNEFDITELLHDGENVVAVACYEYSSASWLEDQDFWRLHGLFRSVELAARPHVHIENTQIEADWDPEAGTASLDAALTVLNAADAATVRATLKDADGNTVWQTTGDAEAQTAISSGPLQGIAPWSAESPTLYELDVDVIDQAGDVIECTSQKVGFRRFRIEDGILTINGKRIVFKGADRHEFDAERGRAITEQDMIDDVVFCKRHNINSIRTSHYPNQERWYELCDEYGIYLIDEANLEAHGSWSLPGDVLTEDTIVPGSKREWEGACVDRVNSMMRRDYNHPSVLIWSLGNESYVGDVFRAMYKHVHDIDPNRPVHYEGVTHNRDYDDVTDIETRMYSHADEIEKYLKDDPKKPYLSCEYMHAMGNSVGNMDEYTALERYPKYQGGFIWDFIDQAIYATQPDGTRSLRYGGDFGDRPSDYEFSGDGLLFADRKPSPKAQEVKQLYSNVHIDVTKDSVSVKNDNLFTATGDYVFVLSVLADGKPVWQSTRRFDVPAGETHTFDVAWPVAAYRADARELVLQVSQRLAKATDWAESGYELAFGQAVVPADATATPDTKPADGTITVGRWNAGVRGAGREVLLSRTQGGMVSYTFAGNEFVLRRPAITTFRPLTDNDRGAGHGFERVQWLGAGRYARCVDNVLEQIDDSTLKGTYTYELATAQRTKVTVSYTAHTDGRVNLHVEYPGEQGGLPTIPAFGIEWTLPVQYTNLRFFGTGPEETYLDRKHAKLGVWSTNAFADHAPYLMPQETGNHEDVRWAEITDDHGHGMRVSRADGAAPFAVSLLPYSSFMLEEAQHQDELPKPKHMFLRVLAAQMGVGGDDSWMSPVHPQYHIPADKPISLDVDLELI

SEQ ID NO: 5666 - protein, 202 aa, Mycobacterium tuberculosis
MHVTQSSSAITPGQTAELYPGDIKSVLLTAEQIQARIAELGEQIGNDYRELSATTGQDLLMITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPNDFVVGYGLDYDERYRDLSYIGTLDPRVYQ

SEQ ID NO: 5667 - protein, 313 aa, Stranvaesia davidiana
GGLGDVLGGLPPAMAANGHRVMTISPRYDQYKDAWDTEVTVELKVGDKSETVRFFHCYKRGVDRVFVDHPLFLEKVWGKTASKIYGPTAGVDFKDNQLRFSLLCQAALVAPRVLNLNSSKYFSGPYGEEVVFVANDWHTALLPCYLKAIYKPKGIYKTAKVAFCIHNIAYQGRFAFADFALLNLPNGFKSSFDFIDGYDKPVKGRKINWMKAGILESDKVLTVSPYYAEELVSSVENGVELDNIIRKTGIQGIVNGMDVQEWNPLTDKYTTVKYDASTVADAKPLLKEALQAEVGLPVDRDIPVIGFIGRLEE

SEQ ID NO: 5668 - protein, 319 aa, Unknown
  Vibrio sp. Ex25
MSDVKHCKLLILGSGPAGYTAAVYAARANLNPVLVTGMQQGGQLTTTTEVENWPGDAEGLTGPALMDRMKEHAERFETEIVFDHINEVELSQRPFRLKGESGEYTCDALIISTGASAKYLGLESEEAFKGRGVSACATCDGFFYRNQKVAVVGGGNTAVEEALYLSNIASEVHLIHRRDSFRAEKILVKRLMDKVESGNIVLHTDRTLDEVLGDDMGVTGVRIKDVNTGATEDLEVMGAFIAIGHQPNTQIFEGQVDMKDGYIIVKSGLEGNATQTSIEGVFAAGDVMDHNYRQAITSAGTGCMAALDAERFLDSLGDK

SEQ ID NO: 5669 - protein, 313 aa, Stranvaesia davidiana
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPEGIYENAKVVFGIHNIAYQGRFPISDFSVLNLPENLKGSFDFIDGYNKPVKGRKINWMKAGVLESDRVVTVSPFYAQELVSGEDKGVELDNIIRKTGITGIVNGMDVQEWNPATDKYLGTKYDNTTVLDAKPLVKEALQAEVGLPVDRNIPVIGFIGRLEE

SEQ ID NO: 5670 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVSTNWLHQRSLS

SEQ ID NO: 5671 - protein, 245 aa, Cistanche deserticola
MTIRYWNINLEEMLEAGVHFGHGTRKWNPKMAPYISAKRKGIHIINLTRTARFLSEACDLVFDAASRGKQFLIVGTKNKAADSVAWAAIKARCHFVNKKWLGGMLTNWSTTEMRLHKFRDLRMEQKMGRFNRLPKRDAAVVKRQLSRLQTYLGGIKYMTGLPDIVIIVDQHEEYTALRECITLGIPTICLIDTNCDPDLADISIPANDDAISSIRLILNKLVFAICEGRSSYSSSYIRNPGLIIR

SEQ ID NO: 5672 - protein, 451 aa, Unknown
  Mycobacterium sp. MCS
MTETDHARDAVSADNLPSGGEFFHKGNYAPVADELTAFDLPVEGQIPADLQGWYLRNGPNPRQPSAHWFTGDGMIHGVRIENGRAAWYRNRWVRTESFEQHFPVYNSDGSRNLHSSVANTHVVNHAGKTLALVESSLPYEITNDLQTVGAYDFGGKLVDSMTAHPKICPTTGELHFFGYGNLFEPYVTYHRAAADGELTVNRPLDVKALTMMHDFAMTSGHVVFMDLPIVFDMGIALEGKGDMPYRWDDDYGARLGVLRRDDPFGEVRWFDIDPCYVFHVANAYEDGNTLVLQAVRYPELWRGTGGFEAEGVLWSWTLDLVTGTVRERQLDDRAVEFPRIDDRLAGLAARYAVSVGDQRLVRYDLTSGTAVEHAFGTADAPGGPGEAVFVPATSGPVDEQNGWYMAYVYDPQRDGSDLVILDAADFAGQPVARIKLPQRVPYGFHGNWITG

SEQ ID NO: 5673 - protein, 313 aa, Stranvaesia davidiana
GGLGDVLGGLPPAMAANGHRVMTISPRYDQYKDAWDTEVTVELKVGGKTETVRFFHCYKRGVDRVFLDHPLFLEKVWGKTASRVYGPVAGVDFKDNQLRFSLLCQAALEAPRVLNLNSSKYFSGPYGEEVVFIANDWHTALLPCYLKAVYKPIGIYSTAKVAFCIHNIAYQGRFAFADFALLNLPDEFKSSFDFIDGCEKPVKGRKINWMKAGILESDKVLTVSPYYAEELVSAVEKGVELDNIIRKTGIFGTVNSMDVQEWNPLTDKYTTIKYDASTVADAKPLLKETLQAEVGLPVDRDVPVIGFIGRLEE

SEQ ID NO: 5674 - protein, 245 aa, Cistanche salsa
MTIRYWNIDLEEMLEAGVHFGHGTRKWNPKMAPYISAKRKGIHITNLTRTARFLSEACNLVFDAASRGKQFLIVGTKNKAADSVAWAAIKARCHFVNKKWLGGMLTNWSTTEMRLHKFRDLRMEQKMGRFNRLPKRDAAVVKRQLSRLQTYLGGIKYMTGLPDIVIIVDQHEEYTALRECITLGIPTICLIDTNCDPDLADISIPANDDAISSIRLILNKLVFAICEGRSSYSSSYIRNPGLIIR

SEQ ID NO: 5675 - protein, 313 aa, Torminalis clusii
GGLGDVLGGLPPAMAANGHRVMTISPRYDQYKDAWDTGVTVELKVGDKTETVRFFHCYKRGVDRVFVDHPLFLEKVWGKTASKIYGPTAGVDFKDNQLRFSLLCQAALVAPRVLNLNSSKYFSGPYGEEVVFIANDWHTALLPCYLKAIYKPKGIYKTAKVAFCIHNIAYQGRFSFADFALLNLPNEFKSSFDFIDGYDKPVKGRKINWMKAGILESDKVLTVSPYYAEELVSSVEKGVELDNIIRKTRIQGIVNGMDVQEWNPLTDKYTTVKYDASTVADAKPLLKEALQAEVGLPVDRDIPVIGFIGRLEE

SEQ ID NO: 5676 - protein, 245 aa, Cistanche salsa
MTIRYWNINLEEMLEAGVHFGHGTKKWNPKMAPYISAKRKGIHIINLTRTARFLSEACDLVFDAASRGKQFLIVGTKNKAADSVAWAAIRARCHFVNKKWLGGMLTNWSTTEMRLHKFRDLRMEQKMGRFNRLPKRDAAVVKRQLSRLQTYLGGIKYMTGLPDIIIIVDQHEEYTALRECITLGIPTICLIDTNCDPDLADISIPANDDAISSIRLILNKLVFAICEGRSSYSSSYIRNPGLIIR

SEQ ID NO: 5677 - protein, 402 aa, Desulfitobacterium hafniense
MKANIAIVQAGGPTSVLNASLAGFLEAAASSERYHHVLGFCNGIEGLIKNQVMHLEGLSKAQLDALKSQPGAVLGAGRYPLTPERLSKVCCNLQLREISQLVLVGGNGTMWAADQIAEACPDVQVVGIPKTVDNDLWGTDHSPGYLSAAKFIGEAVRSLALDLWAMRNFERVRVVEVMGRNVGWLAAAGSLAQTSLPDYPPLHFYLPEHPFELEKFFTKVDEHLHRHPCLLVIVSEGIRLADGSPVAEFEIGRCKVPGGAAQMLSSELRNRGIPSRSEVLGILQRANTWSVCERDRQEAIFLGKQAIGVLGQGKSKVMLGLPAQTVDFAEDSKAQWVDLKSVAGLERPVAPCYLTESGIDPSFTAWLQNKMGEPLAEANSALQVWKLAAEQLSSNPVNRQSR

SEQ ID NO: 5678 - protein, 313 aa, Torminalis clusii
GGLGDVLGGLPPAMAANGHRVMTVSPRYDQYKDAWDTGVPVEIEVGGRVETVRFFHCYKRGVDRVFVDHPSFLERVWGKTGSKIYGPSAGEDYKDNQFRFSLLCQAALEAPRVLNLNSNKYFSGPYGDEVVFIANDWHTALLPCYLKAIYKPKGIYENAKVVFCIHNIAYQGRFPISDFSVLNLPENLKGSFDFIDGYNRPVKGRKINWMKAGILESDRVVTVSPFYAQELVSGEDKGVELDNIIRKTGITGIVNGMDVQEWNPATDKYLDTKYDNTTVLDAKPLVKEALQAEVGLPVDRNIPVIGFIGRLEE

SEQ ID NO: 5679 - protein, 277 aa, Carboxydothermus hydrogenoformans
MELWFTEKQTPNVGITCKITRTLHTETTPFQELAVIETLQFGRMLVLDGMVQTTVVDEFVYHEMIAHVALNTHPNPEKVMVIGGGDGGTIREIVKHPKVKKAVLVEIDERVIEVSKQYLPEIAVALMGNPKVEVRVEDGIKHVKEHKGEYDVIIIDSTEPVGPAVELFSEDFYKNVYESLKDDGIMVAQTESPFFNRDIIKNSFTRIGKNFPITRLYFATVPTYPSGVWTFTLGSKKYDPLAVKKEDIFVDPSNKYYNAEVHFGAFMLPNFIAEIIK

SEQ ID NO: 5680 - protein, 245 aa, Cistanche salsa
MTIRYWNIDLEEMLEAGVHFGHGTKKWNPKMAPYISAKRKGTHITNLTRTARFLSEACNLVFDAASRGKQFLIVGTKNKAAGSVARAAIKARCHFVNKKWLGGMLTNWSTTETRLHKFRDLRMEQKIGRFNRLSKRDAAVVKRQLSRLQTYLGGIKYMTGLPDIVIIVDQHEEYTALRECITLGIPTICLIDTNCDPDLADISIPANDDAISSIRLILNKLVFAICEGRSSYSSIYIRNPGLIIR

SEQ ID NO: 5681 - protein, 182 aa, Photorhabdus luminescens
MSTAKHHKLIILGSGPAGYTAAVYAARANLNPVLITGVEKGGQLTTTTEVENWPGDPEGLTGPGLMERMHQHAEKFQTKIIFDHIQKVDLQNRPFRLYGDEQEYTCDALIIATGASARYLGLPSEDAFKGRGISACATCDGFFYRNQKVAVVGGGNTAVEEALYLANIAAEVHLIHRRDTFR

SEQ ID NO: 5682 - protein, 1109 aa, Fulvimarina pelagi
MNEIVTAAALDPSGGIDPDAPDWYKDAIIYQLHVKTFADTNGDGVGDFPGLLSKLDYIQELGVTAIWLLPFYPSPLRDDGYDISDYRSVNPSYGTIEDVERLIEEAHKRGMKVITELVINHTSDQHPWFQAARHAPKGSPERDFYVWADDDKGYDLTRIIFTDTETSNWTWDPVAQQYFWHRFFSHQPDLNFDNPKVMEEVLSVMHFWLDKGVDGLRLDAIPYLVEREGTNNENLPETHDVLKAIRADLDEHYPDRMLLAEANQWPEDTRPYFGEGDECHMAFHFPLMPRMYMAVAQEDRHPITDIMRQTPEIPENCQWAIFLRNHDELTLEMVTEEERDYLWSTYAADSRARINLGIRRRLAPLMGNDRRKVELLNALLMSMPGTPVVYYGDEIGMGDNYYLGDRDGVRTPMQWSADRNGGFSRADPQRLYLPVIQDAIYGYQALNVEAQSKNPASQLNWVRRLIQVRRTKEAFGRGTIDFLLPSNRKILAYLREFGDEKVLIVANLSSSAQAVELDLSRHAGSTPVEMLGLSAFPQIGELPYMLTLPAYGFFWFDLSAAPSTNRIDAPTPLPAFSTLVAPGDLQSTIGGRNLTELKTVLPEFVGNQRWFAAKSEHPRRVDMKVLGPPTPDAKRHLFTEVVVPAKDGEQRYLMPLSVNWGEHNLSTQEPNLPYTVAKVRQGPKIGALVDGTRSGEFAKIVVSLIAADTNIDLVGGELVVEASKTEKEGLSQSLLVDTDAIRVLTGEQSNTSVMIGAQAILKYYRRLRDGIQPELEVTRFLTEKTDFDAAPALYGSIELVREDGTRTAIAALFEQIQNQGDAWTVIVDALSRYLRDHAYIHQGEGTGVQGEEAAAEQQLMIQIDPGEVLGRRTGEMHAALSTVTGDEAFDPEPFDDERYMKLVGEAKAEAKEALDILREAKPHLPSDEIEAVDRLVSAEKDILTWFDRFGGLKVRAHKIRIHGDYHLGQVLVAKNDVVILDFEGEPGRTLDERREKFSPLRDVAGMIRSFDYAAFAARDRAGPVDEQTAERLREMSLAWRDEVTEDFLQHWSTASGISLDDDAMGQLLDLFVLQKAFYELRYEAAMRPAWLSIPLRGIIALLEKRQVLK

SEQ ID NO: 5683 - protein, 321 aa, Arabidopsis thaliana
MASRIAKDVTELIGNTPLVLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 5684 - protein, 343 aa, Olea europaea
MAGVKSHFTIEMALVGLLILAILDFTVAQTGVCYGRLGNALPPPPEVVALYKQNGIRRMRIYDPYQPTLQALGGSNIELMLGVPNSDLQRLAANQNNANTWVQNNVRKYPNVRFKYIAVGNEVSPLKSVTSQFVQYVLPAMRNIQTAISAAGLGNQIKVSTSIETGVLGNSYPPSAGVFRSEVQQYLGGIIQFLVNNRAPLLVNIYPYFSRVGNPQQISLQYALFTSSGIVTPDGTRYQNLFDALLDAVYAALEKAGGSSVEIVVSESGWPSAGGQDTSIDNARTYNTNLVKSIKTGTPKRPGRAIETYIFAMFDENQKSPEYEKFFGLFRPNKQPKYPISFN

SEQ ID NO: 5685 - protein, 105 aa, Actinobacillus pleuropneumoniae
MTLQVTDATFEQEVLKSDVPVLLDFWAPWCGPCRMVAPILDELSEEFAGRAKIAKVNVDENQQIPAQFGIRSIPTLILFKNGEVVATQVGALPKSQLSAFVEQAL

SEQ ID NO: 5686 - protein, 847 aa, Salmonella enterica
MSKVRLAIIGNGMVGHRFIEDLLDKSDASLFDITVFCEEPRKAYDRVHLSSYFSHHTAEELSLVREGFYEKHGVKVLVGERAITINRQEKVIHSSAGRTVYYDKLIMATGSYPWIPPIKGSETQDCFVYRTIEDLNAIEACARRSKRGAVVGGGLLGLEAAGALKNLGVETHVIEFAPMLMAEQLDQMGGEQLRRKIESMGVRVHTSKNTQEIVQQGNEARKTMRFADGSELEVDFIVFSTGIRPRDKLATQCGLAVAQRGGIVINDTCQTSDPDIYAIGECASWNNRVYGLVAPGYKMAQVAVDHILGSENAFEGADLSAKLKLLGVDVGGIGDAHGRTPGARSYVYLDESKEVYKRLIVSEDNKTLLGAVLVGDTSDYGNLLQLVLNAIELPENPDSLILPSHAGSGKPAIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPQHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNLEGGIEYLKSVIIDDKLGLNEHLEEEMARLRAAVVCEWTETVNTPAAQVRFKHFINSDKRDPTVQVVPEREQHRPATPYERIPVTLVEENA

SEQ ID NO: 5687 - protein, 180 aa, Arabidopsis thaliana
MPTLYKKAGCQFQLTTMANSVMATEQLCYIPCNFCNIILAVNVPCSSLFDIVTVRCGHCTNLWSVNMAAALQSLSRPNFQATNYAVPEYGSSSRSHTKIPSRISTRTITEQRIVNRPPEKRQRVPSAYNQFIKEEIQRIKANNPDISHREAFSTAAKNWAHFPHIHFGLMLESNKQAKIA

SEQ ID NO: 5688 - protein, 119 aa, Clostridium perfringens
MKIALIAHDKKKEEMIELAKDFEDKLSKHILVATGTTGLKVMQNTSLDVKRCKSGPLGGDQEIGAMVANHDVDMVIFLRDPLTAQPHEPDISALLRLCDVYKVPLATNTESAKLIMADI

SEQ ID NO: 5689 - protein, 456 aa, Oryza sativa
  misc_feature (416)..(416): Xaa can be any naturally occurring amino acid
  misc_feature (444)..(444): Xaa can be any naturally occurring amino acid
MEARRISASPRPCSGRRVVARKRPRHEAAVNSVRKLQRREISSCRDRAFSMSAAQERFRNIQLQEEFDTHDPKENSLLLPYLRKRSKIIEIVAARDIVFALSQSGVCAAFSRETNRRICFLNGSPDEVIRSLFYNKNNESLITVSVYGSENFSALRCRTTRIEYIRRAKPDAGFPLFESESLKWPGFVEFDDVNGKVLTYSAQDSTYKVFDLKNYTLLYSISDKNVQEIKISPGIMLLIYTRTSSSVPLKILSIEDGTVLKSFNHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSNDSSSEENAGSINISNILTGKCLAKIKASDLCKQKKAXSSTSTALEALEDITALYYDEERDEIYTXGNRQGLVHVWSN

SEQ ID NO: 5690 - protein, 457 aa, Salmonella enterica
MDHLPIFCQLRDRDCLIVGGGDVAERKARLLLEAGARLTVNALNFIPQFTVWANEGMLTLVEGPFDETLLDSCWLAIAATDDDTVNQRVSDAAESRRIFCNVVDAPKAASFIMPSIIDRSPLMVAVSSGGTSPVLARLLREKLESLLPQHLGQVARYAGQLRARVKKQFATMGERRRFWEKFFVNDRLAQSLANADEKAVNATTERLFSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCHAGIPFSVVPGITAASGCSAYSGIPLTHRDYAQSVRLVTGHLKTGGELDWENLAAEKQTLVFYMGLNQAATIQEKLIAFGMQADMPVALVENGTSVKQRVVHGVLTQLGELAQQVESPALIIVGRVVALRDKLNWFSNH

SEQ ID NO: 5691 - protein, 417 aa, Pseudomonas syringae
MFSRDLTIAKYDADLFAAMEQEALRQEEHIELIASENYTSPAVMEAQGSVLTNKYAEGYPGKRYYGGCEYVDVVEQLAIDRAKELFGADYANVQPHAGSQANSAVYLALLQGGDTILGMSLAHGGHLTHGASVSSSGKLYNAVQYGIDGNGMIDYDEVERLAVEHKPKMIVAGFSAYSQILDFPRFRAIADKVGAYLFVDMAHVAGLVAAGVYPNPVPFADVVTTTTHKTLRGPRGGLILARANADIEKKLNSAVFPGSQGGPLEHVIAAKAICFKEALQPEFKTYQQQVVKNAKAMAGVFIERGFDVVSGGTENHLFLLSLIKQDISGKDADAALGRAFITVNKNSVPNDPRSPFVTSGLRFGTPAVTTRGFKETECKELAGWICDILADLNNEAVIDAVREKVKAICAKLPVYGA

SEQ ID NO: 5692 - protein, 1101 aa, Cryptococcus neoformans
MPESRMVHPHSHHLHSAHHHSSHPHSYQHPPPPNYSSSHPSYPHHHHTPRHVSNGHSSQVPLSGPPPPQMPIAGPPADPVGPPAIATSNAGSTRSRSVPPMSSEARAAKEKMDNILAQLAAANENTWMLIGAVAEGMNDQDRALSAFENALRHNPSSVLGLNAVASIARGRDDFDKAIEYFQRILNANPENGEVWGSMGHCLLMKDDLPKAYTSYQQALYHLANPKEPKLWYGIGILYDRYGSFEHAEEAFSSVLKVDPNFEKANEIYFRLGIIYKHQRKYKSSLDCFRYILNNPPRPLTSWDIWFQLGHVYEQDRDFEAARDAYMRVLSHQPDHAKVLQQLGWLYHQPGAHFADQEKAVSYLTKSLETDPSDAQSWYLLGRAYMAAQRYNKAYEAYQQAVYRDGRNPTFWCSIGVLYYQIAQYRDALDAYSRAIRLNPYISEVWYNLGSLYESCNNQMADAMDAYSRALELDPNNTVIKQRMALLQNPNGGPLPPVPPPIDVHPSQYTATPTAQPPAGSPNASPSHQLPSDAHAGGRDLPPPPPGGDIARGHSPGPFRNGAAPPPLNHVDEPRGPVPGMTQLARMETEPRSAEIRDERYNGRYDPADIRRHNGSPLSPRASRRESQAFPSQPSYFPSNGAHARDREREEWDRSRGGSRAPQGHSPRLGDRTPGADPRVPQEYRDYPGYYDPRTAYPAPLGGPPTPSAMPGRFDPRREAEEFRRREEDREVNGAKLASSARQENRMPSPAPSIASSKNGRKRGEGTRKAKDKEEKALNKKEGGRKGKAAGLKAGEEITGQSPRGNVKSPSVSVHNTPQLNTARPIPPSAPAPVPLMSRTVDEDYDEGAADALMVLAGDRSTTTLPLPVRHITPTPSGPMSPPPPAPNTGPATGAKRPGPEANSPEQANKRVKAEKSQSPVDSASGSASSRVPKRMVIEVLNTPSIASPLPRTSSAVNEEKQSRASQERREERREGTISGTEIDERTAQTSTPLPPPAPLSPANRLAPSSSAHTPQSPPRQASSPPPEAEKEASRPPTPPLPDEPPSPAAPAAAVRVESSRDSDPRTPPLPPSQTFESSSMKTPTSAGDRGDVDMADAGTER

SEQ ID NO: 5693 - protein, 455 aa, Debaryomyces hansenii
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFIAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 5694 - protein, 505 aa, Arabidopsis lyrata
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALT

SEQ ID NO: 5695 - protein, 713 aa, Bifidobacterium longum
MQIRPGSMYPLGASYDGAGVNFALYSQVAQKVELCLFDEHDVETRIEMTERNSYVWHNYIPGLHPGQRYGYRVYGPYDPVHGLRCNPNKLLLDPYAKAIEGNIDGDESLFSYWFKSPDDNSAMNDLDSAAHTMKSAVINPYFDWGNDQHPYISYHDSVIYEAHVRGMTNLNMDVPPDIRGTYAGLAYPSVIEYLKKLGITAIELMPIHQFVNDSFLQEKGLSNYWGYNTIGFFAPHNAYSSSGERGEQVNEFKSMVKAYHRAGMEVILDVVYNHTAEGNHMGPTLSFKGIDNASYYRLVEGDQQHYFDTTGTGNSLLMRSPHALQLITDSLRYWVTEMHVDGFRFDLAATLARQFQEVDKLSAFFDIVEQDPIISRVKLIAEPWDLGSGGYQVGGFPSSWSEWNGRYRDTVRDFWRSQPSTLPEFASRLMGSSDLYQVNGRRPVASVNFITAHDGFTMNDLVSYNEKHNEANGEGNRDGESNNRSWNCGVEGPTNIPDVNDLRQRQMRNMFATLLFSQGIPMICGGDEVARTQQGNNNAYCQDNEISWTNWHLDKGRKELLAFVSKLIHLRLDHPVLHRRRFFTGREPGDDSNTIPQVEWFDHTGSIMDMDDWQNTHAFSMMIYLNGSDIPEVDWYGNRMVDNDFILIFNAHYEPIMFTLPDERYGRKWQLVVDTHNPNEPALSYEAGFMITAQSRSFLMLMSAKKPKKPMGL

SEQ ID NO: 5696 - protein, 556 aa, Robiginitalea biformata
MCGIVCAFDLKQPAEDLRPQMLEMSRVLRHRGPDWNGIHMSDTAILAHERLAIVDPASGKQPLYSPDGNLVLAANGEIYNHQSLRKRFEGTYDFRTESDCEVILALYQEQGPAFLDELNGIFGFALYDSQADRYFIARDHMGIIPLYIGWDRHGTFYVASELKALEGTCTRIELFPPGHYMLSDQEGFQRWYSRDWMEYDAVEDNPTDIAALRKALEDAVHRQLMSDVPYGVLLSGGLDSSVTSAIAKKYAQKRVESGDQADAWWPQLHSFSVGLEGSPDLAAARKVADHIGTVHHEIKFTIQEGLDAVRDVIYHLETYDITTVRASTPMYLMARVIKSMGIKMVLSGEGADELFGGYLYFHKAPGPRDFHEETVRKLDKLHMYDCLRANKSLAAWGIEGRVPFLDKEFMDVAMRLNPRDKMITPERMEKWVVRKAFEDYLPESVAWRQKEQFSDGVGYSWIDTLKEVVAEAVSDEQLANAHFRFPIQTPTSKEEYYYRSIFESHFPSDAAAESVPQEPSVACSTRIALEWDEAFRNMNDPSGRAVARVHADAYEK

SEQ ID NO: 5697 - protein, 959 aa, Saccharomyces cerevisiae
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNVVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIKDNQAAIAEARAAEENFNADDKTISDTAAVVGVKGSHVVYNSIRQLYDYETEVSMRMPKVIHWQATRLIADHLVGRKRVD

SEQ ID NO: 5698 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTPIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5699 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 5700 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKDDKMVTPPHELVDTCNPRIYPDFTWPMLLEFTQKHYRADMKTLEVFTNWLHQRSLS

SEQ ID NO: 5701 - protein, 442 aa, Oryza sativa
MDSVVRTHIGHMLKMIHFCSMFLITFSDYKIQAILSSQQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTALLNMETADVQWDESLDTDVFLSEDVRTPSSHNQQPSAVGGPQMQVSDMHKP

SEQ ID NO: 5702 - protein, 321 aa, Aquifex aeolicus
MRIGILTAGGDAPGMNAVIRAVVRSAEREGHEVIGIKRGYKGLIEGDFIKLTSRDVGGILDRGGTILLSSRDPRYKKLEYREKAYKNLNEQGIEALIILGGEGTLAGAKLTAEETGIPVIGVPCTIDNDVGGTEYCIGYDTALRNAVDAIDKIRDTASSHERIFIVEVMGRNRGFIAVEAGLATGAELILIPEERFPREQIPEEIEKAKKLGKLHFIIVLAEGYCRAKELEDFLLEKIGDKYGEIRSTVLGHIQRGGIPTHFDRIMGTKFGVVAYESLIAGERSGFVAYEKGKFYIEDFEKAQEYKPIDREAYKLNTRLAI

SEQ ID NO: 5703 - protein, 313 aa, Waldsteinia geoides
GGLGDVLGGLPPAMAANGHRVMTVSPRYDQYKDAWDTSVLVEIEVNGRVETVRFFHCYKRGVDRVFVDHPSFLEKVWGKTESKIYGPKAGVDYNDNQMRFSLLCQAALEAPRVLNLNSNEYFSGPYGEDVVFICNDWHTALVPCFLKTLYKPMGIYKSAKVAFCIHNIAYQGRFAIEDFELLDLPNQLKSSFDFTDGYNKPVKGRKINWMKAGILESDRVVTVSPYYAQELISGEDKGVELDNIIRKTGITGIVNGMDVQEWNPATDKHLHVNYDETTVLDAKPLLKEALQAEVGLPVDRNIPLIGFIGRLEE

SEQ ID NO: 5704 - protein, 319 aa, Azospirillum brasilense
MPGSEFRGKIYDSILDTVGATPLVRVNRLAEDAGAKAQIVGKLEFFNPLASVKDRIGFAMIDAAERAGTIEPGRTTLVEPTSGNTGIALAFVAAAKGYRLILTMPESMSVERRKMLKLLGAELVLTPAAEGMKGAIRRADEIVATDPNAYMLQQFKNAANPEIHRNTTAEEIWKDTDGKADFLISGVGTGGTLTGVSEVLKARKPGFRTIAVEPEDSPVLSGGMPGPHKIQGIGAGFVPDVLKKDLIDEVVRISNQRAFETARKVAKLEGIPVGISSGAALAAALEIGSRPENEGKLIVVILPSFAERYLSTALFEGLE

SEQ ID NO: 5705 - protein, 389 aa, Glycine max
  misc_feature (38)..(38): Xaa can be any naturally occurring amino acid
  misc_feature (57)..(57): Xaa can be any naturally occurring amino acid
RRHADDDGDDGVAVAVVCAIAIKNAQNTERAKLKKLLXESYKRCRTDTTEGVSFTMXHIHRTPLYKYHLHAQMCTTVKGTVFATHNRRAYVDITAKSTAYLPLHEACIHRIKNVEEAGIIPGVREEFMIIDENQADDTLILSLRSIQYDIAWERCRQLKAEDAVVKGKVVNANKGGLVAQVEGLKGFVPFSQISSKSAGEELLEHVIPFKFVEVDEEQSRLVLSHRKAVAESQGQLGIGSVVTGSVQSIKPYGAFIDIGGISGLLHVSQISHDRITDIETVLQPGDILKVMILSHDRERGRVSLSTKKLEPTPGDMIRNPKLVFEKAEEMAQTFRQRIAQAEAMARADMLRFQPESGLTLSGEGILGPLTSDLPPEGVDLSEVPPAEDS

SEQ ID NO: 5706 - protein, 385 aa, Populus tremula
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5707 - protein, 317 aa, Aspergillus oryzae
MPFSHHSHSGEFCPSHAQNTLEQVIQTAILQGMEVFCLSEHMPRSSDELYEEEIEAGVTSSSMISNEAKYFMTAIQLRKKYASQIKILVGFESEWIRSDTSLRLIHDSLSRHPFEFFVGSVHHLHGIPIDWSRKLYSKAREVSGGTDERIFEDYFDVQFEMLQNLKPMIVGHFDLIRLHSDNPNASDGGFRSWTGVWQRVARNLRYISSYGGLLELNSAALRKGLEMPYPAAEVCQSQEFLALDGRFCLSDDSHGIAHVGAMYQEMLKYVEEQGIQKLYFLELAPDGTNQGLDPRFPRTLVKCRSLAEVKKMAYWKQ

SEQ ID NO: 5708 - protein, 715 aa, Unknown
  Mesorhizobium sp. BNC1
MFNHHKVEIEWGGRPLILETGKIARQADGAVLATYGETVVLATVVSAKEPKPGIDFFPLTVNYQEKTFAAGKIPGGYFKREGRPSEKETLVSRLIDRPIRPLFVEGYKNDTQVIITVLQHDLENDPDILSMVAASAALTLSGVPFMGPVGAARVGYVGGEYILNPHLDEMAETKLDLVVAGTSDAVLMVESEAHELPEDVMLGAVMFGHRNFQPVIDAIIKLAEVAAKEPREFLPEDLSALEAEMLKVVEADLRDAYKITNKQARYDAVNAAKAKVKEAFLPEGAEAYKWTPEQVATVFKALQAKIVRWNILDTGSRIDGRDLRSVRPIVAEVGVLPRTHGSAVFTRGETQALVVATLGTGEDEQYVDSLTGTVKETFMLHYNFPPYSVGETGRMGSPGRREIGHGKLAWRAVHPLLPAPEQFPYTIRVVSEITESNGSSSMATVCGTSLALMDAGVPLAKPVAGIAMGLIKEDDRFAVLSDILGDEDHLGDMDFKVAGTAEGVTSLQMDIKITGITEEIMKVALEQAKDGRLHILGEMANALSESRGELGEFAPRIEVMHIPTDKIRDVIGTGGKVIREIVEKTGAKINIEDDGTVKIASSNGKEIEAARKWIHSIVAEPEVGEIYEGTVVKTADFGAFVNFFGPRDGLVHISQLAPERVQKTTDVVKEGDKVFVKLMGFDERGKVRLSMKVVDQETGKEIVQEKKEEKQEAEG

SEQ ID NO: 5709 - protein, 276 aa, Magnetospirillum magnetotacticum
MIDRSDPQWYRDAIIYQIHVKSFFDSSNDGIGDFEGLTQKLDYVRDLGVTAIWLMPFYPSPLRDDGYDIADYRDINPSYGTMDDFRRFVDAAHERGLRVITELVINHTSDQHPWFQRAREAPAGSPERDFYVWSDTDDKYSDTRIIFLDTEVSNWTWDPVAKQYFWHRFYSHQPDLNFDNPAVLEAVIEVMRYWLDMGVDGLRLDAIPYLIERDGTNCENLAETHTVIKAIRAALDAEYPDRMLLAEANQWPEETAQYFGDGDECHMAFHFPLSSV

SEQ ID NO: 5710 - protein, 386 aa, Unknown
  Synechococcus sp. CC9605
MKRRRAFHAIFSNYPPEVDRQPPMSATPTEEQIQHQVQDANATEASAETVAADQAFEGEDLTIPEDVPTADDPSSRAASRSLDDAGFTIDEFAALLSKYDYNFKPGDIVNGTVFALESKGAMIDIGAKTAAFMPLQEVSINRVEGLSDVLQPGEIREFFIMSEENEDGQLALSIRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVVGTVRGIKPYGAFIDIGGVSGLLHISEISHEHIETPHSVLNVNDQMKVMIIDLDAERGRISLSTKALEPEPGDMLTDPQKVFEKAEEMAARYKQMLMEQAEEGEDPISSMMI

SEQ ID NO: 5711 - protein, 1008 aa, Glycine max
MRVLVLFFLFLHSLQAARISEYRALLSFKASSLTDDPTHALSSWNSSTPFCSWFGLTCDSRRHVTSLNLTSLSLSGTLSDDLSHLPFLSHLSLADNKFSGPIPASFSALSALRFLNLSNNVFNATFPSQLNRLANLEVLDLYNNNMTGELPLSVAAMPLLRHLHLGGNFFSGQIPPEYGTWQHLQYLALSGNELAGTIAPELGNLSSLRELYIGYYNTYSGGIPPEIGNLSNLVRLDAAYCGLSGEIPAELGKLQNLDTLFLQVNALSGSLTPELGSLKSLKSMDLSNNMLSGEVPASFAELKNLTLLNLFRNKLHGAIPEFVGELPALEVLQLWENNFTGSIPQNLGNNGRLTLVDLSSNKITGTLPPNMCYGNRLQTLITLGNYLFGPIPDSLGKCKSLNRIRMGENFLNGSIPKGLFGLPKLTQVELQDNLLTGQFPEDGSIATDLGQISLSNNQLSGSLPSTIGNFTSMQKLLLNGNEFTGRIPPQIGMLQQLSKIDFSHNKFSGPIAPEISKCKLLTFIDLSGNELSGEIPNKITSMRILNYLNLSRNHLDGSIPGNIASMQSLTSVDFSYNNFSGLVPGTGQFGYFNYTSFLGNPELCGPYLGPCKDGVANGPRQPHVKGPFSSSLKLLLVIGLLVCSILFAVAAIFKARALKKASEARAWKLTAFQRLDFTVDDVLDCLKEDNIIGKGGAGIVYKGAMPNGGNVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDSRLPSVPLHEVMHVFYVAMLCVEEQAVERPTMREVVQILTELPKPPSSKHAITESSLSSSNSLGSPTTASKEPKDNQHPPQSPPPDLLSI

SEQ ID NO: 5712 - protein, 339 aa, Bacillus pseudofirmus
DQVLKKDGTPYKVFTPYYKAWAKERKRTPAVIKRDVLLGSVHKGTAPDREAETLFNNLIKKCSYDWSAIGEEHAIKRLQMFTKKRLSGYKANRDFPSITGTSRLSPYIKTGAVSSRSIYYHILNAEADSYSAETFLKELAWRDFYRMVHFYEPDCKDREIMEGYRELNWSHDQDDLTSWKRGETGFPIVDAGMRQLLNEGWMHNRLRMITASFLTKDLLIDWRLGERYFERMLIDYDPSSNIGGWQWAASVGTDAVPYFRIFNPVTQSKRFDENGTYIRTYIPELNHVPDHYIHEPWKMSEEEQVKYKCRLDEDYPLPIVDHSKQRKKALSFFKGDDEE

SEQ ID NO: 5713 - protein, 443 aa, Thlaspi caerulescens
MSESQQDSEQYPPSKRQYHPSVSSMKPPLVAPGEYHRFDAAETRGGGASDQLKRKTDMVNQIEEPNELNTGVLQTPVSGKGGKPKKSSRSVKSNKTGTQASGSNAGSPGNNFAQATCRYDSSLGLLTKKFINLIKQAEDGILDLNKAADTLEGTKETDIRYTNVLEGIGLIEKTLKNRIQWKDLDVSKPGETVESIANLQDEIQNLTAEEVKLDDQIRESQERLTSLSEDENNKRFLFVTEDDIKNLPCFQNKTLIAVKAPHGTTLEVPDPDEAGGYPQRRYRIILRSTMGPIDVYLVSQFEEKFEEIPNADEPSNLPSTSGLPENQDVAMPMEEDSSDKNMETQEVDDTQRVYSEIESHDFVDGIMKIVPPDLDMDVDYWLRSEVGEVSITDLWPNESGADWNQIVTFDQDHAGPSNTTLEQPRTPLSPAPENSTATKSTGS

SEQ ID NO: 5714 - protein, 83 aa, Glycine max
  misc_feature (23)..(23): Xaa can be any naturally occurring amino acid
  misc_feature (40)..(40): Xaa can be any naturally occurring amino acid
MVRRSARCYRQIKKKPYPKSRFXRGVPDPTIRIYDVGMKXKGVDEFPFCVHLVSWEKEYVSSEALEAARIACNKYMAKFAGRM

SEQ ID NO: 5715 - protein, 236 aa, Solanum tuberosum
MGTPETSREPCPDRILDDVGGAFGMGAVGGSAFHFLKGIYNSPKGERLIGGTQAVRMNAPRIGGSFAVWGGLFSTFDCTMVYLRQKEDPWNSIIAGAATGGFLQMRQGLGAASRSAMFGGVLLALIEGAGIMLNKVMSAPQNFPPMDEPLPNVPGVPGYPPGQLPGQPMGKLPGQAPVSIDGMMTESSAPSSSSSTSWFGGLFGGGKKEETTSSGGSKTQVLESFDAPSPPTFEYK

SEQ ID NO: 5716 - protein, 1839 aa, Lachancea kluyveri
MSSPTDAERVNMRREKHPQIEETFEEHVHNAMPKFKKHYALGITTHTNDEDDDPRDHRQRGIHNPNFIHSPNDPRPPLSQPIKPRFSVHGTASNASVFSHGDIAPVRKTSRAGSLFKRLAGKKSTTSLLGTEHQQRQQQQSSNSLVPAAGLRRKMSTFIHGGSGSQSNESRGTRSSIFFPSTSNSRRGSATSTMTSGSRSSHPPDTPPITSQQQEQQYDQQRQQRPETREQEQKPPTLSDMPIVSRSPSFFMLDTDLNNLSDITNIISATPKNTESDEVRSTGANKTLKYPKPPLSSHKSTSASDLSHHKAQWTAPESWDIEEDANKLLATKRKAKHHHHYHHPQHPRPPHRKHYSNFSKPIEDKAVVEKEQEPPEKCPQPISTDSNDAQGLEIAKPIDESSGIQHSASTQSVSSFSSGATGASGATGKQIGGDQETESTISTVGEDEEVTNLRSIDSEQTDDTSFSKFDEEYDKAEYQLEKYYNDFSDVDLNRRYAIRIFNIDDTFTTLSCTPNTTLQDMMPQLKRKFNVGQGSYQVSLKVGKLSKILRPTAKPILIQRRLLLLNGYLKSDPLHIMGIEDLSFIFSFVFHPVATSHLNYEQEQRLSRGDFVHVDLRNMDLTTPPIILYQHTSDIESLDVSNNANIFLPLDFIESAIKLSSLRMVNIRASKFPANVTDAYKLVSLDLERNFIKKVPDSIFKLNNLTIVNLQCNNLERLPPGFSKLKNLQLLDISSNKFVNYPEVINSCTNLLQIDLSYNKIHSLPVSINQLVKLAKMNLFNNRLTSVGDLSQMKNLRTLNLRCNRVTSIECHAPNLQNLFLTDNRISTFDDDLTRLRTLELQQNPITSMVCGGNYMANMTSLSLNKAKLSSFSAELLSKLPRLEKLELNENNLTQLPPEINKLTRLIYLSVARNKLESIPDEISDLRSLKSLDLHSNNLRMLMNNLEDLELTSLNVSSNLLTGFHGSPAKFFASPSPKLAKSLLFLSVADNNLTDSIWPLVNTFQNLKTLNLSYNNFVEISDLKLQNLTELYLSGNNFTSLPGEAVQHLRSLKVLMLNGNKLLSLPAELSQLSRLSVLDVGSNQLKYNISNYHYDWNWRNNKDLKYLNFSGNKRFEIKSALDPEGKNDLSDLGILKQLRVLGLMDVTLKTSKVPDESVSIRLRTTASMINGMRYGVADTLGQSDSVCSRDVTFERFRGREDECLICLYDGKNENASSGHKISKIIRDIYDKILIRLLEKYGEESDGIKRALRYSFLQLNKEINGMLVSVEDGNTDSGLTSADLLSGSSATVVYLKGKKIYTANIGDTMAVLSKNNGDFVTLTKLHVPAEREEYERIRTSGGYVNNQKLDGVSEVSRAVGFFDLLPHIHASPDISETVLSYSDEMLIIATHKLWEYLDYETVCDISRENKSQPMSAAEKMKDYAISYGCSDNITILCVSLDKSVNQQSQFTLNREDLISRKNTFEDTVLRRLQPEIAPPTGNVAIVFTDIKNSTFLWELFPDAMRAAIKTHNDIMRRQLRIYGGYEVKTEGDAFMVAFPTPTSALVWCLSVQLKLLEAEWPEEITSIQDGCLITDNSGTKVYLGLSVRMGVHWGCPVPEIDLVTQRMDYLGPVVNKAARVSGVADGGQITLSSDFCSEFKKIMKFHKRVVENQEPLKEVYGEDFIGEVLEREIHMLENVGWVFKDLGEQKLKGLETKEFITIAYPKTLASRHDLATKNQNSSVLNDDLLFQLRTISNKLENILSSINGGLIESETPGNSSIYMTFDKNTKDAVITKSTESDWISFLDHLVTRVESTVAILQLRQKLQGGLELYTSSDSTMHKSVFELLDEILKIQTDQKQ

SEQ ID NO: 5717 - protein, 513 aa, Unknown
  Synechococcus sp. WH 8103
MLGDLWSFQGRYRTLHLTWIAFFLTFVVWFNLAPLATTVKADLGLTVGQIRTVAICNVALTIPARVLIGMLLDKFGPRITYSSILVFSAIPCLLFASAQDFNQLVVARLLLSIVGAGFVIGIRMVAEWFPPKEIGLAESIYGGWGNFGSAFSALTMVALAGFLSFSGGFEMPTGTVLNWRGAISLTGIVSAVYGLFYFFNVTDTPPGKTYQRPEKTAGLEVTSMRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAAFNSAFFQILGVAGLIVAFFCFFFLKEPKGSFAELHEGETA

SEQ ID NO: 5718 - protein, 414 aa, Herminiimonas arsenicoxydans
MFSKDQTLAKTDTELWSAIQQENTRQQDHIELIASENYTSPAVMEAQGSQLTNKYAEGYPGKRYYGGCEYVDIVEQLAIDRVKKLFGAEAANVQPNSGSQANQGVFFAVLKPGDTIMGMSLAEGGHLTHGMALNMSGKWFNVVSYGLNDKEEIDYEQMERLAREHKPKMIIAGASAYALRIDFERFAKIAKEIGAYFMVDMAHYAGLIAAGEYPNPVPYADFVTSTTHKSLRGPRGGFILMKAEHEKIINSAIFPGIQGGPLMHVIAGKAVAFKEALAPEFKVYQQQVLKNADALAKALIARGLRIVSNRTESHVMLVDLRAKKITGKDAEALLGSAHITTNKNGIPNDPEKPFVSSGIRLGSPAMTTRGFKEAEATKVGNLIADVLDNPNDAATIERVKAEVKKLTDAFPVYG

SEQ ID NO: 5719 - protein, 148 aa, Oryza sativa
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIREISDELCKGSVKIAVV

SEQ ID NO: 5720 - protein, 1612 aa, Debaryomyces hansenii
MYDDPESIANMGMPPSTQNRIASDGVIYSNQHMSGYMMHPNRNNEFIPHKDNLDNCIDERKLSLPYPSNDNFGTLLQDETSTPNKQNIQVTTNNSSSPIQSDHKDLKSFSFSEQNDSIQEFQVSPIKEDPPRLSRRAFDGFPRDEVSNENSRSARPYSPAPNSSGSDNSNAIGLIIGGYDYSKSSLELASKDNNNNFHNDRKSNTLIQRDDDPTGQFCLTNNPLQSNEVDINVKVHNRNSSESSTVSNTSTTSTITPSTISKGKRFVRYAMNTQSKSSMTNTSTKWHILNVLKWLDYYGFNSSWQETFRRNEISGNRFLELCNYEVDSMIWKQFSKYLVLDNENNSIERFIELLKGHLSTSEPVDDYNANKEYQMQSHSRKGSNESHLSPVLPNSTAENRKSVPIFHKRKSVSISAAYGSSSLNNNIASSGNQRPVSYVDIGSQKPSKDLQSHHKFFRKSKSSYSDIPQTYTGINNISIAPSNNQNISGHRKSNSRTSLSLNDDFIVDSNKIKYTGAPLLKTSSLQNFPTPNNEAIPATTYGRKSGLFSTLKKYSSDKAVGIVKQVQNTSSSSATKTSGINKSNSKNVVSPVSPVEFRELLLPKAKQNITQSNAEQESTNTTTMDDINTRSIAMSSDETLPSPLMNSSAKVINFNNNTYIDLIKKADLLDNLDEKYLPTLHDSFVDKKMILASKDNKHFTPINLTREEIRNIELIRNRVIQELELIDVGIITFHLTEFNSTEGIALKDDVLLDVIRTDILVKLFVNQELTSDTTTTFSTTSSDSKSFELIGENNDERSYPSTPQYLLQNARDPKVDYWNFKDTNNDKLSSISEINSTRAGRKSPSNPQFSMKLHLPENKKFSQDSKPPSLLINTTQIDNSLPSLSPNSSKLSDSHNSFKILRKEGREIDFDKRRKSPYESKAPKLIPNIYSSSVSNPSKSPISATTIATLKDENVESNHNKLSPSISSGSMDRDKSGSIVAKRIAPPPPLDRKLSVIGSHSLKKASILPSISTLSKTLSYSSRSPSGSERSMGSRKAFNKRKGSTSSKNSFVTDDSFAFRENDVSFDDVPTVQRDNNASSDDEDFFVKPIKNQKSNVNDDDNESDEDFFMKPIRSPDSEAPKETLKRRTLTDPISIKMNVRPPVEEVYRNLEKYFPNTNLDKPIIDDSPVSPVNKHQPSIEASNAIPMRKPTISRTFSNANMSPVHPKLDSGDEILYAENQEPTLSRRRMKTIRVVANEARKKRLERQNSPQAGRSLESSYCNTPNSGNFNSLNRTNTKLWGQKVVEVTSTEIEKGFVSKLKNGKHGEFEEFAWIKGELIGRGSFGAVYLALNVTTGEMLAVKQVIVPNDFQNGSPKVSEGIDALHKEVETMKDLDHLNIVQYLGFEQKKNIYSLFLEYVAGGSIASCMKSFGRFEEPLIKFIIKQVLLGLEYLHSNGILHRDLKADNLLLEIDGTCKISDFGISKKSKDIYVNNAEMSMQGTVFWMAPEVIDSIVADKKQGYSAKVDIWSLGCVVLEMFAGKRPWSNEAVVSAIYKIGKTKLAPPIPDDITHLISDEARSFIGRCFTIDPEERPTARDLLGDPFISNESKFSFETTRLAQMIKDNYKKYNI

SEQ ID NO: 5721 - protein, 423 aa, Burkholderia mallei
MDIDQYMTDVGRRARRASREIARASTAAKNAALEAVARAIGRDADALKAANARDVARAKDKGHDAAFVDRLTLSDKALKTMIEGLRQVATLADPIGEMSNLKYRPSGIQVGQMRVPLGVIGIIYESRPNVTIDAAALCLKSGNATILRGGSEALESNTALAKLIGEGLAAAGLPQDAVQVVGTADRAAVGKLITMTEYVDVIVPRGGKSLIERLINEARVPMIKHLDGICHVYVDDRASVAKALAVCDNAKTHRYGTCNTMETLLVARGIAPAVLTPLGRLYREKGVELRVDADARAVLEAAGVGPLVDATDEDWRTEYLAPVLAIKIVDGIDAAIEHINEYGSHHTDAIVTEDHDRAMRFLREVDSASVMVNASTRFADGFEFGLGAEIGISNDKLHARGPVGLEGLTSLKYVVLGHGEGRE

SEQ ID NO: 5722 - protein, 491 aa, Bifidobacterium longum
MAENNTEVTKVAINDIGTEEDFIKAVDSTIKNFDDGDLVEGTVVKIDHDEVLLDIGYKTEGVIPSRELSIKKDVDPDEVVEVGDTIEALVVTKEDKEGRLILSKKRAQYERAWGDIEKIKEADGVVEGTVIEAVKGGLIVDIGLRGFLPASLVEMRRVRDLSPYIGQKIKAKILELDKNRNNVVLSRRQYLEETQSEVRETFLSQLKKGQIREGVVSSIVNFGAFVDLGGVDGLIHVSELSWKHIDHPSEVVKVGDKVTVEVLDVDLDRERISLSLKATQEDPWQRFARTHVPGQIVKGKVTKIVQFGVFISVEDGIEGLVHISELANRHVENPETVVKPGETVFVKVIDVDLDRRRISLSLKQANDSVDPASEDFDPAIYGMPAEYDEQGNYKYPEGFDPNTNEWIAGYEKQREEWESQYAAAHELWEEHKEFVAKELENAAESAAADGQGPKEEKPVEETSNYSSAAPTTGTLADSDQLAALRDQLLGK

SEQ ID NO: 5723 - protein, 757 aa, Burkholderia thailandensis
MREFDYLLVGGGIASVTAARTLRGENAPASIAILCGEPVLPYQRPPLSQEFLMGAAQPASIALHDAAFYASQRIDVVLGARAEHLDLAKRIVRASNGGAFRYRKLLIATGASAKVPALPGIGLDGVHVLHTVAQAQALKDATAHARRATVLGGGFLGVEIAATLRALGLQVTLIERAPDVMPTLRAPALASRFEALCKARGIDVLTSREVRRVLGAQRVEAVETSDGGTHPCDLFVAAVGVTPNCGWLDGSGLALGDGIEVDAFLQTADPDVFAAGDVAHFDDPIFGVRRRIEHWDNAVRQGRIVARNMLGYRLPYRDVSIFYGSVFGLSYNLLGYPVGATETIERGSFDDASYTLLYLADDVLRAAFTIDRPAVEIAAMNDAVRLHVNVAEQKSKLSDPNFALDKLPVQTILILQGGGALGAFECGAIKALEQHGVRPDVISAVSIGAFNGAIVASHPKGASKALEAFWRELSISLPLPHGSQWHQAWLSSYVLSCGVPNFLKPQWSQLGFGADQLRAKWTSFFDASSIEKLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKTLPTNIVEVMLRREEIAYMDRVRNDLRLEEYASDFRDLVDGILAHVDAPTANEIRQQPLYIRLMGNRAALDIARITLNRDGRLSFIEDYDFSSDAIAQLQTQGYDAALAALANDRALRRRGRRAA

SEQ ID NO: 5724 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5725 - protein, 305 aa, Legionella pneumophila
MSKIAVVINPIAGGGRGKKVWKVLKPGLHALFEQTVYRISNRVNDLETITDGLLAENPDSLLIIGGDGTLNHVLNGLIEKDKLKNPQTKIAFFNAGCGGDFTRQFPQQKMTEFLDRLSHNQFIKCDIGKITLANQVSRYFINIASCGLSGHVVLRVSKSKWLKKLGGTLNYLLHALTGLMTYRKTKVRVQIDDALPFDSSILLMAVCSGQYFGGGMHVAPMAKMNDGLFDVVSFNEFSKLNALLKLYKIYSGGHLLDNNVHYVQTKKIKIEPLEESKIEIEADGEIIGCLPAQFELIKETLPLII

SEQ ID NO: 5726 - protein, 152 aa, Oryza sativa
  misc_feature (116)..(116): Xaa can be any naturally occurring amino acid
  misc_feature (129)..(129): Xaa can be any naturally occurring amino acid
  misc_feature (133)..(133): Xaa can be any naturally occurring amino acid
  misc_feature (137)..(137): Xaa can be any naturally occurring amino acid
  misc_feature (139)..(139): Xaa can be any naturally occurring amino acid
MSLTNCRFYEEKYPEIDSFVMVNVKQIAEMGAYVKLLEYDDIDGMILLSELSRRRIRSIQKLIRVGRNEVVVVLRVDKEKGYIDLSKRRVSPEDIVKCEERYNKSKMVHSVMIHLXQATEIPLETLYQXIAWXLKQXFXHALDAFKLSITNP

SEQ ID NO: 5727 - protein, 317 aa, Kineococcus radiotolerans
MGTGMSSTGAVGTTRLAAVAGNFGRDLEATYAQVGRVLERARADGTGLVAFPEACLGGYLSSLGSAEDRGTAASRRGRSGPPALTLDGPELRRVQEMAGDVVVVVGMCEDGGHDLYNTAVALTGDGILGVHRKVHQPLGENLTYAAGSAFDAFDTPVGRIGLQICYDKAFPEAARAAALDGAAVIVSISAWPGSRTAAAADLARDRWRLRFDLYDQARALENQVVWVAANQAGEFGSLRFVGNAKIVGPGGEVLASTGTDAGIAVADVDIEHELALARRAMFNLRDRRPDAYGAVVAPNAHAVPAVPAVQEEVPSLA

SEQ ID NO: 5728 - protein, 385 aa, Populus tremula
MTIDCIKTMPSITAPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5729 - protein, 183 aa, Brassica napus
  misc_feature (95)..(95): Xaa can be any naturally occurring amino acid
  misc_feature (153)..(153): Xaa can be any naturally occurring amino acid
  misc_feature (162)..(162): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTDVELAKEVDYLLRNKWIXPCVEFELEHGFVVPVSTGSTPGILMMDVYWTMWKASPWFGCTDSAQVLKEVKNAKRSXPNAFIRIIXIDTRQSVHQFIAYKPPSFTGA

SEQ ID NO: 5730 - protein, 462 aa, Ralstonia metallidurans
MAQAPHIASRKLRDIVTSRTLDSFLAGVSRRDPNQPEFFQAVKEVMMTLWPFVERNPRYGDQALLERLVEPERVIQFRVAWTDDRGQVQVNRAFRVQHSSAIGPYKGGMRFHPTVNLSVLKFLGFEQTFKNALTTLPMGGGKGGSDFDPKGKTDAEVMRFCQALITELYRHLGPDTDVPAGDIGVGAREVGFMAGMMKKLSNQSACVFTGKGLAFGGSLMRPEATGYGTVYFAQEMLHRRGREFDGLRVLLSGSGNVAQYAAEKAIELGAKVLTVSDSGGVLHFPEGMNREQLDALMTFKNDTRGRLSDFAEQHGLRFEAGKTPWHVPADVALPCATQNELNGQDAERLLSNGVFCVAEGANMPSTLDAVDRFVAARILYAPGKASNAGGVATSGLEMSQNAMRMAWHHAEIDEKLHAIMKDIHGNCIHYGQKEDGYINYVEGANIAGFVKVADAMLAQGVI

SEQ ID NO: 5731 - protein, 386 aa, Thlaspi caerulescens
MAATSNSGEDPVLYNHRSPFRFELLQSLPPTDPRYSSQTPSSTNRPFSVSEPLPNAQSPQIPPHWDESYSQITQKVQKSRKNHRIQLGSISNMPGETIDIAKVIVKQESPQDTKRGIKSKVAKQLKAGKRMANTEAHNGGPNGTNNCRYDSSLGLLTKKFVNLIREAEDGSLDLNYCADVLEVQKRRIYDITNVLEGIGLIEKTTKNHIRWKGADNLGQNGLGDQISRLKLEVESMQSEESRLDELIRERQEALRSLEEDEYCKRYMFMTEEDITSIPRFQNQTLLAIKAPTASYIEVSDPDKVMSFPQRQYRMVIRSRMGPIDVYLLSKYKRDSGETSESDQNTQSGVDTPSLKIVTSDTDLKTDYWFESDAEVSLTDLWNNNFS

SEQ ID NO: 5732 - protein, 453 aa, Listeria monocytogenes
MEASLLKKNQSIELTIEDLTHDGSGVGKIDGYPFFIPNTLPGEKVTAKIIKLNKNYGFARMENIETVSANRVEPPCAVYSKCGGCSLQHLSYDGQLEFKRNQVEETMKRIGKLNVEVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRDLVEQLELTSIVQNINPHKTNVIFGDRTKTLWGKDIIEDTIHGIRFAISARSFYQVNPLQTEVLYQQAIDAAELTGEETVIDAYCGIGSISLCLAKKAKHVYGVEIVDQAIQDARANAELNELANTTFETGKAEEVIPSWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 5733 - protein, 853 aa, Unknown
  Pseudomonas sp. G-179
MSSPHTWFSNRQLQKRRCRMTAELTRRDVLKAQAAAIAASTAGIAMPAAAQSVPGGVAALEIKWSKAPCRFCGTGCGVMVGVKENHVVATHGDMEAEVNRGLNCVKGYFLSKIMYGKDRLTTPLLRKRNGVFDKEGEFEPVTWEEAFDIMAEKAKKTLKEKGPTALGMFGSGQWTIFEGYAATKLMRAGFRSNNLDPNARHCMASAAYGFMRTFGMDEPMGCYDDFEHADAFVLWGSNMAEMHPILWTRLADRRLGHEHVKVSVLSTFTHRSMDLADIPLVFKPGTDLAILNYIANHIIQTGRVNQEFIDKNTKFMQATTDIGYGLRAEHPLEVKATGAAKAAEMTPIDFEAFKKHVSEYTLEKVAELAGVDKGFLEQLAELYADPKVKVMSLWTMGFNQHVRGVWANQMVYNIHLLTGKISEPGNSPFSLTGQPSACGTAREVGTFAHRLPADMTVTNPEHRKHAEELWNIPHGIIPEKPGYHAVQQDRMLHDGKLNFYWVQVNNNMQAAANNSNEAYIGYRNPDNFIVVSDAYPTVTAMTADLILPAAMWVEKEGAYGNAERRTHVWHQLVNAPGEARSDLWQLVEFSKRFTTDEVWPQDILDQNPEYKGKTLYDVLFQNGNVDKFPVSEISSDYENREAKAFGFYLQKGLFEEYASFGRGHGHDLGPYDLYHQVRGLRWPVVNNQETKWRYREGYDPYVKEGEGVKFYGQNDGRAVILAAPYEPPAESPDDEFGFWLVTGRVLEHWHSGSMTMRVPELYKAFPGARCFMNGDDARRLGINQGGQVKIQSRRGEIISRVDIRGRNRMPHGVIFVPWFDASQLINKVTLDATDPISKQTDFKKCAVKILPVA

SEQ ID NO: 5734 - protein, 767 aa, Unknown
  Malus x domestica
MLKALASSLSISLLLFCVSASDNGFPRCNCDDDGSWWSIESILECQRVSDFLIAVAYFSIPIELLYFVSCSNVPFKWVLFQFIAFIVLCGLTHLLNGWTYGPHPFQLMLALTVFKILTALVSCATAITLITLIPLLLKVKVREFMLKKKTWDLGREVGIIMRQKEAGMHVRMLTQEIRKSLDRHTILSTTLFELSETLGLHYCAVWMPNEIKTEMILTHELKGRNYSHAYNFSIPISDPDVAHIKGSDGVSILRPDSALVHASGDSGEPGPVAAIRMPMLRVSNFKGGTPEVIQACYAILVLVLPGGQPRCWSSQDLEIIKVVADQVAVALSHAAVLEESQLMREKLAEQNRALQQAKMKAMMASHARNAFQKVMSDGMRRPMHSILGLLSLMQDNTLDNDQRVIVDAMVRTSNVLSTLINDVMDNSAKESGRFPLEMRSFGLHATIKEAACLAKCLCVFRGFDFAIDVDKSLPDHVMGDERRVFQVILHMVGSLLNGNGVGGLVMFRVASEKGSQGRSDQRWAAWRHSSSDGDICVRFEIGISNSGSQSEVTIPAVQLVGRRYAGEGVDEGLSFTICKKLVQMMQGNIWAVPNPQGFAQSMALVLRFQPRLSIAIAISEPGESSEHPHSNSLFKGLQVLLTDDDDVNRVVTRKMLEKLGCIVTAVSSGFECLSTIGTIGPAGSSFQFVFLDLHMPELDGFEVAIRIRKFRSRTWPLIIGVTASADEDVWDRCMQTGINGVIRKPVLLQGIANELRRVLLQANKGMT

SEQ ID NO: 5735 - protein, 310 aa, Listeria monocytogenes
MQKHARVIYNPTSGREIIKKNLADVLSILEQAGYVTSAHATTAEPDDAKHAAEEAVRNRFDLVVAAGGDGTINEVINGIAEKEYRPKVGIIPTGTTNDFARALHVPRDVIKATKIIAAGQSVAMDIGKANETYFINIGGGGRLTELTYDVPSRLKTMLGQLAYYLKGIEMLPSLKATKVKVEYDQGVFEGEVMFFLLGLTNSIGGFEKIAPDAKLDDGKFSLIIVKKVNLAEFIRLVTLALRGDHIKEPNVIYVKSEKVIVNSEDKMLINLDGELGGETPMEFRNLRQHIEFFASVDDIPATDLFIKENS

SEQ ID NO: 5736 - protein, 266 aa, Solanum tuberosum
EFQICEEIGRGRFGTVYRCFSPATGESFACKSIDKNLLIDSTDRECLDKEPKILQLLSGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRMMSGVVGTPYYVAPEVLMGKEYNEKVDVWSARVILYIMLSGVPPFYGETPTETFQAVLRGNLRFPTRNFRSVSSEAKDLLRKIICKDVSRRFSAEQVLRHPWVINGGETR

SEQ ID NO: 5737 - protein, 397 aa, Unknown
  Malus x domestica
GFWSIPNILECQRVSDFLIAIAYFSIPVELLYFVSCSNVPFKWVLLQFIAFIVLCGLTHLLNAWTYYGRYTFQLMLSLTIAKFLTALVSCATAITLLTLFPMILKVKVRELFLRQNVMELDQEVGMMKIQKEASWHVRMLTQEIRKSLDKHTILYTTLVELSKTLDLHNCAVWMPNEKRGEMNLTHELKTSSSQQYRRSIPINDPDVLEIRESERVMILRPDSALGSASSVESSESGAVAAIRMPMLRVSNFKGGTPQLVDTHYAILVLVLPVADSGGWSHHELEIVEVVADQVAVALSHAAVLEESQLMREKLAEQNRALQQAKKNAMMASQARHSFQKVMSHGMRRPMHTILGLLSMFQDNLSFKQSIIVDTMEKTSYVICTLINDVMEMSVKDN

SEQ ID NO: 5738 - protein, 809 aa, Unknown
  Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 5739 - protein, 554 aa, Wigglesworthia glossinidia
MTESFARLFEESLKKIQTRPGSLVKGTVIAILKDIVLVDAGLKSESAVPIEQFLNNKGHLEVKVGDVIDVTLDAIEDGFGETILSREKAKRKEAWLNLEKAHLDSITVNGIINGKVKGGFTVELNGIRAFLPGSLVDIRPIRDTIHLEGKDLEFKVIKLDQKRNNVVVSRRAVIESENSAERDHILKILQEGSKAVGVVKNLTDYGAFIDLGGVDGLLHITDMAWKRVKHPNEIVSIGDEITVKILKFDKEKTRVSLGLKQLGQDPWIEISKRYPENVKISGKVTNLTDYGCFVEIEEGVEGLVHISEMDWTNKNIHPSKVVNVGDTVNVLVLDIDEERRRISLGLKQCKPNPWKNFSKLNKKGDKVQGRIKSITDFGIFIGLEGGIDGLVHLSDVSWNIQGEEAVKEYKKGDIISAMVLQVDSDRERISLGIKQLSEDPFNYYVKNNKIGDIVDGTISIIEKSKFVIKLDSFVEGYVNIADKKEENITKNFKISNILKLKIIGIDRKNRTINLSFIIDDYKKKSNKNDKKNNSIEDSFSNVMTEAFKAATKSD

SEQ ID NO: 5740 - protein, 87 aa, Lithachne pauciflora
KPSMVVHQPRVDIGGDDMRTFYTLVMVDPDAPSPSDPTLREYLHWLVTDIPGTTGAAFGQEVMCYEPPRPSMGIHRFVLVLFQQLGR

SEQ ID NO: 5741 - protein, 72 aa, Ralstonia solanacearum
MAKDDVIQMQGEVQENLPNATFRVKLENGHVVLGHISGKMRMHYIRILPGDKVTVELTPYDLSRARIVFRAK

SEQ ID NO: 5742 - protein, 255 aa, Triticum aestivum
  misc_feature (246)..(246): Xaa can be any naturally occurring amino acid
MGANGALEGEEERPRADGEEEEEGGATVFRGTNYSLPRTIAALALWLGGIHFNVILILASLFLFPLRLAALVVALQLVFMFTPLNDEDKLGRKIGRFICKYAMGYFPISLHVEDYNAFDSSRAYVFGYEPHSVLPIGVAALANHVGFMPLPKLKVLASSAVFHTPFLRQIWTWIGLIAATRKNFYSYLAAGYSCVVVPGGIQEILHMDHDSEVAFLNSRKGVVKIAMQAGCPLSLFSASGQEQTYXWWEARRQLL

SEQ ID NO: 5743 - protein, 69 aa, Arabidopsis thaliana
  misc_feature (29)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (47)..(51): Xaa can be any naturally occurring amino acid
  misc_feature (54)..(54): Xaa can be any naturally occurring amino acid
  misc_feature (57)..(57): Xaa can be any naturally occurring amino acid
  misc_feature (66)..(66): Xaa can be any naturally occurring amino acid
MASSMLSSATMVASPAQATMVAPFNGLKXSAAXPAXRKANNDITCIXXXXXRVXCMXGWPAIGKKXGRL

SEQ ID NO: 5744 - protein, 389 aa, Glycine max
RAGSFFNWFYFSINIGALVSSTFIVWIQENAGWGLGFGIPALFMALAIGSFFLGTPLYRFQKPGGSPITRMCQVVVASVWKRNLVVPEDSNLLYETPDKSSAIEGSRKLGHSDELKCLDRAAVVSDAESKSGDYSNQWRLCTVTQVEELKILIRMFPVWATGIVFAAVYAQMSTLFVEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 5745 - protein, 315 aa, Oryza sativa
MHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIEGKQIMKYMRNIP

SEQ ID NO: 5746 - protein, 323 aa, Solanum schlechtendalianum
EVKVGDTIEIVRFFHCYKRGLDRVFVDHPMFLEKVWGKTGSKIYGPKAGKDYLDNELRFSLLCQAALEAPRVLNLNCSKYFSGPYGENVLFVANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHNFIRLDVQIVVLGTGKKKFEQEIEQLEVLYPNKAKGVAK

SEQ ID NO: 5747 - protein, 330 aa, Legionella pneumophila
MTNNRVRVAVTGAAGQIGYALVFRIASGQMFGPNTEVELNLLELEPALPSLEGVAMELDDCAFPLLKRIVCTADLNKAMDGVNWALLVGSVPRKQGMERSDLLQINGGIFTKQGQAINDYASDDVRVFVVGNPCNTNCLIAMNHAKDVPSDRFYAMTTLDELRARTQLAKKAGVDITAVTQMTIWGNHSATQYPDFYNAKINGTSAARVINDQTWLKETFVSTVQQRGAAVIKARGSSSAASAANAIITGVNHLVTDTPAGESFSMCRRSKGEYGVDEGLIFSFPCRREHGELKVVENMEFNDFGRERFNITLNELRSERDTVKSLGLLD

SEQ ID NO: 5748 - protein, 552 aa, Pisum sativum
MAAADFRSTIRTITPFFSKHIPSTTRHSHYSFSSTYSPKPLLSHHHHRLTMPPVAIDGKQTVDVDVDDSCSSSVTVKPPSLHDYHRFDQQLLDSIAYDALVWASLHGLVMGDKSSKKSGTVPGVGLVHAPFALLPVSLPESKFKQACDLAPIFNELVDRVSLDANFLQESLSRTKKVDEFTSRLLDIHSKMLHVNKKEEIRLGLHRSDYMLDEQTKSLLQIELNTISSSFAGFGSLVTELHRYILSRHGKLLGLDAENVPVNNAVIQNAEGLAKAWIEYNNPKAVIMFVVQAEERNMYDQHSLSAVLKEKHGITIVRKTLAEVDQEGEILPDGTLTVNGQAVAVVYFRAGYTPADYPSESEWRARLLMEQSSAVKCPSISYHLVGTKKIQQELAKPGVLERFLENKDDIAKMRECFAGLWSLDDSDIVKKAIEKPEIFVMKPQREGGGNNIYGDAVRETLIKLQNLGSQEDAAYILMQRIFPNLSAALLMRNGYLHKDHAISELGIFGTYLRNKDRVIINNQSGYLMRTKIASSDEGGVAAGFAVLDSVYLS

SEQ ID NO: 5749 - protein, 383 aa, Unknown
  Vibrio sp. Ex25
MNDVIRDFFKMESAGGILLVIAAAIAMTIANSPLGETYQSVLHTYVFGMSVSHWINDGLMAVFFLLIGLEVKRELLEGALKSKETAIFPAIAAVGGMLAPALIYVAFNANDPEAISGWAIPAATDIAFALGIMALLGKRVPVSLKVFLLALAIIDDLGVVVIIALFYTGDLSTMALLVGFIMTGVLFMLNAKEVTKLTPYMIVGAILWFAVLKSGVHATLAGVVIGFAIPLKGKQGEHSPLKHMEHALHPYVAFGILPLFAFANAGISLEGVSMSGLTSMLPLGIALGLLVGKPLGIFTFSWAAVKMGVAKLPEGVNFKHIFAVSVLCGIGFTMSIFISSLAFGNVSPEFDTYARLGILMGSTTAALLGYALLHFSLPKKAQA

SEQ ID NO: 5750 - protein, 323 aa, Solanum seaforthianum
EVKVGDSIEIVRFFHCYKRGVDRVFVDHPMFLEKVWGKTASKIYGPKAGQDYLDNELRFSLLCQAALEAPRVLSLNCSKYFSGPYGDNVFFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTSITGIVNGMDTQEWNPATDKYTDVKYDITTVMDAKPLLKEALQAAVGLPVDSKIPLIGFIGRLEEQKGSDILVAAIHKLIGLDAQIVVLGTGKKKFEQEIEQLEVLYPNKAKGVAK

SEQ ID NO: 5751 - protein, 472 aa, Unknown
  Mesorhizobium sp. BNC1
MEKADIGLIGLGTMGANLALNIAEKGFRIAVFNRTTERTHEFAQEAGSLAGNIVPCDTLQALVEGIKPPRPIILMVPAGSVVDEQIAALDPLVARDDIIIDAGNANFRDTRRRMLELAKTGPRFIGMGVSGGEDGARHGPSIMVGGPDESYRRIEPVLEAIAARYEGEACQAWLGPDGAGHFVKTIHNGIEYADMQMIAEIYGILRDGHGLQAGEIAPIFAQWNDGRLNSYLIEITAKVLEASDPDTGKPIVDVILDRAGQKGTGRWSAIEAQSLGIPATAIEAAVAARSLSALKAERETAEKRYGSLAAAMAGSPGADELATLEAALFAGKIVAYAQGFSVMAAASREFGWNLPLGTIARIWRAGCIIRSQFLGAIAEAFDGAPETDNLLMTEAFSQHMEAAHPRLRRVVAKSAEAGLPVPSLSAALAHFDTFRRGRGTANLIQAQRDFFGAHGFERVDSEGSHHASWKRD

SEQ ID NO: 5752 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGHASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5753 - protein, 323 aa, Solanum triflorum
EVKVGDTIEIVRFFHCYKRGVDRVFVDHPMFLEKVWGKTGSKIYGPKAGQDYLDNELRFSLLCQAALEVPRVLNLNCSTYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEEEIEQLEVLYPNKAKGVAK

SEQ ID NO: 5754 - protein, 323 aa, Solanum tripartitum
EVKVGDTIEIVRFFHCYKRGVDRVFVDHPMFLEKVWGKTASKIYGPKAGQDYLDNELRFSLLCQAALEAPRVLNLNCSAYFSGPYGEDVLFIANDWHTALIPCYLKSMYQSRGIYLNAKVAFCIHNIAYQGRFTFSDFPLLNLPDEFRGSFDFIDGYEKPVKGRKINWMKAGILESHRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHEFIGLDVQIVVLGTGKKKFEQEIEQLEELYPNKAKGVAK

SEQ ID NO: 5755 - protein, 279 aa, Ulva fasciata
MVNTEQLEGATAAIKELIAAKACGPILIRLAWHDAGTYDDSIGAAAWPKCGGANGSIRFDPEILHGANAGLKNALILLEPIKAQFPEVGYADLFQLASATAVEVMGGPTIPMKYGRKDATGPDMCHPEGNLPAGAAPWPTGGDAAGHLRAVFHRMGLSDQDIVALSGAHCVGRAHASRSGLCHKAETKYTAAGACPMGTAATGGASWTPEWTKFDNSYFQVVKDPKDEELLALETDTVLFKDPEFLKYAEKYAEDQDAFFADYAVSHAKLSELGVAWEA

SEQ ID NO: 5756 - protein, 243 aa, Herminiimonas arsenicoxydans
MPQEKKAYGKVYLIGAGPGAIDLITVRGARILAQADVVLHDALVTPEMLTLCPQAEKISVGKRSGQRSTAQIAINQLLIECAEKYQLIVRLKGGDPMLFGRADEELQALETHGIAVEIVPGITTAFAAAAATQQPLTKRGVARSIAFFTSSTAPNQPDQLTLPDCDTLIQYMGGREAIITAQKLLEQGRSPRLPVVVVENCSLESQRIMRMTLHELEQGLGECQGPVLVMIGEALAERSTSKK

SEQ ID NO: 5757 - protein, 323 aa, Solanum turneroides
EVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVMGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVILGTGKKKFEQEIEQLEVLYPNKAKGVAK

SEQ ID NO: 5758 - protein, 105 aa, Saccharomyces cerevisiae
MLMPKQERNKIHQYLFQEGVVVAKKDFNQAKHEEIDTKNLYVIKALQSLTSKGYVKTQFSWQYYYYTLTEEGVEYLREYLNLPEHIVPGTYIQERNPSQRPQRRY

SEQ ID NO: 5759 - protein, 328 aa, Leifsonia xyli
MRQIIIIGSGPAGYTAAIYAARANLKPLLIASSVEAGGELMKTTEVENFPGFPDGVMGPDLMVKMQAQAERFGTEVILEDVVSVDLSGDAKTVTLGSGAVHEALSVIFATGSAYRKLGLEDEERLSGHGVSWCATCDGFFFRERTIAVVGGGDSALEEATFLTRFADKVYVIHRRDSLRASKIMQDRAFANNKIEFIWNSEVVAINGSEQVEGITLRNRENDDQSDLDVQGLFIAIGNDPRVHLVHGQLDLTPEGTIAVAGRSSKTKLTGVFAAGDVVDSSYRQAVTAAASGTVAALDAEHYLSDLPQDLLDNATDIAPGDLELTTTA

SEQ ID NO: 5760 - protein, 108 aa, Leifsonia xyli
MSATRSVTDVSFEQDVLNSEKTVLVDFWAEWCGPCRAVGPILDQIAAEHSEKIEIVKLNVDENPQTAAKYQITSIPAMKVYQGGEVVKTVIGAKPKPALEADLAAYLA

SEQ ID NO: 5761 - protein, 843 aa, Unknown
  Malus x domestica
  misc_feature (118)..(118): Xaa can be any naturally occurring amino acid
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFXMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITDSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 5762 - protein, 139 aa, Yarrowia lipolytica
MAPKVAEKKPSLAGKAPAGKAPAEKKEAGKKTTTATGEKKKRTKARKETYSSYIYKVLKQTHPDTGISTRAMSIMNSFVNDIFERVATEASKLATYTKKSTITSREIQTAVRLILPGELAKHATGDGTRAVAKYSTFDN

SEQ ID NO: 5763 - protein, 471 aa, Oryza sativa
MEARRISASPRPCSGRRVVARKRPRHEAAVNSVRKLQRREISSCRDRAFSMSAAQERFRNIQLQEEFDTHDPKENSLLLPYLRKRSKIIEIVAARDIVFALSQSGVCAAFSRETNRRICFLNGSPDEVIRSLFYNKNNESLITVSVYGSENFSALRCRTTRIEYIRRAKPDAGFPLFESESLKWPGFVEFDDVNGKVLTYSAQDSTYKVFDLKNYTLLYSISDKNVQEIKISPGIMLLIYTRTSSSVPLKILSIEDGTVLKSFNHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSNDSSSEENAGSINISNILTGKCLAKIKASDLCKQKKAWKFQSTALEALEDITALYYDEERDEIYTGNRQGLVHVVPATKRCLEKAVKSHSIFR

SEQ ID NO: 5764 - protein, 372 aa, Oryza sativa
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASEQQQIGPQGELNDNFWEELLNEGLVGEENDNPVVEDDMNVLSEKMGYLNSNGPTAGE

SEQ ID NO: 5765 - protein, 843 aa, Unknown
  Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 5766 - protein, 152 aa, Gibberella zeae
MDHGRDPCPYVILNDFGGAFCMGAIGGTIWHGIKGFRNSPYGERRIGAITAIKMRAPVLGGNFGVWGGLFSTFDCAVKGVRQKEDPYNAIIAGFFTGGSLAIRGGYKAARNGAIGCAVLLAVIEGVGIGFSKMLAGSTKLEAPQPPPQEATL

SEQ ID NO: 5767 - protein, 327 aa, Ehrlichia ruminantium
MKISILGAGSFGTAIAIALSAHGISVNLWGRDHRNTTHINTYRKNLKYLPTYHLPDNIYATSNIDEVLSDNNTCIILTIPTQQLRTICTQIQHKQHMCKNTPILICSKGIEITSLKFPSEIAEEILQYNPIFILSGPSFAKEIAEHLPCSIVLAGDNKELGESLIEKISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 5768 - protein, 60 aa, Passiflora kalbreyeri
WEYQVGPSVGIDAGDHIWCSRYILERITEQAGVVLTLDPKPIEGDWNGAGCHTHYSTKSR

SEQ ID NO: 5769 - protein, 112 aa, Thiomicrospira crunogena
MKMVTSIIKPFKLDDVREALHDIGVHGMTVTDVKGYGRQKGHTEMYRGAEYVVDFLPKLKIEIAVSGDKVDQVIEAITQTAQTGKIGDGKIFVTSIEQTVRIRTGETGPEAL

SEQ ID NO: 5770 - protein, 299 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYRGGGGGGRGRGSRYDRYDDGAGRGGRHDRYDDGAGRGGRHDRYDDGGRRRHGSPPRRARSPVRESSEERRAKIEQWNREREGKQ

SEQ ID NO: 5771 - protein, 522 aa, Neisseria meningitidis
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDGDVQRIVKGSINEAQALALIRDPNADLGSLKHSFYKPDTQKKDSKIMNTRTIYLAGGCFWGLEAYFQRIDGVVDAVSGYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKTAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSYNMRRTEVRSHAADSHLGHVFPDGPRDKGGLRYCINGASLKFIPLEQMDAAGYGALKSKVK

SEQ ID NO: 5772 - protein, 374 aa, Triticum aestivum
PRLRVVRCMAASEAAQLKSAREDIKEILKTTYCHPILVRLGWHDSGTYDKNIEEWPQRGGADGSLRFDPELSHGANAGLTSALKLIQPIKDKYPGITYADLFQLASATAIEEAGGPKLPMKYGRVDITAPEQCPPEGRLPDAGPRLPAEHLREVFYRMGLDDKEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDDDKGAVATEEKVVADPAPASDTNSTGPQPEPFVSAKYSYKKRELSDTMKQKIRAEYEGLGGSPNKPMKSNYFLNIMIVIAGLAFLTSLTGN

SEQ ID NO: 5773 - protein, 314 aa, Wigglesworthia glossinidia
MKIKSKLLILGSGPAGFTSAIYSSRAGINPILITGSQLGGQLTTTDKIENWPGDSKSLTGSELIKRMRDHAIKFGTKIFYDHINEVNFNKKPFICKGEKEYISDAIIIATGSSARYLGLSSEQLYKGKGVSTCAVCDGFFYKNKIVAVIGGGNTALEEALYLSNIASKVYLIHRRDIFTAEKILVDRIFKKRNNGNISIYNNFVVKKIIGNDKQVSSILLESTTSKKEKIISVSGIFIAIGHIPNTKIFENQITLKNYYICISNKYNKKYRTSTSIPGIFSAGDVSDYLYRQAITASGFGCMAALDAEKYLSSL

SEQ ID NO: 5774 - protein, 461 aa, Bradyrhizobium japonicum
MERTTVAATARLSLRTQHRLAATQRHGPAAKARIDFIGIVATDECRIAVMTASQRKAPGGDQMFDRRDLLKGAGLAAMAATLNSTKALALDTVTLPFANGERPLVKYPQKRPMIGLTSRPPQLETPFAVFNDGPITPNNAFFVRYHLSDLPYNLDPDKFTLEIKGKVDKLLKLSLKDIRKMKATEIVAVNQCSGNSRGFFEPRVAGGQLANGAMGNARWRGVPLKTVLEMAGVQAGAKQVTFNGMDGPASDKTPDFVKALDIDHASDVEVMLAYGMNGEDLPFLNGFPLRLIVPGYYGTYWVKHLNEITVIDNVYDGFWMKSAYRIPDTPNNAIEPGTTPKATIPINRFTIRSFITSVPDGAKLKAGATTLRGIAFDGGKGIKDVAVSTDGGKTWTSAKLGKDLGKYSFREWKLPVKLAAGTVELKVRATGNGGETQPDQPRWNPAGYLRNVVETVRVSVA

SEQ ID NO: 5775 - protein, 364 aa, Triticum aestivum
PRLRVVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDITAPEQCPPEGRLPDAGPRLPAEHLREEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDADKGAVATEEKAVADPAPTSDTNGAGPQPEPFVAAKYSYKKRELSDTMKQKIRAEYEGLGGSPNKPMKSNYFLNIMIVIAGLAFLTSLVGN

SEQ ID NO: 5776 - protein, 527 aa, Prochlorococcus marinus
MNNDFNSWDKYCDYLWYDQKINIWLDISKINFSYDQISSLENKFIGVFSSIKELEAGAISNIDEKRQVGHYWLRNPSIAPNTFIKDEIIKDIRDISEFGDKVLKGIIKNNKNQTYTDVLWIGIGGSGLGPLLITEALQENSVGLNFSYIDNIDPFLISEKLDELSDKLPTTLFVVVSKSGGTPEPKIAMNIIKRHVEDKNILWNSNAIAITMKNSQLYKKAKLENWLKIFNLPDWVGGRTSITSSVGLLPLALINQDVSEFIRGASIMDELTRITNIKDNPAALLSSAWFFSGNGIGKRDMVVLPYRDRLQVFSKYLQQLVMESLGKKFNRKGKIVHQGISVFGNKGSTDQHAYVQQLRDGIDNFFCVFIELLDIPDDNKYFGSENPKEFLSGFLQGTRSALSNENRQSITITLDKLNCLTLGALIALFERAVSFYAELVDINAYDQPGVEAGKKAAAEILEYQKKVTELLNNGEEFSIKKITSLIENSTSEPIFFIIRQMCFGNDDYLIKGDWSNPISIIIKKNSK

SEQ ID NO: 5777 - protein, 84 aa, Glycine max
MEYQRQRSHQSQGRSRWVPASYFSVESLLLLSCLTASLLILPLLLPPLPPPPFLLLLLPIAILLVLIISAFMPSNVRDITHTYM

SEQ ID NO: 5778 - protein, 240 aa, Desulfotalea psychrophila
MGTYLLVLLTHTSSSTLVLSQEMTTKMAEKPERRTIMSQVTVKDMLQAGLHFGHQTRRWNPKMKPYIYGPRNGIYIVNLDLTKRLFDKACEFISSNVKNEGSVLFVGTKRQAQSIIKEEARRCGQYYVDHRWLGGMLTNFQTIKNSIDRLKSIEAMQEDGSINRFPKKEILLMGKERVKLERNVGGIKDMRALPAVIVIVDPRKESIAVSEAGKLGIPVVALTDTNCDPDGIDYRNPRQR

SEQ ID NO: 5779 - protein, 165 aa, Picea rubens
MARSAAMTMVLFLLAGFLVSSMAQAPSASPTKSPTTPAPTTTAAPPTTTAAPPTTTATPPVSTPPPVASPPPVATPPPVATPPPVATPVATPPSPALVPSPAVATPPPAATPIVTPTASTPAVTPSAAPIASPAVSPSSTSGASVASTLEKTAILAAALAGVFFL

SEQ ID NO: 5780 - protein, 2027 aa, Debaryomyces hansenii
MSFLRRDKSKNNIFNSFAAGQYNMSTNNPNNRETNEMNSNKFQEPPSPMTDNFEGSAMNTTTNQTGANSSAIGSENGANTRPKLDKKLSSNGVYPTSSSSSMSSNDRNEGQIFFNSKFSEHDDRIVLQGHHSQVQGNQAQGSQEQGNQVQQQQKMPVRNSSVGFNNEAMYSPRSSIVSLSTPPTQSNNNSELAVSSEQSHIKDNYKGFHANKRPKGLANIPPLAHPIKPRFRKKGSSLLGKLIYSSRKDSEGSQQSGELAPQHSIEVEPEMPEERDQQRRNSSGNNGGQTQVNKKSVSSAGSNSSKHKFRIPSISLDHHHHHHSHNDEPEETNQQPRAHSTSSAEIRYNNKGGDKKMPTSFDLDMDINEMQGIVKSPNQSSTHENKNPLSDIDAARSFTFNLTDTNSKVPLQQTSDNVNLLMQRSSSSVASSVPSGNVNTRQNVNRSGGGWRAPDSWDVKLNGPLGSAKGDNRSLSDSDNEDKMDDRISSADTSSTLSNSMNQLNDKPTNKLQNAQQVSPRKQNKKSDVRAETPKNSRSNLPVLYGSSNISHVVPTQSDSKSLTKGPNHIVRVFKEDNTFTTILCPLETTTAELLNIVQMKFFLESTTNYQISVYIGNCVKVLEPFERPLKIQMGLLMLSGYSDNDNLRIIGREDLSYICKFVVENIYLRNLTHEEEIMLSKDYVDVNISNSDLKNIPIIFHQHTYEIEKLNVSDNPSIYIPLDFIQSCTNLTSIIFSRNGCSKFPINFLEAKQLTHLNMEKNFLDDLPSKIGHLRNLTHLKLNSNQLSTLPKSFGKLQNLVSLNLSSNYLEAYPEAISELYNLADLDLSYNDLSYLPESIGKLTQLIKLNVSTNKLSKTLPLYITKLISLKRFDLRYNKLTNVDVLGSLPNLEVVYASKNNISTFNDEMESLRLLHFDRNPITDLTFDTLLPNLAVLDLSKAKITAIPPEFMHKISSIEKLVLDKNHLINLPNEIGNLTKLAYLSAYGNNLQVLPPSIDKLVSLQYLDLHSNNLQLLPNGIWDLKSLTYLNVSSNMLSTLPQPPLSVAKRISSTANFRQSPISGLSLESDSRRPSFQSVIESDSTNTPIEPTDAIAEVSSEGGPYEESSTSSVNFNNSSGSLADSLLVLVLADNRLDDDCFDSISFLVELKTLNLSYNDLLEIPEGAARRMTKLVELYLSGNELTSLPTDDLDNIKSLKLLYLNNNKFVSLPAELSKLVNLQHLDVGSNQLKYNISNWPYDWNWHWNKNLKYLNFSGNKRFEIKQSHMKNPDTGEDFDSLLVLKNLKVLGLIDVTLTTTSVPDHTIDMRIRTTASELDNIGYGVSDTMGMRDHVSSRDIFIQKFRGNENEVLICSIDGKSGSPNHTHRISALVKSLFVPNFTNELNKLKNEEGIQDAIRRTFLSLNKEINGILSAKKYNCFNPSSQISPEFADLNLRDDAAAGCAMSIVYIKEKKLYTANIGDVETLLSMSNGDHILLTNKHDPTNRTEFERIRASGGYVSGDGALDGDLAVSRGVGFFNYLPHTHSGPDISEIELTSADDMIIMATKVLWNYITFEIAVDILRQEKNDPMIAAQKLRDYAICYGATDKIAVIVITLGEKKSNKMKFGTKAFYNNLGQENDVFAKKRRDRSQLLVGDSTLRRLEEEIEPPEGILALAFTDIKNSTLLWDSYPVAMRSAIKIHNAIMRRQLRIVGGYEVKTEGDAFMVSFPSPTAALLWCFNVQQQLLKQDWPAEILETDHCCEVTDSKGEVIFRGLSVRMGIHWGSPVCELDYVTRRMDYFGPMVNRASRIMAIADGGQIAVSSDFLAEIRALYKIHEDVTSGATTLYDAYQGNVRGGEIIEREIRSIEEIKWSFFELGEKKLKGLETPELITLVYPKKLEVRFEIFQKRLFHIEDSQSSTRIVGTLPVYSIYGLRTVSLRLENICSCINGGVHVNEGFQMNSSDLISEKINSSFKESDLMGLLNHIVTRIENCAATLHLRQQMSLLGDKGGYIDFTQIQPISNVMDDLKNLIEQFEQYKMLQEGL

SEQ ID NO: 5781 - protein, 185 aa, Burkholderia pseudomallei
MSEATSEVATLGGGCFWCQEAVFLDVDGVTAVESGYAGGHTRNPGYRDVCDGDTGHAEVVSVSFDPARIGYREILEIFFATHDPTQLNRQGNDVGTQYRSVIFTHSDAQRDAALELIRTLERDKLYDDPIVTQVEPLNGNYWPAEAYHQNYYARNPGQGYCAVVIGPKLAKFRQKFAHRLKSRGA

SEQ ID NO: 5782 - protein, 369 aa, Nanoarchaeum equitans
MDEKEIEEILEENKRLKSMVNYLQKELEKFRSPPLVVAEVIKPYGERAIVRLPTGMELLVEKLSKIEIEPGDTVFLNQSNMVIVGKAEKRKKFNIDAFVITEKPNVDWSQIGGLKEQIEEIREAIELPLTKPEIFEKIGIEPPKGVLLYGPPGTGKTLIGKALAKSANATFIYIVGSELVQKYIGEGAKLVKELFDYAREHAPAIVFIDEIDAIAARRIETGTSGEREVQRTFMQLLAEIDGFKPLDKVKVIGATNRLDILDPAILRPGRFDRIIHIPLPDKQGRIEIFKIHTRKMRTKDIDYSLLAELTEGFSGAEIKQVCIEAGYLAIRNKRDYVILEDFIKAIDKVKKMRKKEEYQRFLKGLSYFG

SEQ ID NO: 5783 - protein, 323 aa, Solanum uleanum
  misc_feature (223)..(223): Xaa can be any naturally occurring amino acid
EVKVGDTIEIVRFFHCYKRGVDRVFVDHPMFLEKVWGKTGSKIYGPKSGQDYLDNELRFSLLCQAALEVPRVLSLNCSKYFSGPYGEDVLFIANDWHTALIPCYLKSMYQSRGIYLNAKVAFCIHNIAYQGRFAFSDFRLLNLPDEFRGSFDFIDGYEKPIKGRKINWMKAGILESHRVVTVSPYYAQELVSGVDKGVELDNVLRKNCITGIVNGMDTQEWNXATDKYTDVKYDITTVMDAKPLLKEALQAAVGLPVDRKIPLIGFIGRLEEQKGSDILVAAIHKFIGLDVQIVVLGTGKKEFEQEIEQLEVLYPNKAKGVAK

SEQ ID NO: 5784 - protein, 323 aa, Solanum villosum
  misc_feature (262)..(262): Xaa can be any naturally occurring amino acid
  misc_feature (317)..(317): Xaa can be any naturally occurring amino acid
EVKVGDTIEIVRFFHCYKRGVDRVFVDHPMFLEKVWGKTGSKIYGPKAGQDYLDNELRFSLLCQAALEAPRVLNLNCSTYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIXLIGFIGRLEEQKGSDILVAAIHKFIGLDVQIVVLGTGKKEFEEEIEQLEVLYPNXAKGVAK

SEQ ID NO: 5785 - protein, 700 aa, Psychrobacter arcticus
MTMFNTIKREFQYGNQQVVIETGRIARQANSILVHMGGVTVLVAAVVKSDAKEGQNFFPLTVNYQEKMYAAGKIPGAYGKREGRASESETLTSRLIDRPIRPLFPEGYVNEIQITATVVSSDKTQSADIAALIGASAALAISDAPFNGPVAAARVGFINGEYVLNPTLEELKESDLDLVVAGTKSAVLMVESEAAELSEDQMLGAVLYGHQQQQIVIDNIASMAAEIGTAKQQYTAPVRDQALETGMKEQFGAQVSDAYTITDKQARYSKLNEIKDAAIVALAGDAESESYSDTVSELKEIYNDLKYRTVRDNILSGKPRIDGRDLETVRALDVQVGVLPFTHGSALFTRGETQALVTTTLGNTRDVNMIDSLAGTIRDHFMLHYNFPHFSVGETGREGIPKRREIGHGRLARRGVQAMLPDSDRFPYVIRVVSEITESNGSSSMASVCGASLALMDAGVPIKAPVAGIAMGLVKEGERFAVLSDILGDEDHLGDMDFKVAGSKDGITALQMDIKIEGITPDIMEQALKQAHAGRIHILDAMNKVLPESRTEINAHAPNYAVIEINPDKIRDVIGKGGATIRQLTEETGAVIDIDDAGTIRIFGENKAATKAAIAKIEAITAEVEVGKTYEGTVARIVDFGAFVNVLPNTDGLVHISQIADERVENVSDYLKEGQIVKVLVQDVDNRGRIKLTMKGIEQS

SEQ ID NO: 5786 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNEDDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5787 - protein, 902 aa, Burkholderia thailandensis
MRARGTVQRRAQGARGGAARARARRERLHALTNGFTNQQRASIMKIVVIGHGMVGHKLLECIAAGAQGALVAPQVAVICEEPRPAYDRVHLSEFFAGKSADDLSLVEPGFFERHPNFRLLLNTKAVAIDRGARTVALSTGETLAYDKLVLATGSTPFVPSVPGRERAGCFVYRTIEDLEAMQACGARAKSGVVVGGGLLGLECAKALRDMGLAAHVVEFAPRLMAVQVDEGGGRMLREKIEALGVQVHTGKNTLEIVDGETGAHRMAFADGTHLDTDMIVFSAGIRPRDEVARACGLEIGPRGGVAIDSHCRTSDADIYAIGECAAWNGQTFGLVAPGYDMARVVAQRLAGGDGAFTGADLSTKLKLMGVDVASIGDAHGKTPGCRTYQFADERRGVYKKLVVSGCGKELLGAVMVGDAADYGTLLQMMLNRIELPAAPEFLILPPADGAAKPALGVDALPDAAQICSCNNVTKAQLCEAVAGGATSIGALKGCTGAGTSCGGCVPLVTQVMKAEMKKQGLAVNNHLCEHFPYSRQELYHLVRVERIKTFGALLGKHGRGLGCDVCKPAVAGILASCWNEFVLKKEHAALQDSNDYYLANIQRDGTYSVVPRMPGGEVTPEGLIAVGQVARKYGLYTKITGGQRVDLFGARVEQLPLIWEALIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLIRYVDRFLMFYIRTADRLQRTSVWRDNLEGGLDYLIDVVVHDRLGLAAELEVEMQHVVDTYECEWKRAVTDSATRRRFRHFVNSDAPDSTIAFVEARGQIRPATPDERDAAGPHGVRAVREDEAQTETETA

SEQ ID NO: 5788 - protein, 133 aa, Unknown
  Acinetobacter sp. ADP1
MRMLHTMLRVGNLEQSIKFYTEVLGMTLLRKRDYEEGRFTLAFVGYGQESDHTVLELTHNWDTSSYDLGNGYGHIAIGVEDAYKACDLIKERGGNVVREAGPMKGGVTVIAFVEDPDGYKIELIQQDENARNN

SEQ ID NO: 5789 - protein, 342 aa, Aspergillus oryzae
MAMNRIPGQNIYIGGIFSLKNRAALERANITHVLSVLRLQPQEETFAGFQHHRIDVDDVEDENLLEHFPSAIKFIQSGLDAGGGVLVHCAMGKSRSATICIAYLLHQQPSALTPQSALAIIKESRPLCEPNDGFMKQLSIYHQMGCPDDVISHPLYNRWLYRREVEESVACGRAPEMSSVLFEDEQPHKSQDNTDRTTEIKCRKCRRNLATTPFIIPHGPQNGAKGPTDCAHIFLHPLTWMRPCLFPNGEDDGAPPGDAPLSGRLTCPNTSCGSNIGKFAWQGMQCSCGDWVVPAIGLAKARIDMSQRVNVGRLPPAALGIRMPPSMRPNPADDSTNGRGNL

SEQ ID NO: 5790 - protein, 813 aa, Oryza sativa
ANRRGGIKNRGLRSLQKPPWTAPASSRECACDRRLVVGELAEPDCGGEAAMPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 5791 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5792 - protein, 58 aa, Passiflora kawensis
WEYQVGPSVGIEAGDHIWCSRYILERITEQAGVVLTLDPKPIDGDWNGAGCHTNYSTK

SEQ ID NO: 5793 - protein, 418 aa, Unknown
  Frankia sp. EAN1pec
MNTSAEDVRASAVRARQAAGQLAPLSRAAKDAALLGMAAALLDRSAEILAANALDTAAARAAGTSAALVDRLTLTPERIEAMADGLRQVAALEDPVGEVVRGRVLPNGLELRQVRVPLGVIGIIYEARPNVTVDAAGLCIKSGNAVLLRGSASALNSNRVLVDVLREAAVAAGLPADGVQLVPGADHDSVKHLMRLRGLVDVLIPRGGAGLIRAVVEESTVPVIETGVGNCHVYVDVDADVDTALAITLNAKTQKVSVCNSAETLLVHAGIAAEFLPRVLTALRDAGVTVHGDETVRAVDPSAVPVTDEDWATEYLSLDMAVGVVDSLDQALDHIRRWSSGHTEAIVTRSLAASRRFVASCDSAAVMVNASTRFTDGERFGMGAEIGISTQKLHARGPMGLPELTSTTWVGIGDGHLV

SEQ ID NO: 5794 - protein, 72 aa, Pseudoalteromonas tunicata
MAKEDVIEMQGTILDTLPNTMFRVELENGHVVTAHISGKMRKNYIRILTGDKVTVEMTPYDLSKGRIVFRAR

SEQ ID NO: 5795 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 5796 - protein, 645 aa, Oryza sativa
MAAPPLSSWPWASLGSWVQYVLYGAVVWKVAEEWRQQGAAPVGSWWLHLLLLFAARGLTYQFWFSYGNMLFFTRRRRVVPDSVDFRQVDAEWDWDNFLLLQTLIGATLVGSPAVARQQLLLPSLKQAWDPRGWAIALLLHVLVAEPLFYWAHRALHRAPLFSRYHAAHHHASVTTPLTAGFGTPLESLLLTVVIGVPLAGAFLMGVGSVGLVYGHVLLFDFLRSMGYSNVEVISPRVFQAVPLLRYLIYTPTYLSLHHREKDSNFCLFMPIFDLLGGTLNHKSWELQKEVYLGKNDQAPDFVFLAHVVDIMASMHVPFVLRSCSSTPFANHFVLLPFWPVAFGFMLLMWCCSKNFLVSSYRLRGNLHQMWTVPRYGFQYFIPAAKKGINEQIELAILRADRMGVKVLSLAALNKNEALNGGGTLFVNKHPELRVRVVHGNTLTAAVILNEIPSNVKDVFLTGATSKLGRAIALYLCRKKIRVLMLTLSSERFLKIQREAPAEFQQYLVQVTKYQPAQNCKTWLVGKWLSPREQRWAPAGTHFHQFVVPPIIGFRRDCTYGKLAAMRLPKDVQGLGYCEFADMVGRRSPGNICVQYTMERGVVHACHAGGVVHFLEGWEHHEVGAIDVDRIDVVWKAALKHGLTPA

SEQ ID NO: 5797 - protein, 553 aa, Unknown
  Synechococcus sp. CC9605
MTPALTWWSGTVIYQLIVRSYSDGNGDGTGDFKGLAARLPYLRWLGVNTLWLTPIYPSPLRDGGYDITDFTGIHPDLGDLSSFHRFLTAAHSQGMRVILDLVLNHTSDLHPWFQRARWAPKGSPERDVYVWSDDPKRYAEAPVLFRHFEASNWEWDPVAEQYYLHRFLRHQPDLNYENPWVQDTMLEVVDFWLDRGVDGFRLDAVPFLFESEGTRCEGLPETHAFLTRLRERVDAHGRDVLLLGEAIQPVEEAAPYLADDELHGAFNFVLTAHLFAAIASGRTQQLGECLMQAEQAVSGPRWALPLRNHDELWLGDGHLVSDEVIQTIRVGLPQGQGHWLNWGINRRLAPLLNGDPRSNRLLHGLLYSLPGMPCLYYGDELGMGDWPGLRDRDPNRTPMAWTPARNGGFSTAPDPLLVLPPITAPGYDYRVVNVEVQKQLPGSLLNWHRRMLTCRRLLPALRHGSFRLLYSPHPGVLVYLRCTEAMTVLVAANVTAAGASLSLDLSEWTGERTREVMWGCEFPPAAAEWFVNLPPYGFNWWLIGEVEPAATAA

SEQ ID NO: 5798 - protein, 340 aa, Glycine max
  misc_feature (94)..(94): Xaa can be any naturally occurring amino acid
MQRTAAATEEPRRSSGDASAAEGEKVFKGSEVFGDTSPNYLKTILALALWLGTIHFNAALVLFAIFFLSLHKAFLLFGLLFVLMVIPVDEKSKXGRKLSRYICKHVCAYFPITLHVEDMKAFHPSRAYVFGYEPHSVLPIGVVALADNTCFMPLPKIKVLASSAIFYTPFLRHIWTWLGLTPVTKKRFTSLLDAGYSCILIPGGVQEAFLMEHGSEIAFLKARRGFVRIAMEKGKPLVPVFCFGQSNVYKWWKPGGKLVLNFARAVKFSPIYFWGIFGSPIPFKHPMHVVVGRPIELEKNHEPTPEEVARIHSQFVEALQDLFERHKARAGYPNLELRIV

SEQ ID NO: 5799 - protein, 331 aa, Herminiimonas arsenicoxydans
MNITILGAGAWGTALAMSLADRHSVMLWGRDAAVMQEAEQRRENTVYLPGFRLPDSLSLSSDFSAAIAHVGTDGLLLVATSLAGLRPLAMQLQPYAIPNIVWLCKGFEADTHLLPHQIVREVLGNDIPAGALSGPSFAQEVAQGLPCALAIASDNAALRELVVSAVHGPSMRIYSTDDVIGVEVGGAVKNILAIATGIIDGLKLGMNARAALITRGLVEITRFGVALGGRTETFMGLAGMGDLILTCTGDLSRNRKVGLGLAQGKKLEQIVTELGHVAEGVRCAQAVRSLAAERGIDMPITNAVAAVLFDGDLPREMVGRLLARDARNEMA

SEQ ID NO: 5800 - protein, 112 aa, Vibrio fischeri
MKIINAIIKPFKLDDVREALADAGVDGMTVSEVKGFGRQKGHTELYRGAEYQVDFLPKVKLEIAVQAEGVDRIVEAISKAAHTGKIGDGKIFVYDLQQAVRIRTGETNTEAL

SEQ ID NO: 5801 - protein, 420 aa, Wigglesworthia glossinidia
MNIYYKNFKKYDTKIYNIIKKEIIRQEEHIELIASENYASKYVMQMQGSLLTNKYAEGYPKNRYYRGCKYIDEIEDLAIKRAKKLFNVDYVNVQPHSGSQANFAVYSALLNPGDLVLGMKLNHGGHLTHGSKANFSGKMYKFISYGVNGEGKLDYNKLLNLANYYRPKMIVGGFSSYSGFINWKKMRFISDKVGAYLFADISHVAGLIVAGIYPNAIPYAHVVTTTTHKTLSGPRGGLILAKEGDDEFYKKLDSAVFPGTQGGPLMHIIAAKAVAFKEAMTLKFKKYQHQLVKNSKSMVEIFLKRKFHVVSGGTKNHLFILNLSNIGLKGDLASEILEKANITVNKNSIPNDKLNPKITSGIRIGTPAITKRGFKEIESKKVAEWICDILENINDKKLINNIKIKVINLCYKYPVYKSFK

SEQ ID NO: 5802 - protein, 513 aa, Arabidopsis thaliana
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 5803 - protein, 220 aa, Zea mays
  misc_feature (143)..(143): Xaa can be any naturally occurring amino acid
MGTPETSREPCPDRILDDVGGAFGMGAVGGSAFHFIKGIYNSPNGMRMSGGAQAVRMNAPRVGGSFAVWGGLFSTFDCAMVYARQKEDPWNSIIAGAATGGFLSMRQGMGAAGRSALMGGVLLALIEGAGLMLNRVLANPPLXQRDPNLTAAMGDNPFPGLPQAPPVVAPPEVASSSGAGGWFGGLIGRKDEEKKSSAGKSEILESFDTPSSPIPSFEYK

SEQ ID NO: 5804 - protein, 254 aa, Zea mays
TEWIRTDARRTAIGLDLDLESLEWCLENNLSKIGADGYSRMLLFHGNVLQPMESRLVKQKFTNLVHGLDLNSNNGTGSNSCKQMGLADSKCLANLTMSEADFPARDIICAFNYSCCCLHSRKDLVLYFRHVCSICKNLQHANRYIGNIYFWEQDEFDIISRQTRISLHFQGGKKQMLRYAFTYHWRLWSIPEIKDCLEEAGFKWVHVWMREMPNTQSGGNAKEYNANWDVKYEESQHFNQGDAWNAYVVGVANV

SEQ ID NO: 5805 - protein, 324 aa, Actinobacillus pleuropneumoniae
MAKQIKKIAVLTSGGDAPGMNAAIRGVVRAALNEGLEVYGVQDGYYGLYTDRVIPLDRRSVSETINRGGTFLGSARFPQFKDPDVRKKSVETLKKYDIDALVVIGGDGSYMGAKLITEEFGYPCIGIPGTIDNDIVGTDYTIGYQTALETAVEAIDRLRDTSTSHQRISIVEIMGRHCGDLTISAALASGCEYIIVPEKGLDKESLMRNIEDGFNKGKRHAIIAITELMTDVQALAKEIEDRFGHETRATVLGHIQRGGAPCPFDRILASRMGVYAVDLLLQGHGGRCIGIKNENLVHHDIIDAINNMRRPFKEELFEAARKLF

SEQ ID NO: 5806 - protein, 566 aa, Clostridium perfringens
MSKKIVIVGGVAGGASTAARLRRLDENNQIIMFERGPHVSFSNCCLPYYLSGKVENHEDLVLMTPEKFYSQYRIDARVYTEVVSINRKAKEVTVRNVVSGQEYTESYDKLVLSPGAKAIVPPIKGIEDVNVFTVRNVVDIAKLDSFIKDNNSKNISVIGGGFIGVEVAENLHEAGYNVTLIEAMDQIMKPFDYDMVQVLHKEMYDKGVNLIVGDKVSSFESGKVVLESGKKINSDAVVMAIGVAPETDLAREAGLEIGQTGAIKVNQNYLTNDKDIYAVGDAVEVYNSLTNSISRLPLAGPAQKQARAVADHIHGRPSRNSGYIGSSCVQIFDYNGASTGLTEGQIKAMNLSLNYDVVRVIPQDKVGLMPGSEPLHFKLIFEVPTGRILGAQAIGKGNADKRVDIIATLIKMGGTVEDLKDLELCYAPPFGTAKDVVNHAALVASNLLEGTFKQVYVHEVRDLVESGACIIDVREVSEYEAGHIKGAKNLPLSEIRDRLDEIPTDRPVYLHCRSAQRSYNACLALQHLGFDNIYNVSGGFMGISFYEYYNDKVQDREPIVTEYNFN

SEQ ID NO: 5807 - protein, 891 aa, Glycine max
ITNMLTWWGKSSSKETKKKANKESFFDTLHRKLRISSKGKVSIRSGGSRRHCNDTISEKGDHSPCGSRSPSPSKVARCQSFIDRPHAQPLPLPGLHPSSVGRVDSEISISSKSRLEKVSKPLSFLTLPTPGCIRCRPNPADLDGDMVTASVFSDCSADSDEPADSHNRSPLAIDCETGTRTAAGSPSSLMLKDQPPAVSQLNSTGVKKPGNILSNHMSSTSPKRRPLRNHVPNLQVPPHGAFYSAPDSSLSSPSRSPLRAFGTDQVLNSAFLAGKPYPEINFVGSGHCSSPGSGHNSGHNSMGGDMSGPLLWQPSRGSPEYSPVPSPRMTSPGPSSRIQSGAVTPIHPKAGGTPTESQTHRLPLPPLSVSNSSLFSHSNSAATSPSMPRSPARADNPNSGSRWKKGKLLGSGSFGHVYLGFNSERGEMCAVKEVTLFSDDPKSMESAKQFMQEIHLLSRLQHPNIVQYYGSETVDNKLYIYLEYVSGGSIHKLLQEYGQFGELVIRSYTQQILSGLAYLHAKNTLHRDIKGANILVDPTGRVKLADFGMAKHITGQSCLLSFKGTPYWMAPEVIKNSNGCNLAVDIWSLGCTVLEMATTKPPWFQYEAVAAMFKIGNSKELPTIPDHLSNEGKDFVRKCLQRNPYDRPSACELLDHPFVKNAAPLERPILAPEVLDPVSGIIQGAKALAAGQGKNLSSLDSDRLSIHSSRFLKTNPRESEIHIPRNISCPVSPIGSPLLRSRSPQHRNGRMSPSPISSPRTASGASTPLAGGSGAIPFGNHSKQPIYFQEGFGSIPKSSNGVYINGHSHHDSSVDIFRGMQIGSHIQPELVSSENDVLVNQFARHPHAEPYDFQSVLADRVGRQLLREHVKINPSIDLSPNSSLLSRPNGL

SEQ ID NO: 5808 - protein, 48 aa, Antirrhinum majus
AVYVGENEKKRFVIPLSHLNERLFQDVLCRADEEFGFHHPMGGLTIPC

SEQ ID NO: 5809 - protein, 247 aa, Cryphonectria parasitica
MELDIDLPDFGPFEGGAPVSEFSSPDNPVFGLDLSGSLHSSVMSVSPTELLLTENLMSAPGSTALTHLTTPSGYDTSPAFTEDWNASPLFAQNDFETAQEWPSLFPDAETSAAPAPALAAPAPVPAAQAEDSPSVDSEDFEPARRPSQARKSSASSSPSGRHSSVSGVSARRRGKPLPPITIDDPSDTVGMKRAKNTLAARKSRARKAERMDELERQVRELEAEKEKLAAELAHWKSLASSQGAAGQ

SEQ ID NO: 5810 - protein, 136 aa, Triticum aestivum
MAALVGDAAYWLAEHPDIVGFRWSPSGLWFSTWAFLLGFLATYVSLCLAADALLRRRKQPLPLGPLPAAHALLMAAVSAAIFAGTLLSAVAEIRDTRWSWRGRSRTTPLRWLLCFPPGTRSSDRVFFWSYAYYLSR

SEQ ID NO: 5811 - protein, 462 aa, Geobacillus kaustophilus
MEQKQPQLHRGLEERHISLMSLGAAIGVGLFLGSASAIEMAGPAILLGYAVSGAIMFFIMRALGEMAVEHPVAGSFSRYAYQYLGPLAGYLTGWNYWFLWVVTCIAEITAVGIYMQFWFPDTPRWAWALAALVLMTFINFLAVKAYGEFEFWFALIKIVTIVAMIIIGLGMILFGIGNGGVATGISNLWKHGGFFPHGISGVLMSLQMVMFAYLGIEMIGVTAGEVKNPQKSLTKAINSVFWRILIFYVGALFVIMSIYPWNEIGEKGSPFVLTFEKIGIHAAAGIINFVVLTAALSSCNSGIFSTSRMLFNLAEQQEAPSAFGRLTKRGIPGAALIATALVMLVGVYLNYVSEKVFQWVTSIATFGAIWTWAVILLSQLKFRKQLSAEQAQRLTFKLPLYPYSSYVSLAFLIGVAALMAYFPDTRIALIIGPAWLLLLTAVYFAKGMHRRQHGQAEEKQAG

SEQ ID NO: 5812 - protein, 448 aa, Yersinia pestis
MMNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 5813 - protein, 191 aa, Brassica napus
  misc_feature (158)..(158): Xaa can be any naturally occurring amino acid
TDGVNGRCFCNPTLTLKFPFLGFSKLSTDSGIQSSVNNTESELREIRLSLLMEIEKRKQTEEVLEQMQIHWQRLREQLAQVGVFVPIDPTISTNNSNISEELCCQLEAARFVSDSVSRGMAKAEVEMEMDSMLETKNFEITRLFDRVHHYEPVNREMXQRNQEAIGNRKPYYSFVIHLCLSWSYISNLQLC

SEQ ID NO: 5814 - protein, 200 aa, Zea mays
  misc_feature (29)..(29): Xaa can be any naturally occurring amino acid
MDPNKSSTPPPPPVMGAPVAYPPPAYPSXVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAAAAAAAAAGIPRPAAGVPATDPLAYYYVPQQ

SEQ ID NO: 5815 - protein, 566 aa, Aspergillus nidulans
MFSGSSSPPKDKSDTIPRSGPINTPSLSIQTEGTVGSQAKSPPPTSFFGRRASEEQSPGGDKKRRSSTVSKAASFFANAKNSLSLSSPRTESALSSSLPESSLHRYGNMDPALNVPQGSLNNSAGESSPTPRSSFRVGVTEDRNKKCRRTMEDTHAYLYNFLGNPVPSAQNDDSDQSSHPSDASPKTGELTPIVETDNGYFAIFDGHAGTFAAQWCGKKLHLILEDVMRKNINAPVPELLDQTFTSVDQQLEKLPVKNSGCTAVVALLRWEDRIPTPSSVTGSSAIGPAAVAATKAGADSKADDTPTQEAAATPVPAIPPKLREKAIRQRVLYTANVGDARVILCRNGKALRLSYDHKGSDENEGRRIANAGGLILNNRVNGVLAVTRALGDAYIKDLVTGHPYTTETVIQPDLDEFIILACDGLWDVCSDQEAVDLIRNVSDAQEASKILVDHALARFSTDNLSCMVIRLYADRHREVASQAVDLAGWESRSSRGLSETDKIVEGARKSMANTGIADESETLKKVHDEAEECTPEEVPESILSASPNAPAATLNQPNKPGSSDST

SEQ ID NO: 5816 - protein, 305 aa, Unknown
  marine gamma proteobacterium HTCC2143
MAHAKKFGSRTDSDQVLDGLDLTGKKVVVTGANTGIGYETARSLAVAGAEVVVACRSEDKGKSAVDAIQKCHNDVRVEFKKLDLSSIESVKAFSENLSWDTIDVIIGNAGLVPTNYQQTDEGIEQCVGVCHFGHFALCKLLLPRLLKSKDPRVVMVSSESHRAPKKLNFKKFPLTKTNFAVFTAYGQAKLCNVLFVNELQRRFGDQGLNACSLHPGTLITTDIGRNSGLFSLLMTLISPLTKTPNQGASTTVYCAAYINGKDMQGAYFSHCKRGKSSAEANDPEVAKHLWDISEAFCEEHNVANI

SEQ ID NO: 5817 - protein, 356 aa, Saccharum officinarum
MASLTDLVNLSLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRHNAAKIFSNPEVAAEEPWYGIEQEYTLLQKDTNWPLGWPIGGFPGPQGPYYCGIGADKSFGRDIVDAHYKACLYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 5818 - protein, 353 aa, Triticum aestivum
  misc_feature (228)..(228): Xaa can be any naturally occurring amino acid
  misc_feature (253)..(253): Xaa can be any naturally occurring amino acid
  misc_feature (290)..(290): Xaa can be any naturally occurring amino acid
NKFVQKSRLVPVRNSRDFGDPRVRFSLSSSTLFHCPLVVSSARIKMEGWTRGKCIGKGAFGTVHLAVHRATGRAFAVKSVHAKGAAPAAAMACLETEIRILRRLSSPYVVAYLGDDATASSRNLHMELVSGGSAAARGAAGLGERAARCVLRRVAAALHYLHDVAGVVHGDVKGRNVLVGGDGAEYGSSKLADFGAARLVSEPAPRGPRGTPAWMAPEVARGGASTPXSDVWSLGCTAVELLTGKRPWSENGXALEVGELLLHFGYGVKRPELPACLSDSCSDFLDKCLXREPGDRWSCNQLLRHPFLSGDPQDAGEPSPSRSREGVFDWAGLESGFRSVFRRAFGGPNLRTR

SEQ ID NO: 5819 - protein, 318 aa, Pseudoalteromonas tunicata
MSTAKHCKLLILGSGPAGYTAAVYAARANLNPVLITGMQQGGQLTTTTEVENWPGDAHGLTGPALMDRMKEHAERFETEILFDHIHTVDVKNRPFTLTGDNGVYTCDALIIATGASATYLGLESEENFKGRGVSACATCDGFFYRNQKVAVVGGGNTAVEEALYLSNIASEVHVIHRRDSFRSEKILAERLKDKAANGNVVLHLNRTLDEVLGDQMGVTGIRIKATDSDATEELDLAGVFIAIGHKPNTDMFVDQLEMKDGYLVVQSGLHGNATQTSVEGVFAAGDVCDHIYRQAITSAGTGCMAALDAERYLDNLKA

SEQ ID NO: 5820 - protein, 376 aa, Xanthomonas campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTTDQRELLKQFEATFTGEDARKHSPKSATFIDGVKGFWDRMTS

SEQ ID NO: 5821 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGEPCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5822 - protein, 382 aa, Ehrlichia ruminantium
MSKSDYYDLLGLSKNATPEEIKKAYRKMALKYHPDKNPGDKAAEEKFKELSEAYDVLIDKDKRAAYDRYGHSAFSDGSGRGGFDFNSGFSTDFSDIFNDLFGGGFRGGRSSSKRQDGGTVGSDLRLDIEITLEDSFNGTKVPINYVTHVKCSSCSGSGSEGSVKSVQCNTCHGAGNIRTQQGFFTIERTCHVCNGEGEIIKNKCKKCSGSGRVRDEVNLLVTVPKGIESGDKIRLNGKGEAGYRGAQSGDLYVYPNIKKHKFFTRNGADLYCNVPIKMILATLGGHIEMPSIDGTWTKVKVPEGSQNGDKLRLKEKGMPVINSSRRGDMYIQITVETPINLTKQQKELLKKFDEEPNTVECNPQSTGFFQKVKSFWNDIRSS

SEQ ID NO: 5823 - protein, 591 aa, Prevotella intermedia
MANFENVNPLSDFNWDDFENGVTVGGDKEELTKAYDNTLNKIQEHQVVEGEVISIDKKEVVVNIGYKSDGIIPASEFRYNPELKVGDKVEVYVENQEDKSGQLILSHKKARLQKSWVNINEALEADAVIQGYIKSRTKGGMIVDVFGIEAFLPGSQIDVHPIRDYDVFVGKTMEFKVVKINQEFRNVVVSHKALIEAELEAQRKEIISHLEKGQILEGVVKNITSYGVFVDLGGVDGLIHITDLSWGRINDPHEVVELDQKINVVILDFDEEKKRIALGLKQLAPHPWDALDPNLKVGDHVKGKVVVMADYGAFVEIQPGVEGLIHVSEMSWSQHLRSAQEFMKAGDEVEAVVLTLDRDERKMSLGIKQLKEDPWEAIEAKYPVGSKHVAKVRNFTNFGIFVELEEGVDGLIHISDLSWTKKVKHPSEFTQVGADMDVIVLEIDKENRRLSLGHKQLETNPWDTYESIYTPGSTHVGKITESMDKGAVITLNEGGEGFATPKHLVKEDGSQAQLGEELPFVVIEFVKDTKRIILSHSRTFEEVKEEQARRQRTASKKHSEPASQINNVAAGTSLGDLDVLADLKKKMEEGK

SEQ ID NO: 5824 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5825 - protein, 272 aa, Leptospira interrogans
MEELFSKLGYSGLFGIIWTSFLIRYLLFSGISFWVVWILFEKKFFHKLIQGKKPAKENIIHEVKYSFVTFFIFALSGVFVVWAKRNGYNQIYENVEDYGILYLIFSLLALIFLHDFYFYWTHRMMHHKFLFKHVHLAHHKSINPSPWAAFSFHPLEAIIEAGIVPIVSFVLPLHPGVMIVFFVYMTSLNVLGHLSYEFFPSWFLRNKFTNWHNTTTHHNMHHKYFNCNYSLYFNFWDKIMRTNHEKYKEKFEEVSSRSPNKDYILEKSKILT

SEQ ID NO: 5826 - protein, 264 aa, Thermococcus kodakarensis
MKVAYVQMEPVFLDPEANYSRAEKLIREAADQGAKLVVLPELFDTGYNFRSREEVEEVAGQIPDGPTTEFLVELAKELEVFIVAGTAEKDEKGNLYNSAVLVGPVGWGYIGKYRKIHLFNREKLFFRPGNLGFHVFNIGIAKVGVMICFDWFFPESARTLALKGADVIAHPSNLVMPYAPRAMPIRALENRVYTITANRIGEEFGLRFIGKSTIASPRAEVLAMGSEDKEEVGVVEIDLSLARDKRINEMNDIFKDRRPQYYTL

SEQ ID NO: 5827 - protein, 81 aa, Glycine max
GNADAEQRSHAHRVPDITPQCYSLIINMPYPKSRFCRGIPDTKITIYDVGMMYNGLDEFPFCVQLVTWNKANVSTYVLEAT

SEQ ID NO: 5828 - protein, 333 aa, Festuca pratensis
MAKHGAFAAALVVGLLAAIPAAVESIGVCYGVNGDRLPSASEVVQLYKSNGITGMRVYNVNDNTRPEGPERQQPRPHPRHRQHTAQCPRFQRLQRGHVGQLVKANVQSQQGLAIKYIAVGNEVPNQGGNTADILPAMKNIQAALVRAGLGGIKVSTAVHSGVTQGFPPSQGTFSAAHMPPIAQYLASIDSPLLANIYPYISFKGTPSIDIKYALFTAPGTVVTDGRNSYQNLFDALIDTMYSALESAGAGSVPIVVSESGWPSAGDLDATAANARTYNQNLINHVGKGDPKKPGAIEAYIFAMFNENLKGGLETEKHFGLFNADKSPAYSINF

SEQ ID NO: 5829 - protein, 55 aa, Passiflora ligularis
  misc_feature (54)..(54): Xaa can be any naturally occurring amino acid
WEYQVGPSVGIDAGDHIWCSRYILEKITEQAGVVLSLDPKPIEGDWNGPGGHTXY

SEQ ID NO: 5830 - protein, 276 aa, Thiomicrospira crunogena
MLYPTWGQQFVMNDVLFEVDTGHQHLIIFKNDQWGTVMALDGVIQTTEKDEFIYHEMMTHVPMFAHGNAKKVLIIGGGDGGILREVLKHPTVDAVTQVEIDQQVIDMCKQYLPKHSAGAFEHPKANVVIADGVDFVNECTEKFDVIISDSTDPIGPGEVLFTSRFYQGIQSCLNDGGVFVAQNGVSFMQTDEVTTTFKRLSPLFNESSFYSAAVPTYVGGIMTFAWATNDLSLKQQSVDVIRSRYDAAAIETRFYTPELHIGAFALPKYVQQAIQA

SEQ ID NO: 5831 - protein, 122 aa, Glycine max
  misc_feature (96)..(96): Xaa can be any naturally occurring amino acid
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 5832 - protein, 448 aa, Oceanobacillus iheyensis
MTHVSFNYEKALSFFEKQEITNLEPFVHTAHQMIHERIGAGKDFLGWLDLPRNYNREEYTRIKAAADKIKKDSDILLVIGIGGSYLGAKAALEMLNHSFQNLLSKDQRQVPQIIFVGHHLSSTYMTELFDILKDKDFSINVISKSGTTTEPAIAFRVFKKYLEEKYGQDEAKKRIYATTDRSKGALKTTADSNDYETFVIPDDVGGRYSVLTAVGLLPIAASGINIDDMMEGAKAGMEDLANPVISENPAYQYAAVRNILYQKGKVTELLINYEPNLQYFSEWWKQLFGESEGKNQKGIYPSSANFTTDLHSLGQYIQEGRRNIFETILHVNEPKKDFTLEKEESDLDGLNYLAGKSIHEINDKAFQGTLLAHTDGDVPNLIVEVPRLDAYTFGYLVYFFEKACAISGYILGVNPFDQPGVEAYKKNMFALLGKPGFEDQKEALEKRL

SEQ ID NO: 5833 - protein, 121 aa, Mycobacterium smegmatis
MTSIYEQIGGAEALEVVVEDFYRRVLADDELAGFFTGTNMSRLKGRQVEFFATALGGPDEYTGAPMRQVHQGRGITMHHFDLVAGHLGDALSAAGMPGATTSQIIAAIAPLAPEIATARTA

SEQ ID NO: 5834 - protein, 570 aa, Unknown
  Klebsiella sp. LX3
APSLNQDIHVQKESEYPAWWKEAVFYQIYPRSFKDTNDDGIGDIRGIIEKLDYLKSLGIDAIWINPHYDSPNTDNGYDISNYRQIMKEYGTMEDFDSLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSGMRFDTVATYSKIPGFPNLTPEQQKNFAEQYTMGPNIHRYIQEMNRKVLSRYDVATAGEIFGVPLDRSSQFFDRRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQAAAPHSTSLSLSPWQAGVYKLR

SEQ ID NO: 5835 - protein, 368 aa, Oryza sativa
MDMASIECVSYSDSMDDDDDDGVGVGGVSHLPRPILVKPSSAAAAVNVVVVSAGSGGGAGGGGGGVGVVAGAPAVPPATSVHELLECPVCTNSMYPPIHQLGHWEPEELPSMLSVILLECQNGHTLCSTCKTRVHNRCPTCRQELGDIRCLALEKVAESLELPCKYYSLGCPEIFPYYSKLKHESQCNFRPYNCPYAGSECSVVGDIPFLVAHLRDDHKVDMHSGCTFNHRYVKSNPREVENATWMLTVFHCFGQYFCLHFEAFQLGVAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 5836 - protein, 495 aa, Symbiobacterium thermophilum
MQGARATVAGEKQLSLNLAQRIGLVLGPTLCLLIYLFFRPAGLGPEGVAALAGTAWIAAWWVTEAIPIPITSLLPVILFPVLGLGSVGEVVSAYADPTLFLFLGGFIIAVAIERWNLHRRIALAVISAVGTSPSRLVLGFMLATGVLSAFISNSATAMMMLPIGIAVVKQITELRVRNGEKVYPDQEPFSALILLAIAYAASIGGVGSIIGSPPNAIMVGVAASTLGVEISFFDYMLVGVPMFLVFTLVAWRILLWVMPPGFAEVAGSREWVRRQMAELGPMSGEERKVLGVFCATALLWITYPFLLKGVVPGISDAMVAIFGASLLFLIPGGEGGFLLDESALKELPWGVLLLFGAGFCIAEVFQSTGVAVWLAGFLQVLAGAPYFLIVIAVAAMVTFLTEITSNTAIAAIFMPIMASLATALGAAPTGLMVVAALAGSLAFMLPVGTPPNAIVFSSGRVTIRQMIRVGFFLNLAAIATITLIGCFWVPLVWGR

SEQ ID NO: 5837 - protein, 634 aa, Penicillium canescens
MKFLTGLSLLSLAAPSLGTPAARHFPRNEMTQHEQPLIKVRPQRTSSRELVNLDGLWKFALASGLNDTAQPWTAPLPKGLECPVPASYNDIFISREIHDHVGWVYYQREVIVPKGWSQERYLVRAESATHHGRIYVNNRLVAEHVGGYTPFEADVTELVAPGEKFRLTIGVNNELTHETIPPGKITTGNATGKRIQTYQHDFYNYAGLARSIWLYSVPQQHIQDITVVTDVDGDNGLINYEVEVANQTTGQIQISVIDEDGAIVAKASGAQGTVTIPSVKLWQPGAAYLYQLQVNIVGSSGDVVDTYNLATGVRTVKVAGSQFLINGKPFYFTGFGKHEDTAVRGKGHDPAYMVHDFQLMKWIGANSFRTSHYPYAEEVMDFADRNGIVVIDETPAVGLNIALMGVSESGAPQTFTPDAINDKTQEAHKQAIRELIARDKNHASVVMWSIANEPASHEDGAREYFEPLTNLTRQLDPTRPITFANVGTATYQLDRISDLFDVSCINRYFGWYSQTGDLEEAEAALEKELHGWQEKFHRPIVMTEYGADTLAGLHSILGLPWSEEFQVQMLDMYHRVFDRIESMAGEHVWNFADFQTNLGIIRVDGNKKGVFTRDRKPKAAAHSLRARWTSIDKN

SEQ ID NO: 5838 - protein, 276 aa, Unknown
  Shewanella sp. MR-7
MEILSLPGQRAKGKVWLVGAGPGDVELLTLKAWRILKSADAVLYDALVSQDILDLIPKDAEKIAVGKRAGKHSAAQDEINQLLVTKAYTRKNVVRLKGGDPFIFGRGGEELQTLVEAGVEFEVVPGITAASGTSAYAGIPLTHRDYAQGVTFITGHCQLESRPMDWQGYANPNNTLVVYMGILNAGIIRQGLIDAGRSPKTPVAIVSKATTQSQQRFIGQLDSLEQLAADPQLQMPALMIIGEVVALADSLNWFQPKGEGESALDTADAAKIVAKI

SEQ ID NO: 5839 - protein, 386 aa, Cucurbita maxima
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGPSFSHHGKAYQECGIALNELGTKIVELLGLSLGISREYFKNFFEDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPDCNTLEAFKTWVQEGKALDTGSTITAPSA

SEQ ID NO: 5840 - protein, 102 aa, Zea mays
  misc_feature (18)..(18): Xaa can be any naturally occurring amino acid
  misc_feature (26)..(26): Xaa can be any naturally occurring amino acid
  misc_feature (32)..(32): Xaa can be any naturally occurring amino acid
  misc_feature (53)..(53): Xaa can be any naturally occurring amino acid
  misc_feature (65)..(65): Xaa can be any naturally occurring amino acid
  misc_feature (88)..(88): Xaa can be any naturally occurring amino acid
  misc_feature (95)..(95): Xaa can be any naturally occurring amino acid
MDTHIGSVNGAASNQTVXGCPASADXPMASTXAPGLTSVAAGCVAGGHLARRXVQVGVNELFAVXPGDFKLTLLDHLIAEPALRLVGXCNELNAXYAADRYA

SEQ ID NO: 5841 - protein, 634 aa, Penicillium canescens
  misc_feature (31)..(31): Xaa can be any naturally occurring amino acid
  misc_feature (373)..(373): Xaa can be any naturally occurring amino acid
MKFLTRLSLLSLAAPSLGTPAARHFPRNEMXQNEQPLIKIRPQRTSSRDLVNLDGLWKFALASGPNDTAQPWTAPLPKGLECPVPASYNDIFISREIHDHVGWVYYQREVIVPKGWSQERYLVRAESATHHGRIYVNNRLVAEHVGGYTPFEADITDLVVPGEKFRLTIGVNNELTHETIPPGEITTANATGKRIQTYQHDFYNYAGLARSIWLYSVPQQHIQDITVVTDVDGDNGLINYEVEVANQTTGQIQISVIDEDGAIVANASGAQGTVTIPSVKLWQPGAAYLYQLQVNVVDSSGDVVDTYNLATGVRTVKISGSQFLINGKPFYFTGFGRHEDTAVRGKGHDPAYMVHDFQLMKWIGANSFRTSHXPYAEEVMDFADRNGIVVIDETPAVGLNIALMGVSESGAPQTFTPDGINDKTQEAHKQAIRELIARDKNHASVVMWSIANEPASQEDGAREYFEPLANLTRQLDPTRPITFANVGAATYQLDRISDLFDVSCINRYFGWYSQTGDLEEAEAALEKELRGWQEKFHRPIIMSEYGADTLAGLHSILALPWSEEFQVQMLDMYHRVFDRIESMAGEHVWNFADFQTNLGVIRVDGNKKGVFTRDRKPKAAAHSLRARWTNGDKN

SEQ ID NO: 5842 - protein, 263 aa, Zea mays
  misc_feature (28)..(28): Xaa can be any naturally occurring amino acid
PQPPKLKANHQTPGHGARAHFRCRAQDXPFLGARRALANAAAKPAPRRALVVAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGWVESKRWVDFFNPDSQAVEWATPWSRTAENFANFTGEQGYPGGKFFDPLGLAGTVKDGVYIPDVDKLERLKLAEIKHARIAMLAMLAFYFEAGQGKTPLGALGL

SEQ ID NO: 5843 - protein, 87 aa, Phaseolus vulgaris
QKTIIFLINNGGYTIEVEIHDGPYNVIKNWNYTGLVDAIHNGEGKCWTTKVSFLKLTSNFIDATWGVEYLVFIHSCMVHLRCSVKRS

SEQ ID NO: 5844 - protein, 963 aa, Xanthomonas campestris
MTPAVMQQQATTTAQRVSERGVGVAMTGAMRLRVVLYRLCRRARDGRPGTTQQPLQRSLRAGCMALICLCTTAGVVTAAEPTNAPRERISLNADWRFRRGDPPGNTVRLEYDVRPEVVRSEDGKVADARPEQAQRIDADARNVLKPWILPTANSLIADPTQRHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQQMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVHAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGEPTPYYSSRSSYSGILDLAGFPKDRYWLYQARWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAE

SEQ ID NO: 5845 - protein, 715 aa, Escherichia coli
  misc_feature (140)..(140): Xaa can be any naturally occurring amino acid
MKKVVTVCPYCASGCKINVVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 5846 - protein, 456 aa, Desulfitobacterium hafniense
MKVLLIQPPSSTAFMDKVYMYEPLGLEYLGAGLQEDGHEVLLLDARLEPDFEKAFHSFQPDIVGITGYTNHLNIVKAIAARFKSINPEVFIIVGGHHATVKPADYNDQAIDLIIIGEGVFTLRQVLKHKESLLPFEDIPGLAIPGAVMKFTAERPYTPLDDLPFPDRSLTARYRNHYFSDWMKPIASIRTSLGCFGRCNFCALWSITNGKYLQRNPERIVAELQGIQEEIVFFCDDESMCDTRRMDQLADLIQEAGIRKKYFLYGRVDTIVKHPELFAKWKNIGLIQVFVGFESFSDERLQGLNKNITVAQQEEAVKILNDLNIDIYASFVIDPSFTRQEFTQLIAYTRKLNIAYAALSVLTPLPGTALYEQNKDRLLTHDPKFFDFMHTVLPTALPLKQFYSEYARTLMKATPIPRYFRFIAKFDRQRRLSTMKELYGVVGDVRKGYQWHQAKES

SEQ ID NO: 5847 - protein, 780 aa, Oryza sativa
  misc_feature (20)..(20): Xaa can be any naturally occurring amino acid
  misc_feature (551)..(551): Xaa can be any naturally occurring amino acid
MPHRRRLLNPAPSLPPPPAXAAPAGFHHHLLAVDDTRLPLLADYALLQGDAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEXAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 5848 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLPLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCDPRIYPDFTWPMLLEFTQKHYRADMKTLEVFTNWLHQRSFS

SEQ ID NO: 5849 - protein, 333 aa, Bifidobacterium longum
MGKNITVLGAGAWGTAFGQVLADAGNTVTMWAKEQQIVEGIRDHHHNAVRLPSVEKLPDNMTATGDRAEAVKNADIVVVAIAAQFARVALVEFKGLIPDHAIVVSLMKGIERGTNKRMDEVVRESLDLPADRFAAISGPNLSKEIADRHPAATVVACTNLDNATKVAEACTTSYFKPFVTTDVIGLEMCGSLKNVTALAVGMARGAGYGENTAAMIETRGLAELTALGVAAGADPKTFFGLAGVGDLIATCGSSLSRNYTFGANLGKGLTVEEATKVSNGVAEGVPTTDAVVALGDQLDVPTPLAYQMSRVLNEGISCSEMLAGLFGHEVTGE

SEQ ID NO: 5850 - protein, 249 aa, Brassica napus
  misc_feature (217)..(217): Xaa can be any naturally occurring amino acid
  misc_feature (243)..(243): Xaa can be any naturally occurring amino acid
MERKPLEVESTDHQKPPSAVYDGSVMAVDSVEEEVGETKVVYRGWKVMPFIIGNETFEKLGIIGTLSNLLVYLTAVFNMKSITAATIINAFSGTINFGTFVAAFLCDTYFGRYKTLTVAVIACFLGSLVILLTAAVPQLHPAPCGTALSCIGPSGGQIAFLLLGLGFLVVGAGGIRPCNLAFGADQFNPKSESGKRGIDSFFNWYFFTFTFAQILSXLTLIVYIQSNVSWTIGLTIPVVLMFXLACVIF

SEQ ID NO: 5851 - protein, 208 aa, Linum usitatissimum
WILKYIAVGNEVLYWKDRNVIAYTLPAMKTVHHALQLANLTDIKVTTPHALSFLAASEPPSTGVFKKFDGEILEPILDFHRRTKTPFMVNPYPFFGYRDEVKDYAVFRPSKGLYDKHTGINYTNMFDEQMDAVYSSMKKLGKGYEEDVEIVIGETGWPSAGDPNQPGISLENALSYNGNVVKHVNSGKGTPLMPNRTFETYLSALLVP

SEQ ID NO: 5852 - protein, 418 aa, Streptomyces coelicolor
MSVTHEIIEADDSSVGVLLRQDPELAEILFAEGRRQSTTLQLIAAENFTSPAVLAALGSPLANKYAEGYPGARHHGGCEIVDVAERLAAQRAQALFGAEHANVQSHSGSSAVLAAYAALLRPGDTVLALGLPYGGHLTHGSPANFSGRWFDFVGYGVDAETGLIDHDQVRTLARARRPKAIVCGSIAYPRHLDYAAFRDIADEVGAYLIADAAHPIGLVAGGAAPSPVPYADIVCATTHKVLRGPRGGMILCGSELAERVDRAVFPFTQGGAQMHTIAAKAVAFGEAATPAFAAYAHQVVANARALAAHLAAEGLVVTTGGTDTHLLTADPAPLGVDGKTARGLLAAAGIVLDCCALPHADARGLRLGTAAVTTQGMGEREMRAVATLVAGVLRGTTDPAAARADVRDLTAEFPPYPD

SEQ ID NO: 5853 - protein, 561 aa, Aspergillus oryzae
MPRDEAQDLLLADQNGIDRLESQSLLPESPSEERDALTPFDTTPHSPISPPTLSDETQHQRQSSFAQPVAEGQRRAPRTLNRVRFDLDDDTDDEHRSNGYPRHSGDSWLEGEDYARGDNTRSGRSATGQTVPLLTDIEAPSVTLATSDDFFPEEHLENARPRSGMRMAFMNMANSIIGAGIIGQPYALRQAGMLMGLTLLVALTVAVDWTIRLIVINSKLSGADSYQATMQHCFGKSGLIAISIAQWAFAFGGMIAFCIIVGDTIPHVLGSLFPSLRDMSFLWLLTDRRAVIVLLVLGISYPLSLYRDIAKLAKASTLALLSMVVILVAVLTQGFRVPSESRGEVKSLMIVNSGFFQAVGVISFGRSQTALLIYGSLKKPTLDRFARVTHYSTGVSLAMCLTMGISGFLFFGSQTQGNVLNNFPSDNIIVNVARFCLGLNMLTTLPLEAFVCREVMTTYYFSDEPFNMNRHIIFTSALVVSAMTMALITCDLGAVFELIGATSAAALAYIFPPLCYIKLSNASRKAKIPAYLCIVFGITVMGVSLLQAIAKMIRSKLKTLN

SEQ ID NO: 5854 - protein, 302 aa, Thiobacillus denitrificans
MEFGIIGLGRMGGNMARRLGRKGIRIALYNRSRDVSDAIAAEAGHLACGTPEELVAALQAPRIVWLMLPAGKATEDAVSALLPLLDAGDLLVDGANAYYKDDQRRAALLADRQIDYADAGVSGGVWGLENGYCIMFGGSDVAAARLKPYMEALAPSPTTGWLHTGPVGSGHFVKMVHNGIEYGMMQAFAEGFALMKNKPGFDLDVGAIAELWRHGSVVRSWLLDLSADFLAQDSTLDAIEPFVADSGEGRWTALESIEQGVPTPVMSLALMMRFATQGKNDYAAKMLAKMRQGFGGHAVKEA

SEQ ID NO: 5855 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGVYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5856 - protein, 624 aa, Chlorobium tepidum
MHERIAIIAITETGIALARSLKSLLVADGFAGCGLFSSRVAEGVEPIESVPAFVRHSFGSFDAFLFIGSLGICVRSIAPVLQGKLRDPAVINCDESGRFVQSVLSGHAGGANALAGRVARLLGAQAVLSTSSDVQGLWPLDILGREEGWGVEFASPVAGESMTTAMAAFVNHEPTTLLLDVRDSLTDELERTAPPFVTIAYRYEEVDFSTCSLLLAVTPRIIEASVQTVFYRPKVLCVGVGSERGIDPERFVSSISEQFASNGFSMRSIRSVGSVDFKLNEEAFIAFAEACGTTLTGFTPEQLESVGPVPNPSDVVFRKTGVHSVSEASAALLSGENRWLIEKQKISLDGIPEGEPRHYTFAVSLLRGAERRGRIAIVGAGPGDPELVTVKGKRYLEQADLILYAGSLVPEKLTHYAKPGALVRSSASLSLEEQFALMERFYRQGKFVVRLHTGDPSIYGAIQEQMAFFDAEGFEYEIVPGVSSFQAAAAVLQSQFTVPEKVQTIILTRGSGRTPVPDKERLSELARARATMCIYLSAEWSDQVQSELLEHYAPDTPVAVCYRLTWDDQQVWRGRLDGLASLVRESGKTRTVLLVVGEAIGARGGRSKLYDPSFTHGFREGHGA

SEQ ID NO: 5857 - protein, 560 aa, Rhizopus oryzae
MPSIKIGQHLLNRLKEINIDVVFGVPGDFNMPLLDIIEDDPELTWGNNANELNASYAADGYARIRGAGAVVTTFGVGELSAVNGIAGSYSEMLPVIHIVGTPSTKSQAAGAMLHHSLGDGNFDVFFNMSSMIACASAHLKKQTAIAEIDRVISQAVLSKRTGYIGIPIDLIKTEVEVPEPIPALKTELPKNPADVQAIALRVVTDAIAKAQFPVIIVDGCVLRQRCQKAVQAFIERSGFPTYVAPMGKGAVDESSVSYRGCYSGNVTLEAVNEEIKQADLIIEVGSIKSDFNTGNFSYSLDRSKTITLHSFATIVFCAEYQKVSMLEFVPLLTQALPEQPRQFNLGPRPRPVPIQPGTEITHNYFWHKVPEFMDENAIVCAETGTAEFASLNMDGPKGTTYITQFLWGSIGFSVGAAVGAAIAARDRRVYLFVGDGSFQLTCQEISGFLRHGLTPVVFLLNNDGYLIEKLIHGPERAYNNYQMWNYSKSLDYFGAHLEHNKSMGVPPVGFEGKVATRDEFESAMRQVQANPDKIHFLEVIMPQFDSPRELELLVANSENR

SEQ ID NO: 5858 - protein, 139 aa, Brassica napus
  misc_feature (19)..(19): Xaa can be any naturally occurring amino acid
MQGALCIKPTILPLSSPLXSPKLTILLPQTITNTKASRLSSLRPNGSSPTTSDPLTGDYDSLLSVFPAEACEVISGYACSADIYPEVKLETKPISRPVTSENVDREYIEYNTPKTVFVSEACDDLGGEFCEPDYQKDVY

SEQ ID NO: 5859 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFRNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 5860 - protein, 267 aa, Chlorobium tepidum
MSDGKGKVFLVGGGPGDPELLTIRAHNVLQSADVVLHDALISPEILALLPNGAERISVGKRLGDGKDQTDRQTKINDLLVRHAREGKCVVRLKAGDPFMFGRGIEEVRALAAAGVPCEVVPGITTGIAAADLCGIPLTERHRNSSVLFCTGHTADYSLGHFAAVIELMKAGTPLVMYMGFENLDKIVERFIDSGLSPELPACAVSRVSRSDQTLVAATIGTIVQQIRERELSLPVVFIIGEHAVPEGACPDQSDASDPSDQNHNEQQ

SEQ ID NO: 5861 - protein, 308 aa, Bacteroides fragilis
MSVEPGKWGVIYNPKAGTRKVQKRWKEIKEYMDSKGVSYDYVQSEGFGSVERLAGILANNGYRTIVVVGGDGALNDAINGIMSSNAEKKEEIAIGIIPNGIGNDFARYWELNLEYKQAVDWIINNRQKKIDVGYCNFYDGEKHQRRYFLNAVNIGLGARIVKITDQTKRFWGVKFLSYLAALFLLIFERKLYRSHLKINDEHIRGRIMTVCVGSATGYGQTPSAVPYNGWLDVSVIYRPEFLQILSGLWMLIQGRILNHKVVKSYRTRKVKVLRAQNAAVDLDGRLLPRHFPIEIGIIPEATTLIIPN

SEQ ID NO: 5862 - protein, 55 aa, Passiflora mathewsii
WEYQVGPSVGIDAGDDIWCSRYILERITEQAGVILSLDPKPIEGDWNGAGCHTNY

SEQ ID NO: 5863 - protein, 298 aa, Alkaliphilus metalliredigenes
MTYCFIVNPVSGKNKGKKVMVLVEEVLKKKNVDYQLYVTNKPGEAQFLASQASREKYDVIVAIGGDGTIHEVLNGMIHSKKKLGIIPAGTGNDLAKSLNYPTNVEQALETVLNGHTRKIDIGRINGNYFINFASIGLDALIAEEANKMKKLYSSRYTYVLAVLKGIIVFKSPTIKVLIDGKEQKREIMLLAICNGAYYGGGMKIAPTADVADGYLDVCLIRKMSKLKLLFLFPTIFTGNHVKYKEVEFYRGKKVEVSSQSKFKFNADGEVKDHLPTTVEIIEKGIEIIWNKENTFLES

SEQ ID NO: 5864 - protein, 195 aa, Plantago major
KGKDSQGEEVIKPYTPTTLDSDVGYFELVIKMYPQGRMSHHFREMKEGDYMAVKGPKGRFKYQPNQVRAFGMLAGGSGITPMFQVARAILENPIDNTMVHLIYANVTYDDILLKDELDALAKNYPDRFKIYYVLNQPPEVWNGGVGFVSKEMIEANCPAPAADVKVLRCGPPPMNKAMAAHLDALGYTSDMQFQF

SEQ ID NO: 5865 - protein, 419 aa, Unknown
  Frankia sp. EAN1pec
MSTPFWGPDFDQLRATDPDIAAVVVDELERLRGGLQLIASENFTSPAVLAALGSTLSNKYAEGYPGRRYYGRVPGGRPRRGDRHRAGPGAVRVPSTRTCSRTRARRRTSPSTPPCSHRGDTVLAMSLPHGGHLTHGSRVNFSGRWFDVVAYGVREDTELIDYDQVRELALQHRPKMIICGATAYPRRIDFAAFRSIADEVGAWLMVDAAHFIGLVAGGALPSPVPHADVVSFTTHKVLRGPRGGMILCREELAARIDKAVFPFSQGGPLMHAVAAKAVALKEAATPEYATYAHQVIANAQTLAEGLAAEGVRPVAGGTDTHLTLLDLRELGVTGRDAEARCDAAGITLNKNAIPYDPQPPAISSGIRVGTPAVTTQGMREGEMKEIAGLIARAVRDPSAAADVSAAVSVLVDRHPAYPR

SEQ ID NO: 5866 - protein, 256 aa, Unknown
  Mycobacterium sp. MCS
MSDRFSMEGRVAVITGGGTGIGRASALVLAERGADVVLAGRREEPLKATAADVEALGRRAIAVPTDVTKADQCQALVDAALGEFGRLDVLLNNAGGGETKSLMKWTDEEWHEVLELNLSSAWYLSRAAAKPMIAQGKGAIVNISSGASLLAMPQAPVYAAAKAGLNNLTGSMAAAWTRKGVRVNCIACGAIRTPGLEADAKRQGFDIDMIGQTNGSGRIAEADEIGYGVLFFASDASSYCSGQTLYMHGGPGPAGV

SEQ ID NO: 5867 - protein, 641 aa, Unknown
  Scopulariopsis sp. RP38.3
MRLSNIPLLRPWAALSLATLIGLSSGADTDQWKTLKPQANAIRELLSLDGTWNFALPQSREIEEDQGWTSVIPPKLQIPVPASYNDIFTDPAIRNNVGWAYYQRHAIVPQTWSEGRYYVRFDSVTHEAKVYVNDEEVGGHVGGYTPFEVDLTDLVSPGEQFRLTVAVNNILTWQTIPPGEVVTNEAGKLRQDYNHDFYNYAGIARSVSLYSVPDVHVSDVTVTTENDDEGNEGTVNYSVETSGSNDTQARVTLIDEDGNEVAEASELEGSLNVSPVNLWQPGAAYLYTLRVELLSDDTVVDTYDLPVGVRSVRVEGNQFLINGKPFYFTGFGKHEDSPVRGKGYDPAYMIHDFELMKWMGANSFRTSHYPYAEEVMEYADRHGIVVIDEVAAVGLNLGISAGLRGDEPPKTFTEDKVNNETQKTHAQALRELIHRDKNHASVVSWCVTNEPASAEDGAREYFQPLVELTRELDPTRPVTFTNVMGATVDKCLISDLFDFLSLNRYYGWYVQTGDLESAEVAMEEELLQWVDEYDKPIIMSEYGADTLAGLHAVDEVLWSEEYQTNLLRMSHKVFDSIDSIVGEHVWNFADFQTPHTGVNRVDGNKKGVFTRERRPKAAAHELKRRWLDEGFPKLGNGTSGA

SEQ ID NO: 5868 - protein, 89 aa, Glycine max
MPSLQKALPPELADNALRLYRECLRRAKFIGSQQHNTGLLVSMVRQQFKKNMHETDPEKIQKMKDDAARGLINHIIYESEKMTGRKFSG

SEQ ID NO: 5869 - protein, 279 aa, Anabaena variabilis
MKPPQFCTIKNSKLLFAIIASPSRRPIADRFFTLPLITSNGMTDPMIVSGTANDIDSLRQRLIAGSIQVQQQIILQLADVGNEGLDVLMEFLLKRRENPATWIDGKAYQVLYESDAPQAQEFLQNNFPEGIVTLKSSCGINYNLLQQLLAQQDFQAADLLTIETMCEIAGPMAVKRKWLYFTDVDSFPSDDLQTINQLWIVHSEGKFGFSVQRDIWLSLGKNWDNFWPKIGWKSGNNWTRYPNGFTWNLTAPRGHLPLSNQLRGVRVIAALFAHPAWSK

SEQ ID NO: 5870 - protein, 1029 aa, Pantoea agglomerans
MMFTASPMSLSKILARRDWENPGVTQWHRLPAHAPFNSWRDEASARADDNASRKRSLNGDWQFSYYAAPEQVPDSWVTEDCADAVTTPVPSNWQMQGFDTPIYTNDTYPIPVNPPFVPAENPTGCYSLTFEVDEQWLESGQTRIVFDGVNSAFYLWCNGKWMGYSQDSRLPAEFDLSAVLRPGTNRLAVLVLRWCDGSYLEDQDMWRMSGIFRDVSLLHKPHTHIADYHAVTELNADYDRAKLQVEVALAGEQFADCEVAVTLWRDGLSVATVSAKPGSAIIDERGNWAERLNVTLPVKDPALWSAETPELYRLTFALRDGQGEILDVEACDVGFRCVEISNGLLKVNGKPLLIRGVNRHEHHPENGQVMDEATMCRDIELMKQHNFNAVRCSHYPNHPLWYTLCDRYGLYVVDEANIETHGMVPMSRLADDPRWLPAMSERVTRMVLRDRNHPSIIIWSLGNESGHGANHDALYRWVKTTDPTRPVQYEGGGANTAATDIVCPMYARVDQDQPFEAVPKWSLKKWIGMPDETRPLILCEYAHAMGNSFGGFAKYWQAFRNHPRLQGGFVWDWVDQALTKKDDNGNAFWAYGGDFGDTPNDRQFCLNGLVFPDRTPHPALFEAQRAQQFFTFTLVSTSPLVIDVHSDYLFRQCDNEQLRWNIARDGEVLASGEVALTIAPQQTQRIEIDAPEFAAAAGEIWLNVDIVQTAATAWSPADHRCAWDQWQLPAPLYIAPPVEGTAKPDLKVKEDVLEVSHQSQRWHFDRASGNLTQWWNNGTATLLAPLSDNFTRAPLDNDIGVSEATRIDPNAWVERWKAAGMYNLTPRLLLCEGEQLAQAVTITTLHAWESNGKALFLSRKVWKIDRAGVLHGDVQVQVANDIPQPARIGLSCQLAQTPQTASWLGLGPDENYPDRKLAARQGRWTLPLDALHTAYIFPTDNGLRCDTRELTFDTHQMQGDFHFSLSRYSQQQLRDTSHHHLLEAEPGCWLNIDAFHMGVGGDDSWSPSVSPEFILQRREMRYAFSWRQD

SEQ ID NO: 5871 - protein, 176 aa, Vibrio fischeri
MKHTVEVMISEQEVNQRVKELGQQISEHYKDSEGLVMVGLLRGSFVFMADLARAIDVPMTVDFMTASSYGNSMESTRDVRILKDLDDDIKGKDVLLVEDIIDTGNTLSKVCEILSIREPNSITICTLLDKPSRREVEVNVDWIGFSIPDEFVVGVGIDYAQKYRNLSYIGKVVPQE

SEQ ID NO: 5872 - protein, 494 aa, Unknown
  Rhodococcus sp. RHA1
MPSTTVTSPQVAVNDIGSAEDFLAAIDATIKYFNDGDIVEGTIVKVDRDEVLLDIGYKTEGVIPSRELSIKHDVDPNEVVSVGDEVEALVLTKEDKEGRLILSKKRAQYERAWGTIEELKEKDEAVKGTVIEVVKGGLILDIGLRGFLPASLVEMRRVRDLQPYVGKEIEAKIIELDKNRNNVVLSRRAWLEQTQSEVRSEFLHQLQKGQVRKGIVSSIVNFGAFVDLGGVDGLVHVSELSWKHIDHPSEVVEVGTEVTVEVLDVDLDRERVSLSLKATQEDPWRQFARTHAIGQIVPGKVTKLVPFGAFVRVEEGIEGLVHISELAERHVEVPDQVVGVNDDALVKVIDIDLERRRISLSLKQANEDYNAEFDPSKYGMADSYDEQGNYIFPEGFDPETNEWLEGFDKQREEWENRYAEAERRHKMHTAQMEKTAADEAAEAATAAAGYSSESGAGDADVASAASTSSSESAGGSLASDAQLAALREKLSGNA

SEQ ID NO: 5873 - protein, 621 aa, Unknown
  Arthrobacter sp. RP10
MLKPRSTITRELINLDGLWRFAVENPNVPEPWKGVLGGNLEAAVPSSYNDLFADQKIRDHVGWVWYQRTVRVPRGWTGERVLLRLDAATHEGKVYVDDVLVARHVGGYTPFEADITDHLSPGDEFRLTVGVNNELTSATIPPGSISVSQDGRRQQTYLHDFYNYAGLARSVWLYSKPERHISDITVVTGVIGRTGVIDYSVETSHKTPVRVRVLDAAGHEVSSAEGTQGTLTIEDVSLWRPGAAYLYNLVVELLDGEDVIDSYTEPFGVRTVEVRGTQFLINGEPFYFTGFGKHEDTAVRGKGHDNAYLVHDFQLLDWVGANSFRTSHYPYAEEVLEFADRHGIVVVDETAAVGLNLGVQGGLTGVGPKPTFSPETFNHETQAAHAQHLREVISRDKNHPSVVMWSIANEPASNEDGAREFFEPLVQLARELDPTRPLTYAAVMFATFQNDKIADLFDVLSINRYYGWYIFTGDLQSAENYLERDLRGWVEAFGKPIMMSEYGADTMPGQHSIWDMPWSEEYQQSFLAMNHRVFDRIDGFVGEHVWNFADFQTSNGIHRVDGNRKGVFSRDRKPKAAAHTLRARWTGLNGAKPSVDDTEETEVLENVTAELDAAPALEGAK

SEQ ID NO: 5874 - protein, 479 aa, Salmonella enterica
MSILVKNNIHWVGQRDWEVRDFHGTEYKTLRGSSYNSYLIREEKNVLIDTVDHKFSREFVQNLRSEIDLADIDYIIINHAEEDHAGALTELMAQIPDTPIYCTANAIDSINGHHHHPEWNFKVVKTGDTLDIGNGKQLIFVETPMLHWPDSMMTYMTGDAVLFSNDAFGQHYCDERLFNDEVDQTELFEQCQRYYANILTPFSRLVTPKITEILGFNLPVDMIATSHGVVWRDNPTQIVELYLKWTADYQEDRITIFYDTMSNNTRMMADAIAQGINEVDPNVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDLDALELCRQHGRDIARQWALAPLPETTQKTAPAEEITTCAAADLGPKMQCSVCQWIYDPALGEPLQDVAPGTPWSEVPDNFLCPECSLGKDVFDVLATEAK

SEQ ID NO: 5875 - protein, 377 aa, Salmonella enterica
MSRGIIIIGSGFAARQLVKNIRKQDAHVPLTLIAADSMDEYNKPDLSHVISQSQRADDLTRQLAGEFAEQFNLRLFPHTWVTDIDADAHVVKSQDKQWQYDKLVLATGAAAFVPPIAGRELMLTLNNQQEYRACETPLRDAQRVLIVGGGLIGSELAMDFCRAGKTVTLMDNAASLLASLMPPEVSSRLQHHLTDMGVHLLLKSQLQKLEKIEAGIRATLASQRSIEVDAVIAATGLRPETALARRAGVVVNRGVCVDSYLQTSHPDIYAIGDCAEINGQVLPFLQPIQLSAMYLAKNLLGGNAPLKLPAMLVKVKTPELPLHLAGETQRRDLSWQITAESDGMIAKGMSGEGQLRAFVVSEDRMKEAFALLKTLSV

SEQ ID NO: 5876 - protein, 618 aa, Unknown
  Arthrobacter sp. RP40.7
MLKPRSTLTRELVNLDGLWRFALEDTDVPEPWIRTLDSKLEAPVPSSYNDLFADQKIRDHVGWVWYQRTVRVPRGWTGERVFLRLDAATHEGKVYVDDVLVAQHVGGYTPFEADITEHVAPGGEFRLTVGVNNELTTATIPPGGITVSQDGRRQQTYLHDFYNYAGLARSVWLYSKPDRHITDITIATGILGRTGVADYSIAASQETRVRVRVLDATGREVTSAEGSQGTLSIEDVSLWRPGAAYLYDLVAELLEGEDVIDSYTEHFGVRTVEVRGTQFLINGEPFYFTGFGKHEDTAVRGKGHDNAYLVHDFQLLEWLGANSFRTSHYPYAEEVLEFADRHGIVVVNETAAVGLNLGVQGGLTGVGPKPTFSPETFNHETQAAHAQHLREVIARDKNHPSVVMWSIANEPASNEDGAREFFEPLVQLARKLDPTRPLTYAAVMFATFQNDKIADLFDVLSINRYYGWYVFTGDLATAEQYLEGDLRGWVKTFGKPVMMSEYGADTMPGQHSIWDLPWSEEYQQSFLDMNHRVFDRIEGFVGEHVWNFADFQTSNGIHRVDGNRKGVFTRDRKPKAAAHALRARWTGLSGAKPSGNATTSDQTTETEARPEAALEGAK

SEQ ID NO: 5877 - protein, 322 aa, Unknown
  Shewanella sp. MR-7
MSKIFEDNSYTIGNTPLVRLNRVSQGKVLAKVEARNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYIMLQQFNNPANPEIHEKTTGPEIWNDTDGAVDVFVAGVGTGGTITGVSRYLKKVAGKAITSVAVEPADSPVITQTLTGLPVQPGPHKIQGIGAGFIPGNLDLELIDRVETVTNDEAIDMARRLMQEEGILVGISSGAAVVAANRIAALPEFADKNIVVILPSAAERYLSSVLFQGQFGDEENIQ

SEQ ID NO: 5878 - protein, 413 aa, Paenibacillus thiaminolyticus
MLFDAFDVFLFDLDGVIYVGPEALPGAVEALERLRSGGKTIRFLTNNPCMTREQTAARLNRLGIEAAKDEVISSGWATACCLRERRAGSVYVLGDEHLERECRDAGLDIVDVNAAEAVVVGWSDDLTLRDIQSAVTRIANGAQFIATNADWSFPGPDGPMMAVGTAVEAIKMASGKTPYIVGKPYPYMFRQALQHVEDWSRAVMFGDTPDADIAGAHRIGISAVLISSGPYTGYSSARDYRKPDAIIPDLRSLWDEELRIERWIPPAFPWPDDIKPGVAGIVMDERGRVLLMKRADNGCWGLPSGHVERGESVEEAIVREIREETGLQVEVMRLVGLYSDPESQVFTYPDGAATQFVTACFRCETVGGALVRTGAETLDVNYFEAERLPDPILAMHPRWIADALAEESLCIFR

SEQ ID NO: 5879 - protein, 215 aa, Phaseolus vulgaris
RLSYGYSSFKGKRSSMEDFFDTTISEVDGQMVAFFGVFDGHGGSRTAEYLKNNLFKNLSSHPDFIKDTKTAIVEAFKQTDIDYLNEEKGHQRDAGSTASTAMLLGDRIVVANVGDSRVVASRSGSAIPLSIDHKPDRSDERQRIEKAGGFIIWAGTWRVGGVLAVSRAFGDKLLKPYVVADPEIQEEEIDGVDFIIIASDGLWNVISNKEAVSLV

SEQ ID NO: 5880 - protein, 213 aa, Zea mays
MVSPDAIRTVIGVIGNGTALVLFLSPVPTFISIWKKKTVEQYSAVPYLATLLNCMMWVLYGLPLVHPHSMLVITINGTGMLIELTYIALFLTFSVGAARRRVLLLLVAEVAFVAGVAALVLSLAHTHDRRSMVVGILCVLFGTGMYAAPLSVMKMVIQTKSVEYMPLFLSVASLVNGICWTAYALIKFDLYITIPNGLGVMFAVGQIILYAIY

SEQ ID NO: 5881 - protein, 161 aa, Unknown
  Fragaria x ananassa
NLFGVAIGYTIASSISMVAIKRSNCFHSSDGKDECHVNSNPYMIAFGIAEIIFSQIENFDQLWWLSIVAAVMSFTYSTIGLGLGIGKVVETGTIRGSMTGVDIGTVTEAQKIWRSFQALGDIAFAYSYSLILIEIQDTVESHHREAKTMRKHSNQCAPHPF

SEQ ID NO: 5882 - protein, 560 aa, Rhizopus oryzae
MPSIQIGQHLLNRLKEINIDVVFGVPGDFNMPLLDIIEDDPKLTWGNNANELNASYAADGYARIRGAGAVVTTFGVGELSAVNGVAGSYAEMLPVIHIVGTPSTKSQAAGAMLHHSLGDGNFDVFFNMSSMIACASTHLRKQTAIAEIDRVISQAVLSKRTGYIGIPIDLIKTEVEIPEELGPFQTTLPKNNPEVQAIALKVVAEAIQSAKHPVIIVDGCVLRHRCQKPVQEFITRSGFPTYVAPMGKGAVDESIENFRGCYSGNVTLEAVNEEIKLADLIIEIGSIKSDFNTGNFSYSLDRSKTITLHSFATVVFCAEYQKVSMMEFIPLLTEALPQQPRTFNLGPRAKPVPIQPGTEITHNYFWHKVPEYMEENAIVCAETGTAEFASLNMDGPKGTTYITQILWGSIGFTVGASVGAAIAARDRRVYLFVGDGSFQLTCQEIAVFLRHGLTPVIFLLNNDGYLIEKLIHGPERAYNNYQMWNYSKSLDYFGAHLEHNKSMGVPPVGFEGKVATRDEFESAMKQVQANPDKIHFLEVIMPQFDAPRELELLVANSENR

SEQ ID NO: 5883 - protein, 465 aa, Unknown
  marine gamma proteobacterium HTCC2143
MDYLPLFFKLTDKACLVVGGGHIATRKARLLVSAGGILHVVALEITAELKTMARSSGGSCREGHFHNDDMNGKSLVIAASNDSAMNAHISEIARERLIPVNVVDSPELSSVILPSIIDRSPVIVAVSSGGNSPVLARMLRTKIESIIPSAYGKLAQLVGDFRERVQKRLPDVDARKRFWEEVLQGPIAEMVFTGKYQTAADMLELQVNTAQLETNTGEVYLVGAGPGDPDLLTFKALRLMQSADVVLYDRLVSDEIVNLTRRDAERVYVGKQRADHALPQQDINQLLVTLAKEGKRVLRLKGGDPFIFGRGGEEIEMLAEHKIPFQIVPGITAASGCSTYAGIPLTHRDYAQSVRFVTGHLQNGSIDLPWNELVYDKQTLVFYMGLVGLPIICEQLVAHGRSAATPIALVQQGTTAMQRVLTSDLAGMPALARAEQVRAPTILIVGDVVKLRKKLAWFEGNERSE

SEQ ID NO: 5884 - protein, 586 aa, Bifidobacterium breve
MGTTGHSDVPRPEHPEPQWQRDNWRCLNGTWDFQLDLNCSGQDRGWYRKHDFDQSIVVPFCPESKLSGIEYKDFIHCCWYRRSIELSEKELTGIVRLHFGAVDYETTVYLNGEQLGVHRGGYSPFSFDIQRIAHVGVNELVVCVKDELRSGRQPRGKQSERYDSYGCCYTRTTGIWQTVWLEFMPQTHVVSARFHPNLSRDSVGIDLTVNGRTRQRSQLANITISFEGNQVGSASIAMGSDRCSLEVPLEKTVPWAVGQGNLYDVRISYGEDVVCSYFGMRSVDIEGNRVLINGEPVFQRLVLDQGYYPEGIYTAKDLEELSRDIDLSMAAGFNGARLHQKAFEPRFLYECDRKGYIVWGEMANWGLDITTASGLTAFLPEWLELLERDINHPSIVGWCPFNETWDVDGTKQDDDVLRQTYAVTKAIDPSRPCIDTSGMFHTVTDIYDVHDYEQDPVRFAGNYAGLDPSDGSGYVDPFPERQRYQGCKPFFVSEYGGIKIASRARVDGGESWGYGEAAAGESEFMERYHGLTKALLDNPAIFGFCYTQLYDVEQECNGLYTHDRKPKVDIAAVRDINMERAAIEKS

SEQ ID NO: 5885 - protein, 573 aa, Aspergillus oryzae
MCGIFACYNHPDVQKFKPTALRMAKAVRHRGPDWSGNYIADKTILAHERLCIVGVDSGAQPLVNDDGSLALAVNGEIYNHRIIRKNLKNQYDFKTHSDCEVVIPLYMEHGLDAPKHLDGMFSWVLYDRKQDRVVAARDPIGVTSFYIGWSSETPGAIYFASELKSLHPVCDKIEAFPPGHIFDSKTGSMTRYFEPKWWDPTNVPTTPVDLKVLRHTLEKSVRKRLMAEVPYGVLLSGGLDSSLVASIAQRETLRMQEAAKVAIQNQTGSSDLVGIDDSNELSTVTTFQQLHSFSIGLPGAPDTEAALEVAKYLGTKHHAFTFTVEDGINALSDVIYHLETYDVTTIRASTPMYLLSRKIKAMGVKMVLSGEGSDEIFGGYLYFHAAPNKEEFHNETVRRVKALHLADCLRANKSTSAWGLEARVPFLDKNFLETAMGVDPQDKMITKERIEKYILRKAFDTTDEPDVEPYLPEKILWRQKEQFSDGVGYSWIDGLKDHAELHVTDEMMKNPKPEWGNDIPDTKEAYWYRMMFDEHFPPSCASTVERWVPTWSKQTDPSGRAIATHNAKYDHVE

SEQ ID NO: 5886 - protein, 618 aa, Ustilago maydis
DLIRCVKEGGVRSIGEMKSSTKCGTGCGGCMPLSTSILNKALKEAGVEVSNHLCGHFAYSRQDLYQIIKFKKLKDFTTVMSTVGKKADSLGCEVCRPAIGSILSSLYNDWIMAPQLRQTQDTNDRYLANMQRDGTYSVVPRLAAGEITPAGLKVIGEVAEEYGLYTKITGGQRIDMFGAKKQDLPAIWTKLVDAGFESGHAYGKALRTVKSCVGSTWCRYGVGDSVGLAHELETRYKGIRAPHKFKGGISGCVRECAEAQGKDFGLIATTKGWNVYVGGNGGAKPRHAELIAEDVTRRQAIKILDRFILFYIRSADKLERTARWIEKFPGGLKGLKEVIVDDKLGICEDLEKEMEVLVGTYHCEWTKVVRDPTRHKAFRQFVNTDETQPVSEMMSERDQQRPADWPVETGPLHFSILDVAKEAVWEWRSVCKYTDLDPQKDSPSSATIKYGDTQIAVWNIPGRGVRAAQNMCPPRRAFVLADGLVGEDDKGREYVSCPLHKRNYILSANADEEGGKCNDGDYSIMTFEAKMDEEKDLVYLKLPPTEALDAVLSTSKWMLRRATEESDAMAGGQSHSVEITGPLDMDTLEKGPSSPNKPGSPPAKKTKASCGEQSSLDW

SEQ ID NO: 5887 - protein, 419 aa, Neorickettsia sennetsu
MRGGGIVFFKSRISAVDPAVARIIDGEVSRQRKHLQLIASENFASAAVLEAQGSVFTNKYAEGYPGKRYYCGCEYADQIERLAIERVCKLFGCSYANVQPHSGSQANQAVFLALLNPGDTVLGFSLASGGHLTHGASVNLSGKWFNAVHYNVRRDNFEIDMDEVRDLAKKHSPRMIIAGASAYSKYIDFKSFREIADEVGAYLLGDVAHYAGLIAAGEYPSPFPYVDVMTSTTHKTLRGPRGAIVLTNSEELIRKINSAIFPGLQGGPQMHAIAARAVAFGEALTTEFKEYIRSVIRNAKTLANVLRERGFDVLSGGTDTHIVMIDLRKLNLKGNVSALKLESAGIICNKNAIPFDEEKPFVTSGLRFGSPAETTRGMRELEFAHIGGLIADLLEEKISTDNAAEMVLDLTSKFNFYNV

SEQ ID NO: 5888 - protein, 463 aa, Anabaena variabilis
MVNRRIAEILRSGQPDESLVVQGWVRTKRELKGFAFIEVNDGSSLGNLQVVINQDLPDYAVIVKQLNTGASVEVNGVLVASQGKGQRIELKAEAVKVYGEADPETYPLQKKRHSFEFLRTIGHLRSRTNSFGAVFRVRNACSAAIHQFFQERGFLWVHTPIITASDCEGAGELFSVTSLDLKQIPRTENQGIDYSQDFFAKPTYLTVSGQLEAEVMAMAFSNVYTFGPTFRAENSNTSRHLAEFWMVEPEMAFCDLEGDMDLAEAFLKHIFNHVLEKCPEDMEFFNQRIDNTVLATAENIINNQFERLTYTDAIKLLEKADVKFEYPVSWGLDLQSEHERYLAEQLFKKPVIVTDYPAQIKAFYMRLSDDEKTVRAMDVLAPKIGEIIGGSQREERLDVLERRILAQGMQPEDLWWYLDLRRYGTVPHAGFGLGFERLVQFITGMGNIRDVIPFPRTPQNAEF

SEQ ID NO: 5889 - protein, 821 aa, Azospirillum brasilense
MSTHTNPPTPRERLVVVGNGMAGIRTLEELLAKAPDRYDITVFGAEPHPNYNRIMLSPVLAGEKTFEQIVLNGRDWYEANGIRLLTGDRVEVIDRANCTVTAISGLTVPYDKLLIATGSTPVIIPVPGSTLTGVVGFRDLADVDTMLEAAARGGRAVVIGGGLLGLEAANGLKVKGMDVTVLHLMDTLMERQLDRSAGALLRHELERRGITVLTGADTAEIVGSEKVSAVRLKNGQELPADLVVMAVGIRPNTTLGKAAGLACGRGIQVDDAMTTSDPAILSVGECVEHRGQTYGLVAPLFEMAKVAAARLAGSAEAAYTGSVTSTKLKVTGVDVFSAGDFTGGKDCEDIVFRDAARGVYKRVVVKENRILGAVLYGDTKDGGWYFQMLKDGTEVAPVRDTLIFGQSFGGEGAANPKAAVAALPDSAEICGCNGVCKGTIVTAITEKGLSSLDEVRAHTKASASCGSCTGQVEQLLALTLGDGYAGEAKAKPMCKCTDRTHDEVRRAITALDLKTIPDVMQRLEWRTPDGCHHCRPALNYYLLCEWPGEYKDDSRSRYINERVHANIQKDGTYSVVPRMWGGLTSAKELRAIADVVDKFAIPTVKVTGGQRIDLFGVKKEDLPAVWADLNAAGMVSGHAYAKGLRTVKTCVGSEWCRFGTQDSTGLGVKLERMTWGTWTPHKVKLAVSGCPRNCAEATIKDLGVVCVDSGYELHVGGNGGMHVRACDLLVKVETEAEVLEYTGAYMQLYREEARYLERTAPWVERVGLDHIRRRLVDDAEGRAALNARFLFSQSFSQDDPWAERANGSVDRHEFAPLAQVG

SEQ ID NO: 5890 - protein, 175 aa, Arabidopsis thaliana
MARISSDPLMVGRVIGDVVDNCLQAVKMTVTYNSDKQVYNGHELFPSVVTYKPKVEVHGGDMRSFFTLVMTDPDVPGPSDPYLREHLHWIVTDIPGTTDVSFGKEIIGYEMPRPNIGIHRFVYLLFKQTRRGSVVSVPSYRDQFNTREFAHENDLGLPVAAVFFNCQRETAARRR

SEQ ID NO: 5891 - protein, 885 aa, Azospirillum brasilense
METVRTTCPYCGVGCGVLASVSSDGTVGVAGDPDHPANRGKLCSKGTNLPDTLGLAERLLHPQVDGRRVAWDEAIAEVAKRLSDTIAKHGPDSVAFYVSGQLLTEDYYAVNKLAKGFLGTANIDTNSRLCMASSVAGHKRGFGADAVPVTYDDLDEADLVLLVGSNLAWCHPILNQRLLAAKHTRGTRIVVLDPRRTAAVDGADRHLPIRPGTDALLFNGLLVYLADNHLADNGLIDARFVAEHTAGLAEALEAARADAPSPAHVAACCGLPLAEVEAFYAEVATVRRTVTVYSQGVNQSSQGTDTVNAILNVHFLTGRIGAPGMGPFSVTGQPNAMGGREVGGLANQLAAHMGFEPESVDRLRRFWNAPRVADKPGLKAVDLFRAVEQGTVRAVWVMATNPAVSMPDAARVRRALAKCETVIVSDCVADTDTARLSHIRLPAAGWSEKDGTVTNSDRTISRQRAFRPLAGEARPDWWIVTQVARAMGFAAAFSFETPADVFREHAALSAFENGGTRAFDIGGLAGLSDAEFETLAPAPWPRRAGEGPTRRLFADGRFFTEDGRARFVPVASRPLPRSVEPGSLMLNTGRLRDQWHTMTRTGLSPRLSAHAPEPCLDLHPQDAAARGLTDGALVSLSTPVGTALARLRVTEAQRVGEAFLPMHWTDRFTASCVVGRLVDDLAVDPVSGQPDLKRMPVTLTPYPAAWTGFLIAREPVEPAHGGYWSRRAVPGGHLIELASEDALPAPETLAFGFAGATVDYSDAARGVLRRAWVTHDRLEACLFLSTSGALPSRGWLVELLSAEALDGAARRALLSGRSPVPTADEGRTVWSCFGVGVNRLIAAIQSQGLTTVQEVGAALRAGTNCGSCIPELKEILADAQRSHVA

SEQ ID NO: 5892 - protein, 132 aa, Bacillus cereus
MSKQPMTPFEAIGGEQCIAILVDTFYSYVSQHPDLSPIFPDDLTETARKQKQFLTQYLGGPNLYTEEHGHPMLRARHLPFEITPKRAEAWLSCMEQAMDDTGVHGHIREFVFERLALTAQHMVNTPDETGEI

SEQ ID NO: 5893 - protein, 534 aa, Unknown
  Acinetobacter sp. ADP1
MIPIKLKNLLLWSFNMLDQNIKTQLKAYLERLESPIELVAALDDSDKAAKIKELVTEIAELSNQVTARFDGQNTRRPSFGIAKAGEQPRVFFAGLPMGHEFTSLILALLQTSGYAPKVSDEILNQIKGLNLKADFDVFVSLSCHNCPDVVQALNLIAIYNPNSTATMIDGAFFQDEVEERKIMAVPMVFQNGNHIGQGRMTLEEIVAKLDSNAAEKDAAAINAKDAFDVLVVGAGPAGGTAAIYAARKGIRTGMIAERFGGQVMDTMDIENFTSVQKTVGPKFAADMEAHVREYDVDIMNLQRVSKIVGADQTASGLVEVELENGAKVESKTVILSTGARWRKMGVPGEQEYATRGVAYCPHCDGPLFKGKKVAVIGGGNSGVEAAIDLAGIVEHVTLVEFDTKLRADQVLQDKLNSLPNATIITNALSTEVIGDGAQVTGLKYKDRATDTEHTIELAGIFVQIGLLPNTDFLKGSVELSPRGEIIINERNETNVKGVFAAGDCTTVPYKQIIIATGEGAKASLSAFDYIIRHG

SEQ ID NO: 5894 - protein, 185 aa, Xanthomonas campestris
MSLNRLLVLVFAGLFSTAAVAAGTSVLDLDYRPLAGKAPINLNRSYGGKVVMVVNTASKCGFTPQYEGLEALNQRFGSRGFTVLGFPSNDFQGQEPGSEKQIQEFCTLTYGVKFPMFEKVHVLGAQATPLYQRLTRETGVAPGWNFHKYLIGRNGHVVAQFPSKVKPDDPQVLAAIERELKAPAR

SEQ ID NO: 5895 - protein, 43 aa, Passiflora mixta
WEYQVGPSVGIDAGDDIWCSRYILERITEQAGVILSLDPKPIE

SEQ ID NO: 5896 - protein, 417 aa, Oryza sativa
MAKSSADDAELRRACAQAVAASGARGEEVSFSIRVAKGRGIFEKLGRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQ

SEQ ID NO: 5897 - protein, 417 aa, Unknown
  Acinetobacter sp. ADP1
MFANISLSEFDPELAKSIEAEDARQEAHIELIASENYCSPAVMEAQGSKLTNKYAEGYPGKRYYGGCEYVDVIEQLAIDRAKALFGADYANVQPHAGSQANSAVYLALLNAGDTVLGMSLAHGGHLTHGAKVNFSGKTYNAVQYGLNPETGEIDYDEVERLAIEHKPRMIVAGFSAYSRIVDWQRFRDIADKVGAYLFVDMAHVAGLVAAGVYPSPVQIADVTTTTTHKTLRGPRSGLILAKANEEIEKKLQSAVFPGNQGGPLVHAIAAKAVCFKEAMAPEYKAYQQQVVKNAQAMAEVLIARGYDIVSGGTDNHLFLLSLIKQDVTGKEADAWLGNANITVNKNAVPNDPRSPFVTSGIRIGTPAVTTRGFGEAEVRDLASWIADVLDSKGDEKVIADVKAKVEAVCAKFPVYEN

SEQ ID NO: 5898 - protein, 559 aa, Pseudomonas aeruginosa
MGARALRRERRLRWSPNWTRILPMQPQKTLTAGQALVRLLANYGVDTVFGIPGVHTLELYRGLPGSGIRHVLTRHEQGAGFMADGYARVSGKPGVCFVITGPGVTNVATAIGQAYADSVPLLVISSVNHSASLGKGWGCLHETQDQRAMTAPITAFSALALSPEQLPELIARAYAVFDSERPRPVHISIPLDVLAAPVAHDWSAAVARRPGRGVPCSEALRAAAERLAAARRPMLIAGGGALAAGEALAALSERLAAPLFTSVAGKGLLPPDAPLNAGASLCVAPGWEMIAEADLVLAVGTEMADTDFWRERLPLSGELIRVDIDPRKFNDFYPSAVALRGDARQTLEALLVRLPQEARDSAPAAARVARLRAEIRAAHAPLQALHQAILDRIAAALPADAFVSTDMTQLAYTGNYAFASRAPRSWLHPTGYGTLGYGLPAGIGAKLGAPQRPGLVLVGDGGFLYTAQELATASEELDSPLVVLLWNNDALGQIRDDMLGLDIEPVGVLPRNPDFALLGRAYGCAVRQPQDLDELERDLRAGFGQSGVTLIELRHACAR

SEQ ID NO: 5899 - protein, 53 aa, Passiflora mixta
WEYQVGPSVGIDAGDDIWCSRYILERITEQAGVILSLDPKPIEGDWNGAGCHT

SEQ ID NO: 5900 - protein, 340 aa, Prochlorococcus marinus
MKEKSNIFNRDKPLTVMITGGSSGIGFQAVLKLISLGHNIILPCKNISRANEVLTNLFNHSLDESSNKGEIYTPIMDLSDLSSIDSLCSEVKNRRWTIDVLILNAGLQYTGSKTPRRSTQGIELTFAVNHLSHFYLTQKILPFIDIRNDPKIIITSSEVHNPNSGGGKVGAKASLGKLKGLESGAGFEMIDGNKFNADKAYKDSKLCNILFARKLSDNFMKKKLSIPVIAWAPGLVISRDNQGFFRYSRKYNQLGQILFAFLARDILKITTSNKKAGLLLSNLACLSKYKKPGFNYYSNKIISSSKFIFEETETSNDAQRGDLSDNLWELSKSLIDKINK

SEQ ID NO: 5901 - protein, 166 aa, Arabidopsis thaliana
  misc_feature (96)..(96): Xaa can be any naturally occurring amino acid
  misc_feature (105)..(105): Xaa can be any naturally occurring amino acid
  misc_feature (122)..(122): Xaa can be any naturally occurring amino acid
  misc_feature (127)..(127): Xaa can be any naturally occurring amino acid
  misc_feature (135)..(135): Xaa can be any naturally occurring amino acid
  misc_feature (138)..(138): Xaa can be any naturally occurring amino acid
  misc_feature (147)..(147): Xaa can be any naturally occurring amino acid
  misc_feature (153)..(153): Xaa can be any naturally occurring amino acid
  misc_feature (161)..(162): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPXCVEFELEHXGLCTREQRETLPGYYDXGTWPXLELPFFRXEPXSVKVFKEVXRFKKGXPRGALIRXXRFGK

SEQ ID NO: 5902 - protein, 314 aa, Thiomicrospira crunogena
MKSLNTLQEFTPLTPLHHPLFDEKAVQVWIKRDDLNHPAIQGNKLHKLKYNLAEARQQGKQSLLTFGGAYSNHIAATAAAGNAFGFETIGFIRGEELANQPDKWSPTLKNAYQNGMQLHFLNRMDYRQKTRAHFLQQLQQQFPKSYILPEGGTNDLAIQGFEELSQQLAMQCPDWSHLYSAVGTGGTLAGLIKFSAFFCDQPRLISGIATLKQASYLIPTIEQLSGVHHNQRGLTQWQLLLDYCGQGYGKEDSDILTARKWFEEQFDIPLDPVYTNKMVYGFLEELAADKIPAGAKIILYHSGGLQGRALEKKA

SEQ ID NO: 5903 - protein, 470 aa, Pseudomonas aeruginosa
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 5904 - protein, 244 aa, Prochlorococcus marinus
MSLLEMKNKDQDYHYKSTLALVKKFVESNQRKRLKLLSEIESEVDNLFVFGTKIFDDFDQEGDDWAAGWLLQVLKKHKPLFFKDKKYNNWFVTYSDKNINYEELQLKLLEQNFEEADRLTSSYLRQLAGKLAVNRGYVFYSEVNSMSGTDLQTIDRLWSIYSNGRFGFSIQAKILKSVEKKYELLWPKIGWKKDGYWTRYPGSFSWSLDAPDGHMPLINQLRGVRLMDSILRHPAISLRHNNIL

SEQ ID NO: 5905 - protein, 364 aa, Pyrus communis
MAPATTLTSIAHEKTLQQKFVRDEDERPKVAYNDFSNEIPIISLAGIDEVEGRRPEICKKIVAACEDWGVFQIVDHGVDAELVSEMTGLAREFFALPSEEKLRFDMSGGKKGGFIVSSHLQGEAAQDWREIVTYFSYPIRHRDYSRWPDKPEAWREVTKKYSNELMGLACKLLGVLSEAMGLDTEALTKACVDMDQKVVVNFYPKCPQPDLTLGLKRHTDPGTITLLLQDQVGGLQATRDDGKTWITVQPVEGAFVVNLGDHGHFLSNGRFKNADHQAVVNSNSSRLSIATFQNPAQEATVYPLSVREGEKPILEAPITYTEMYKKKMSKDLELARLKKLAKEQQLQDLETAKVDTKPVDDIFA

SEQ ID NO: 5906 - protein, 711 aa, Triticum aestivum
  misc_feature (370)..(370): Xaa can be any naturally occurring amino acid
  misc_feature (391)..(391): Xaa can be any naturally occurring amino acid
MSVSSSSMCGGDAGMKCVVWFRRDLRVEDNPALAAAARTAGEVVPAYVWSPEEDGPYFPGRVSRWWLSQSLKHLEASLHRLGAAKLVTRRSPDSVAALLQLVRDTGATHLFFNHLYDPISLVRDHRLKETLTAEGIVVQSFNADLLYDPWEVNDDKGQPFNMFMPFWNRCLSMPYDPPAPLLPPKRINSGDLSMCPSDDLIFEDESERGSNALLARAWSPGWQNADKALSAFLNGPLIDYSVNRKKADSANTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVXGDIIEQVCTKNRLGVRNSRDXLLDADLESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAAMDTGMEEGLGDSSEVPPIEFPQDLQMEVHWEPARVAPNVLTTAQRRQDQMVPTMTASLNRVETEISADLGNSVDSRAEVPFRMHFEPRTEREEVIQSTGNAAGTNGIHHHNNFQQPQHRMRNIFAPSVSEASSSWTGRDGGVVPVWSPPAASGHSETYGADEADVSSRSYLDRHPQSHRIMNWHQLSQSLTTGRDVENSVQPNFIG

SEQ ID NO: 5907 - protein, 107 aa, Acetobacter aceti
SEHTLAVSDSSFDQDVLKASGLVLVDFWAEWCGPCKMIGPALGEIGKEFAGKVTVAKVNIDDNPETPNAYQVRSIPTLMLVRDGKVIDKKVGALPKSQLKAWVESAQ

SEQ ID NO: 5908 - protein, 773 aa, Arabidopsis thaliana
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHIVGSLVKPRKRQEGSSLMFKVLKERGSLDRSDHRWAAWRSPASSADGDVYIRFEMNVENDDSSSQSFASVSSRDQEVGDVRFSGGYGLGQDLSFGVCKKVVQLIHGYISVVPGSDGSPETMSLLLRFRRRPSISVHGSSESPAPDHHAHPHSNSLLRGLQVLLVDTNDSNRAVTRKLLEKLGCDVTAVSSGFDCLTAIAPGSSSPSTSFQVVVLDLQMAEMDGYEVAMRIRSRSWPLIVATTVSLDEEMWDKCAQIGINGVVRKPVVLRAMESELRRVLLQADQLL

SEQ ID NO: 5909 - protein, 429 aa, Phragmites australis
MAQPVVPAMQCQVGARGKAAVRARPAGAGGRVWGVKRSGRGTSGFKVMAVSTESTGVVPRLEQLLNMDTKPFTDKIIAEYIWVGGSGIDLRSKSRTLSKPVEDPSELPKWNYDGSSTGQAPGEDSEVILYPQAIFKDPFRGGNNILVICDTYTPAGEPIPTNKRHRAAQIFSDPKVVDQVPWFGIEQEYTLLQTDVNWPLGWPVGGYPGPQGPYYCAVGADKSFGRDISDAHYKACLYAGINISGTNGEVMPGQWEYQVGPSVGIEAGDHIWISRYILERITEQAGIVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEAEALATKKLALKV

SEQ ID NO: 5910 - protein, 132 aa, Vitis vinifera
MADEIILLDFWPSMFGMRVRLALAEKGLKYEYREEDLWNKSPLLLEMNPVHKKIPVLIHNGKPICESLIIVQYIDEVWCDKSPLLPSDPYQRAQARFWVDYIDKKLYELGRKIWSTKRRRAGNSQEGIHRVP

SEQ ID NO: 5911 - protein, 1049 aa, Cryptococcus neoformans
MDYGHPEGYQPPFQPVYQFVPQGYKDSDALDGIIIDDHWIDPNIDDEDDVWSEESWIPYSSHAVPNLRDSAVSPTSQSGNQQVVIAPLTNWYPTPSDLRQHYCDLHQSECLHQQMPVETNSTERSNTTLEDDLTQGTDLKHIDWSGVGLAFTLLLIILFAIHASWSGDDEEEGENKGKDSPGSRSHSKDKNESSKKKGETKKEQKESRSDKDNEKKEAGRKNGDEKDNDKDKKKSSSRISSKNDAAEGNDDKGSLKGKGEGEKKKDGSSSKSKKPNDDKKSSEKSDKVDGDKKSDPKKDDKAEGLEKKDVKKKSSSSDDKKEDKRGSGGEKKEERNKKEERNKEDENKASRGEKKEDKNSNSREKKDDKKAAGDKKEDKKATGEKKDEKKAAGASRNKDDKKSATGEKRDEKRAVGAEKKDDKKVAAADKDDKKAAGGNRKDDKEATGAEKKAAGAEKKDDKKAGDTKAERKVEKKEVEGERKKDDKKVGEKKHDEKVAEGDKKNDKSQSGRKKHDEKVGEKKHDEKVAGGDKKDDESQSGRKKPSSGDKEGGDKRLDHKKTDKKNNEEKDDKKAGEKKSGSKEGDKKPGDKKGDKKAENRNEEAGKKPANEKEAVNKPGEKKEMDKNPKDNKEMDEKLAGDKKNDGKSEKKGKGSVLEERGGEGKGDKKESKKSGNDKRKHEKKYEEDKEREGTKEEGKKDKSEQKDDPKKDGKGSLTSGSSKTKNEKDDERSWFSSHILIGLLLLLPLLAMTGRSRMPIIYDPAANRPSILTGSGLGDILASPVMAASKGLKRATTSPRASSSGARWVVNEQPEPKAHIHINNVNSQGNGNPINIREPSSEPAVEITVEESSLAAEQLLNRPHSPPVLEEERIWEPINFRFTGPANPDRLWNMIFACFIVALPLIVDQVMDYPERRYSQPDYLPPASQLILLSASFLICAVIGDWHFGWSSTIAPFAEVSISGAQRGLTPLIVGVVETGESLIWSLEDVMFGDGRVLLGMGLAALGVVLFSQRQPSLDVPKTDYASSTVQAMYFLGALLIGMFVWNA

SEQ ID NO: 5912 - protein, 375 aa, Xylella fastidiosa
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGAPQARITTGLPFFDHMLEQIAKHAGISLHISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 5913 - protein, 329 aa, Wigglesworthia glossinidia
MSNFSITVIGAGAYGTALAVSFSKKNRKVFLWGRNKKHMQSLKKDRCNKKFLPKINFPNDLKIEISLKKAIKYSNTIVIAVPSIGFKNILIKIQPFLNKNVFLICGTKGLEPRTGRLLQEVVYDILGRETCLSIISGPSFARYLAIGLPTSMVLANNCIKTCKFLANKLKNKFLNIYSISDLVGVQIGGVIKNVIAIASGMSDGIQMGPNAKTAIITYGLEEMYKLGKVMGANEYTFMGMSGVGDLVLTCTDDESRNRKFGILLAQGYSIENAKSKVGCIIEGYNNIKEILILSCKHKINMPIIKQVYKILYMHQPVKKSILNIFLNKK

SEQ ID NO: 5914 - protein, 630 aa, Fusarium oxysporum
MSLLRLCMHASPLRALRYSFIPNRVQLARSTTILHPARFTTMPPKRTKRESSSPPAKKAKTSKTNGSSTSDALRQPHHKAGEAEENGIAIRKFYPPEMSNARARAYNNNELPRPIEVLISALENTAQERKSIDVKKAVVHWFKMDLRLSDNRALALASDKAKEAGVPLIAMYIISPQDYEAHLRSPVRVDFMLRTLEVIKHDLAKLDIPLYVETVEKRKRVPDRILELMDQWGAGHLYANMEYEVDELRREASMIRDFAENGKAFEVVHDTCVVPPGELHTGAGKQYAVYTPWYRSWVAHIHENLDLLELYEPPEKNPSSARKVFAKLFDVEIPDAPKSKRLDGEEKERLRSLWPCGEHEAKKRLDKFCEEMIGNYQKKRNIPAEAGTSSISVHLASGTISARTCVRTARDRNKTKKLNGGNEGIQTWISEVAWRDFYKHVLVHWPYVCMNKPFKPEYSNISWSYDNEHFAAWCEGRTGFPIVDAAMRQLNHLGYMHNRCRMIVACFLAKDLLLDWRKGERYFMEHLVDGDFASNNGGWGFSASVGVDPQPYFRIFNPLLQSEKFDPDGDYIRKWVPELKDLDRKAIHDPYNRGAGSKAKKNGYPAPIVTHKDCRDRALAAYKEGLASGE

SEQ ID NO: 5915 - protein, 62 aa, Phaseolus vulgaris
TRFKAEFPVFDKVNVNGDKGDPLCKYVKSSKGELFGNNIKWRFSKFLVDKEGKVVDRYAPTT

SEQ ID NO: 5916 - protein, 421 aa, Roseovarius nubinhibens
MKDMDDIPAMMQALGRSARDAARALAIAPAAQKTAALMAAADAVWARREEIIEANGKDMAYGRDKGLSDAMLDRLMLDEARIEGICAGLRAVAGQDDPVGEVLAEWERPTGLSIRRVRTPLGVVGVIYESRPNVTADAGALCLKSGNAVILRGGSESFHSSGAIHGCLVEGLVSAGLPQEAIQLVPTRDRAAVAELLTMTDYVDVIVPRGGKGLVGLVQREARVPVFAHLEGIVHIYVDAAADPKMAMEVVLNAKTRRTGICGAAECLLIHRDIADTLGRDLIEMLIAAGVEVRADEGLSGIAGTVPAGAEDWGREYLDSIIAARVVDGVQEAIGHIARYGSNHTDCILTEDAAAVELFFAEVDSAIVMHNASTQFADGGEFGMGAEIGIATGKMHARGPVGAAQLTSFKYQVTGRGSVRA

SEQ ID NO: 5917 - protein, 422 aa, Desulfitobacterium hafniense
MNYIIIGNSAAGLFAAEGLRKVDSQGKITVLTADHYPPYSRCLTTYYLAGDIREEQLFLRTTEELARLNLNTHYRVRVTGLDPEGQRVSTASGEVFDYDRCLIATGASAVSLDIAGAALPEVFTLRHLENAKAIQKFIKKGRKAVIIGGGLVSLKSAYALRKQGMEVHVIVSSGYILSQMLNSSAAERLEEHLKDHGIHISLNSDVAAIKGKEHVEAVELKCGRIIDTNLVIIGKGVQPNVEPFLNSGLKINHGILVNEYLETNLPHVYAAGDVAETWDFLRECPRINAVWPNATEQGRVAALNMAGRKTIYKGSMGMNSVDFFGLRIISGGVITPLAHKKDIENALPWKVTEGQESWSKPLAKASTYQSLIWKGNYLKGYVLIGYPERAGLLTAMIRTQEPLAPEVQRNIEAGNRKIVKLK

SEQ ID NO: 5918 - protein, 112 aa, Unknown
  Fragaria x ananassa
EITGHPAGITQLQRVGIGLVLSAVSMAVAGIVEVKRRNYALAHSPLAPGGISLFWLSFQYAIFGIADMFTLVGLLEFFYREAPAGMKSLSTSFTWLSLSFGYFLSSTLLRTH

SEQ ID NO: 5919 - protein, 528 aa, Clostridium acetobutylicum
MENKKFSDLKLNSSVLKAIDDMGFEEPSKIQAEAIPVVIDGYDMIGQAQTGTGKTVAFGAPIISKIKDIDEKEGVQAIILTPTRELAIQITDELTRLSKYARVRVLPIYGGQSIERQMRAIKRGVDVIVATPGRIMDHIKRKTVKLDKVKFLVLDEADEMLDMGFIDDIEGIIKNISGDRQTMLFSATMPAPIKKLASNYMKKEVKHIAIIKNSLTVERIQQFYFEVKNKDKFEALCRIIDVEEPETTIIFCRTKRGVDELVESMQFRGYNVEGMHGDMSQNQRINTLKKFKENNIDFLVATDVAARGIDVHNVSHVINYDIPQDMESYVHRIGRTGRANAEGIAYSLVTPREYVMIKQIEKFTKSKIRRKEIPTIDDIFETKYNTLTDKITKNIEKDDFKKYIPFVQKLDDEFNLVDVSAALVKMIFDKEMGFDYSDDDKLKSDESVRLFFSAGRKDKLTVKKLLEFIDNASGVEGNEIGDIDILDKFTFVDVPERLRDVIIRTCDGKKLNGRKVNIEVAKSKKKSK

SEQ ID NO: 5920 - protein, 319 aa, Unknown
  marine gamma proteobacterium HTCC2143
MTDLQHHPLIILGSGPAGYTAAVYAARANLNPVVITGMEQGGQLTTTTDVDNWPGDVEGLQGPDLMIRMQKHAERFDTNIIFDHIEETDLSVRPFVLRGNSHNYSCDALIIATGASAQYLGLPSEEAFMGKGVSACATCDGFFYRGKKVAVIGGGNTAVEEALYLSNLAAEVTLVHRRDSLRSEKILQDKLFEKEKNGNVNILWNHTLNEVTGDNMGVTGLSLGRTLDNSTVNIDVDGVFIAIGHKPNTDIFVDQLHMKDGYITINSGTSGNATETSIPGVFAAGDVADHIYRQAVTSAGAGCMAALDAEKYLDNLATK

SEQ ID NO: 5921 - protein, 587 aa, Brassica oleracea
MEMESCKLFIGGISWETTEDRLREYFQSFGEVLEAVIMKDRATGRARGFGFLVFSDPIVAERVVFLRHVIDGKLVEAKKAVPRDDHVVLNKSYNTSLQGSPGPANSKKIFVGGLASSVTEAEFKKYFAQFGVITDVVVMYDHRTQRPRGFGFISFESEDAVDKVLQRTFHELNGKMVEVKLAVPKEMALNPIRNQMNVNSFGSSRISALLMNEYTQGFSPSPISGYGVKPEVRYSPGLGNRGGGFSPFGHGYGIELNFEPDQSQNFGSGSSAGFGRPLSPGYAPSLGRYGSQIESGGAGNGPVLNAATKNHLWGNGGGLGYMSNSPISRSSFNGMSSLGSIGDNSRRNSYRSEGGGGLGLEAMRGGHVGGYSSGSSSLETDSLYSDSAWLSLPAKAEERMGAFDFMSRGPAGYINRQPNGEVAAASPLSSASSECNSNSCRWKPYSNSTDFQANASVLLILIFSSLICALSLCAAIRCFLRPTTPETDDNDHKSDLEADSSFTIPTPTLVYSSDLELAGAEAECAICLSEFEQGESIQVLEKCHHGFHVKCIHKWLSSRSSCPTCRTSIFLQSTLDSTPSTEAPSTN

SEQ ID NO: 5922 - protein, 238 aa, Picea mariana
MATEACGEKGQVQLLGGSLSSFVLRVRIALALKGIDYEFIEENMQNRSQLLLQSNPVHRKIPVLIHNGKPVCESMIIVQYIDEAWDTKAPNLMPKDPYDLAIARFWAAFVDDKLVPCMRRVFAGHGEQLQKEAEDLVTNFHLIEEALRTNSCFSGKAYFGGDKIGLLDIALGGMLAVLKGLEKATDTVIIDPEKMPLLSAWMDRFCQSNGVKEVMPDPAKQLESLSARRARLASPAGN

SEQ ID NO: 5923 - protein, 219 aa, Castanea crenata
MAGKVVLLDFWPSLFGMRVRIALAEKGIKYENKEEDLSKKSPLLLEMNPVIKQIPVLIHNGKPVCESLIIVQYIDEVWNDKCPLLPSDPYQRAQARFWADFVDKKVYVASRKIWRPKKEEQEAGKKEFLETLKTMEGELGGKPYFGGETFGYVDLSLIPFYSWFHAYKVLDNLNIEAECPKIIAWAKRCMQKEAVAKTFHDPKKVLEFVAQTRKKYVTA

SEQ ID NO: 5924 - protein, 72 aa, Unknown
  marine gamma proteobacterium HTCC2143
MAKEEQIEMEGEVIDTLPNTTFKVQLENGHVVIAHISGKMRKNYIRILTGDKVRVELTPYDLSKGRITYRAR

SEQ ID NO: 5925 - protein, 219 aa, Castanea crenata
MAGEVVLLDFWPSMFAMRVRIALAEKGIRYESKEEDLSNKSPLLLEMNPINKQIPVLIHKGKPVCESLIIVQYIDEVWNDKSPLLPSDPYQKRSSQVWADFVDKKVSGAAKKVWSTKGEEQEAGKKEFLEALKTMEGELGDKPYFGGETFGYVDLSFITFYSWFHAYEVLGNFNIEAECPKIITWAKRCMQKEAVANTLPDQKKVYEFVVQLRKMFVSE

SEQ ID NO: 5926 - protein, 380 aa, Unknown
  Vibrio sp. Ex25
MKNISKLLVGFSFALPVLFLLLSKAGTADTMDKMKTSENAEIAILAGGCFWCTESDLEQLTGVVDVVSGYSGGHVENPTYRQVSSGKSGHIEVIEVKYDPKVVSYEQVLDYFFRHIDPTDDKGSFVDRGPQYRPAIFYHNAEQKQIAEQFIMEIDKAMIYPKPLKTELIEFEKFYPAEEYHQDYYKKSSLKYKYYRYASGRDKYLDEVFGDDRKEPPKTLRQLIEEKKLLSKVKEYSKPAKSEIKSNLTELQYYVTQEEGTERPFDNEYWDNKEAGIYVDIVTGEPLFSSTDKYKSGTGWPSFTKPINPGYIVEKTDYKLIYPRTEVRSKFGDSHLGHVFKDGPKPTGLRYCMNSAAMKFVPVSEMKTQGYEEYLYLFDK

SEQ ID NO: 5927 - protein, 564 aa, Pseudomonas fluorescens
MSESFAELFEESLKTLNLQAGSIITGVIVDIDYQARWVTVHAGLKSEALIPLEQFYNDAGELSINVGDEVHVALDSVEDGFGETKLSREKAKRAECWIVLEAAFAAEEVVKGVINGKVKGGFTVDVNGIRAFLPGSLVDVRPVRDTTHLEGKELEFKVIKLDQKRNNVVVSRRSVLEAENSAEREALLESLQEGQQVKGIVKNLTDYGAFVDLGGVDGLLHITDMAWKRIKHPSEIVNVGDEIDVKVLKYDRERNRVSLGLKQLGEDPWVAIKARYPESTRVTARVTNLTDYGCFAELEEGVEGLVHVSEMDWTNKNIHPSKVVQVGDEVEVMVLDIDEERRRISLGIKQCKSNPWEDFSGQFNKGDKISGTIKSITDFGIFIGLDGGIDGLVHLSDISWNEVGEEAVRRFKKGDELDTVILSVDPERERISLGIKQLESDPFSEYVQENDKGAIVKGVVKEVDAKGAIITLANDIEATLKASEISRDRIEDARNVLKEGEEVEAKIISVDRKSRVIQLSIKSKDVEDEKEAIQSLRDKPAASDIAAGPTTLGDLLRAQMEKQN

SEQ ID NO: 5928 - protein, 256 aa, Corynebacterium diphtheriae
MANLATVERYVSAAAQRGADMVVFPEATMQGFGTGRLDRVAERIDGPFATRICQLARELNIVIVVGMFSPADTHDGKQRINNVALIAHPDSVREYRKIHTYDAFGFKESDTVRPGNQLVTFPVGDVTCGIAVCYDVRFPQQFIDLARLGAEVIVLPASWADGEGKLEQWRTLTAARALDSTSYIVACDQAVAEDERAPGAPTGVGHSAVVTPDGRRIAEAGTGEELFMVNVNRDLVRRTREAIPVLADAGYNQNGE

SEQ ID NO: 5929 - protein, 896 aa, Glycine max
MMDSPEPSKNNNGSSSSASTLNNNNNNDDAPSSESPQVQESPFLRFVKTLSPIPTKASHMTQGCVGLSSPPLVFKSPRISHRETQLTKRPQGTQSFGGVIPQSVNEGNRLGEAPGDSRTSNSHQSLPERFINDTQQVFDFKNDENTQYYSSPSCIDKYLVDPGDIDQMYSADQDVQQQSTDAAETSLSDQTHSKNNILNFDRKDGPGDKVEESLPLSEDFNKVHLEKAAYGEEPEKMEGEKNDVEWSSQEPAKLESILAADGFDKRYSHGPLPQDVKGCEDYNEMVPTSHVTAENILQDGSEATLKHHGIRRRCLQFGEAASNALGRNVKLNAASHTMITVKPSELVTSLCPRRGSGNFPSTSPKPSGIGLHLNSIINAIPIDQAATTGVRLSDSSQGMKSTSSIRLQRMENVKRSILSSNVDGRSLVDTRTESHEIDDTVATDTGNSEDLNQPPSPCKKKKKTSVTADDNGCKRCNCKKSKCLKLYCDCFAAGTYCTDPCACQGCLNRPEYVETVVETKQQIESRNPIAFAPKIVQPTTDISSHMDDENLTTPSSARHKRGCNCKRSMCLKKYCECYQANVGCSSGCRCEGCKNVHGKKEDYVAFGHTSSKERVSSIVEEGSDCTFHNKLEMVASKTVYDLHCLSPITPSLQCSDQGKEDAKSRVISGNYLPSPESDVNMLASCTNYTKSSENLHGSEALLDTNEMLGNTPYDSQIECSDAALLQLTPLPNPEQSGTFIILICTQMSVQRLLTPDSPMDVFASYLAVLFVGVVLPLTPSTRVGEAQYLQCSESDSKLFDILENETPDILKEASTPMTSVKVNSPTQKRVSPPQSCHIGIGSSSSGGLRSGRKFILKAVPTFPSLSPCINSKSNGDEDSCNSPSKSPLKANECPPT

SEQ ID NO: 5930 - protein, 144 aa, Arabidopsis thaliana
  misc_feature (12)..(12): Xaa can be any naturally occurring amino acid
  misc_feature (47)..(47): Xaa can be any naturally occurring amino acid
  misc_feature (52)..(52): Xaa can be any naturally occurring amino acid
MASSMLSYAAEXTSPAQATMDAPFTGLKPSDALPDTHKANIASVASXNGGRXICRKARPPSGKKKKETLSYLPDLTDVELAKEVDYHLHNKRMTCAENEMEHGFVYREHGNSPGYYDGRYWTLWKLPLIGCTDSAEVLKEDEEC

SEQ ID NO: 5931 - protein, 64 aa, Pectobacterium carotovorum
MKRMLINATQQEELRVALVDGQRLYDLDIESPGHEQKKANIYKGKITRIEPSLEAAFVDYGAER

SEQ ID NO: 5932 - protein, 711 aa, Unknown
  Vibrio sp. Ex25
MFEKPVVKTFQYGNHTVTLETGVIARQATAAVMVTMDDTSVFVSVVGKKEAVAGQDFFPLTVNYQERTYAAGKIPGGFFKREGRPSEGETLTARLIDRPIRPLFPDAFKNEVQVIATVMSVNPDVQPDIVTMIGTSAALAISGIPFNGPIGAARVGHIDGQLVLNPSQTELETSKLDLVVAGTESAVLMVESEADNLTEEEMLAAVVYGHDQQQVAIKAINEFKAEVATPAWDWVAPEENTALKDKIAELAEAKLVEAYKITEKMARYDRINEIAAEVNEVLLAEDPEADTKEIHTIFHDLEKTVVRRSIIAGNPRIDGREKDMVRALDVRTGVLPRTHGSALFTRGETQAIVTATLGTQRDAQIIDELTGERKDHFLLHYNFPPYCVGETGFVGSPKRREIGHGKLAKRGIAAVMPSVDEFPYTVRVVSEITESNGSSSMASVCGTSLALMDAGVPIKSSVAGIAMGLVKEGDDFVVLSDILGDEDHLGDMDFKVAGTNTGITALQMDIKIEGITKEIMQIALNQAQGARKHILSVMDEAISGAREDISEFAPRIHTMKISAEKIKDVIGKGGAVIRALTEETGTTIEIEDDGTIKIAATEGTAAKEAIRRIEEITAEVEVGRIYTGKVARLADFGAFVTVLPGKDGLVHISQIAEKRVEKVSDYLAEGQEVQVKVLEIDRQGRVRLSMKEAVEKPAEEAAAEAPAAKDE

SEQ ID NO: 5933 - protein, 510 aa, Solanum lycopersicum
MASCSSSTAAMAMAITIFLFLLSFVTPVFLAKPVHHAHHPRFASHNYRDALAKSIIYFEGQRSGKLPSSQRITWRKDSGLSDGKAMGVDLVGGYYDAGDNVKFGFPMAFTTTMLSWSVIEFGGLMKGELLNAKQAIGWATEYLLKATAHPDTIYVQVGDAGSDHSCWERPEDMDTPRSVYKIDKNTPGTEVAAETAAALAAASLVFRKCNPSYSKILIKRAIRVFAFADKYRGSYSNGLRKVVCPYYCSVSGYEDELLWGAAWLHRATKNPTYLNYIQRNGQTLGAAETDNTFGWDNKHVGARILLSKSFLVQKLQTLHDYKSHADNYICSLIPGTPASQAQYTPGGLLFKMDDSNMQYVTSTSFLLVTYAKYLTSARMVVKCGGVVITPKRLRNVAKKQVDYLLGDNPLKMSYMVGYGARYPQRIHHRGSSLPSVANHPAKIQCRDGFSVMNSQSPNPNVLVGAVVGGPDEHDRFPDERSDYEQSEPATYINAPLVGTLTYLAHSFGQL

SEQ ID NO: 5934 - protein, 265 aa, Triticum aestivum
TSLRDLYPEELDNPQAALEALPPRHEAYLAEAQRLQREYASQIHILIGFEAEFIRPNCAAHVRKLAEHPIIDYFIGSVHYVHSTPIDYNKEMFATAREASSRKTEESLYEDYYDLQYDMLKELRPRVVGHFDLVRLMSEDPARDVRQWKGVWERILRNLALAREQDGWLEVNSAGLRKGLAEPYPGRIIAEEWIKLGGKFTFCDDSHGIAQVATNYARTVTYLESLGIKEVWCLKRTPNSGVDGTKRATVEEVSVPLSVFRENFP

SEQ ID NO: 5935 - protein, 1341 aa, Gibberella zeae
MTESSPRAVRFQGSEDDGRPDKVRGHRLETPIESNGDPHATERHDELGNLIGYGATGHTGSLTSLAPGTVINGVSKAQRGPNTGDDGTAYTPNGSWPQRPLGPARTPSNTYNPATSRKPAHPPATPSFTESIRSSSKTRPRNESRFRAQERAYVQKLRQDYSGGYFTSYSNLNGNDSDSEGETPSSEGPYDDRFDQETIMFYGNDTLQPTDEDLKDPENRERLEWHGMLEAVLTGDVVRQEKKRLIGSADQQAGKSAHKTELWLGIRSKVCGRHIPVQRRMLEESRSTLDRTLDEIINFQIKGESEAGKPPYEQVKDMVAKIQMCENLYPSWAALATEHKAADSATFKESHDAIISWYNTNEMINTELNILKKWVGNEELDFTRTKQRSPAVNGINNDETSFLDRLMKEDGLQSLYNDDNGNLEKGMLAPISTVISKAKDTLIRNSEAFRKRHLPPYLEELLTLISFPSRLIEEITRLRLAYARRVKESAQQNPLMQDQMISQFQLLLKFAIRIKIECTSIANPEPGWDLPPCIDESFDQVVLEALKYYFKMLNWKLSGNKNTFKEAELLFQEWDFANEIGSHLQRGHIEVAEQFSSLTFKALHRLSQTFEKELQAKPKETATEMSKRYKACLDSVRVRQRMLQRFTRMLNDNYEHASDYSISFPPETMQKFYDQLVASGHFQVDTRLLEQDNIYVIASPELRERLEDIQAMMAITSKDQFPDELGEQYLLILRPEDPLNWFGETIEVPLRDLNIDLKRGHIRLCASSPQTLHNARRAFIENVDMHVDLVQEARSNIQKVNSRLTEIRRVAYKLSNNFMDSVEIIRKQARGKDCQELIQTCFVFATEFGQRSLLYMDSNRRQMNNLKLTKLALDWVSFICDDCVASDRKTFRWAVLALELAMGMTRGRHILALGEGEYAKLRSKVAGCMSLLISHFDVMGARSNLAAQAEKERIEALVGQFRKLDKNRMMNDEEASRCVTEQRMSELERVDEYRCEKIAERQGVGRVLEGNNEVDRSLAYLSSSATNVTMRWQQGQFVGGGTFGNVYAAMNLDTGHLMAVKEIRLQDPKLIPQVAEQIREEMGVLEVLDHPNVVSYYGIEVHRDRVYIFMEFCSGGSLANLLEHGRIEDEQVIMVYALQLLEGLVYLHESGIAHRDIKPENILLDHNGIIKYVDFGAAKWIARQGRTLAGDVQPSLPNRSMTGTPMYMSPEVIKGENPGKPGAVDIWSLGCVILEMATGRRPWAQLDNEWAIMYNIAQGNPPQLPPSDQLSPQGLDFLKRCFTRDPRNRSSAVELLQHDWITSIRSQVVEPATPSDTSSSAQSTPTVGSISSKLGGSDGFY

SEQ ID NO: 5936 - protein, 258 aa, Glycine max
  misc_feature (43)..(43): Xaa can be any naturally occurring amino acid
MAAATSSAVLNGFGSHFLCGGKRSHALLAAGIGGKVGAVVSPXRVIVAVAAAPKKSWIPAVKGGGNFIDPEWLDGSLPGDYGFDPLGLGKDPAFLKWYREAELIHGRWAMAAVVGIFIGQAWSGVPWFEAGADPNAIAPFSFGSLLGTQLLLMGWVESKRWVDFFNPDSQSVEWATPWSRTAENFGNSTGEQGYPGGKFFDPLGFAGTIKDGVYIPDTDKLERLKLTEIKHARIAMLAMLIFYFEAGQGKTPLGALGL

SEQ ID NO: 5937 - protein, 390 aa, Corynebacterium diphtheriae
MAAKNEWAEKDYYADLGVSSSATEAEIKKAYRKLARENHPDSHPGDAAAEERFKKVAEAYDVVGDETKRKEYDEFRSMIASGGFGGAGFPGGFRTQEGFDFDLGDIFGSGAGRGHAPQGGFGDIFGGIFNRGGGARNAARPTRGSDVETEITLEFREAAKGTTIPLQLTGDAPCHTCHGSGSRSGAPTTCTECNGTGFTSENKGAFGFSAPCTQCGGTGKMISDPCPDCSGTGTQRRTRSITVRIPAGVVDGQKVRLAGQGEAGPNGLPAGDLYVTVHVKNDRVFTRSGDDLEVTVPVSYAELALGDTISVPTLDLPVRVRIPSGTPNGRVLRVRGKGVPKRGGSAGDLLVKVEVTVPSSLDAASASALRAYVQAERDAGFDPRAGWAGK

SEQ ID NO: 5938 - protein, 59 aa, Passiflora murucuja
WEYQVGPSVGIEAGDHIWCSRYILERITEQVGVVLTLDPKPIEGDWNGAGCHTNYSTKS

SEQ ID NO: 5939 - protein, 438 aa, Prochlorococcus marinus [sequence omitted]

SEQ ID NO: 5940 - protein, 73 aa, Ralstonia metallidurans
MAKEELVEFGGKVSEVLPDNRFRVILENGFEVWAYSSGRLKKNRIRVLAGDRVTLEMSPYDLTKGRINYRHKS

SEQ ID NO: 5941 - protein, 124 aa, Plantago major
QKQQAAEAASRDGSGGSSSKYTRYSPLQAEHHEQLPKTPIRPPEKRQRVPSAYNRFIKEEIQRIKATNPEISHREAFSTAAKNWAHFPHIHFGLKLDGNKSAKPLDHSVAGSESMTTQKSLGLY

SEQ ID NO: 5942 - protein, 55 aa, Passiflora nitida
WEYQVGPSVGIDAGDHIWCSRYILERITEQAGAVLSLDPKPIEGDWNGAGCHTNY

SEQ ID NO: 5943 - protein, 857 aa, Oryza sativa
MAAAVAMRGSSSDGGGYDKVSGMDSGKYVRYTPEQVEALERVYADCPKPTSSRRQQLLRECPILANIEPKQIKVWFQNRRCRDKQRKESSRLQAVNRKLTAMNKLLMEENERLQKQVSQLVHENAHMRQQLQNTPLANDTSCESNVTTPQNPLRDASNPSGLLSIAEETLTEFLSKATGTAIDWVQMPGMKPGPDSVGIVAISHGCRGVAARACGLVNLEPTKVVEILKDRPSWFRDCRNLEVFTMIPAGNGGTVELVYTQLYAPTTLVPARDFWTLRYTTTMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 5944 - protein, 302 aa, Ashbya gossypii
MSTSNCRFYENKYPEVDDVVMVNVQQIAEMGAYVKLLEYDNIEGMVLLSELSRRRIRSIHKLIRVGKNEVVVVLRVDKEKGYIDLSKRRVSSEDMIKCEERYQKSKAVHSILRQCAEKFQFPLEDLYKTIAWPLSRKYGHAYDAFKLSIVDETVWEGIEPPSAEIFEELKQYISRRLTPQAIKIRADVEVSCFSYEGIEAIKEALKAAEATSTEQMQVKVKLVAAPLYVITTQALDKNQGIEALNHAISKIEEYIAKYQGVCNVTMPPKAVTATEDAELQALLESKELENRSDSEEEDSDYE

SEQ ID NO: 5945 - protein, 429 aa, Phragmites australis
MAQAVVPAMQCQVGVKAAVRARPAAAGAGGRVWGVRRSGRGTSGFKVMAMGMSTSGVVPRLEQLLNMDTKPYTDNIIAEYIWVGGSGIDVRSKSRTISKPVEDPSELPKWNYDGSSTGQAPGEDSEVILYPQAIFKDPFRGGNNILVICDTYTPAGEPIPTNKRHRAAQIFSDPKVVSQVPWFGIEQEYTLLQTDVNWPLGWPVGGYPGPQGPYYCAVGADKSFGRDISDAHYKPCLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEVEALAAKKLALKV

SEQ ID NO: 5946 - protein, 650 aa, Glycine max
MANNGSPKHKKMQKNLCTQLAVAVRSTQWSYGIFWAPSTTEERVLEWREGYYNGDIKTRKTVQAMELEMKADKIGLQRSEQLKELYKFLLAGEADPQTKRPSAALAPEDLSDLEWYYLVCMSFVFNHNQSLPGRALEIGDTVWLCNAQHADSKIFSRSLLAKSASVQTVVCFPYQKGVIEIGTTELVTEDPSLIQHVKACFLEISKPTCSDKSSSVLDKPHDDKYPTCTKGDQRVLEAMALENPCSLEENIKFDHDPINELQDGNNEDSNMDSPDGCQHHFPMDGSMIEGINGVPSQVHFVNEALVIGAPDSLSSCDCMSEASENQGNDSKNVDQTQLMELQYCHKPKRSSMDVGADEDLCYIRTLCAILGNSSTFKPNPYAGNSNCKSSFAKWKKGRVSERKRPKLHQSMLKKTLFNVPFMHRSYSSLKSQKENGRMKWTSKLENANDGFMEKTFSDKKRENKNFHVVKPMVPSSISEVEKISILGDTIKYLKKLETRVEELESYMEVTDPEARIRRKCPDVPEQMSDNYGTRKICMGMKPWVNKRKACGIDEIDTELERIVSEESKVLDVKVNVKEQEVLIEMKCPYREYILYDIMDTINNLHLDAQTVESSTSDGVLTLTLKSKFRGAATAPTRMIKEALWKVSGNT

SEQ ID NO: 5947 - protein, 415 aa, Schizosaccharomyces pombe
MNSIPDSYSLKQGFPEGLGEYVDPSGNPNSQVRIGYGQDSVSRFQQPVPDVDPTAVNHYNASAPIEVASPFDNVTQGLVGSDAQALAEYWQKTIDTLEHDDQAVKTLHLPLARIKKVMKTDDDVKNKMISAEAPFLFAKGSEIFIAELTMRAWLHAKKNQRRTLQRSDIANAVSKSEMYDFLIDIISKDNNNSRASSSQAHMSATQVAAMGGMNGLQPFPTQAGLPNQGFPMPTGSQLPFSNQQSSQPSMQYSSHPSRMQQMQDIDQSMYKQQRLGSEYPQLQMSDNSGNVNQMNMQRPVMVAPYMAEHLYRYPPTHLESGSSAFRLQSSPMGYQMPQFQGNMRPNMQQSQMFDPSAYGMSRRPGSPRQFDQQQRLYSQPNAMMYQTQQGRQGNPMHQQFSQQQNPLSRYSQQPQ

SEQ ID NO: 5948 - protein, 347 aa, Streptococcus suis
MEERKRARLIYNPTSGQEIMKKNVAEVLEILEGYGYETSAFQTTAEKDSAKNEATRAALADFDLIIAAGGDGTINEVVNGIAPLEKRPQMAIIPTGTTNDYARALKVPRGNPVEAAKVIGKQQTILMDIGLAKNQKNGFHQEHYFINIAAAGTLTELTYSVPSQLKTMFGYLAYVVKGAELLPQVQFTPVRVEHDEGVFEGSVSMIFVALTNSIGGFEQIVPDAKLDDGNFTLLMVKTGNLFEILHLIRQVLDGGKHIESDLVEYIKTKSLSIENLNPDNRLLLNLDGEFGGEAPVRLHNLSNHIEFFADTDLVSDHAITLDTDQMNREDMAKRFIEETDHIDEAIK

SEQ ID NO: 5949 - protein, 539 aa, Unknown
  delta proteobacterium MLMS-1
MASLAITFGSGAMTNSIADTTVTDLFMMIGSNPDTSHPTIGLRLHQALDRGAKMVVIDPRRTRFAERADLWLPIQPGTDVALLNAMMQVIIEEDLWAKQYVEERTEDFAELRTLVADYTPEKVAEVCRVPAADIRKAARMYAADGRHATYHGMGITHYATGTDRVKSIANLAMLCGKVGFEGGGSNPLRGQNNVQGACDMGALFNTLPGYGGLNDEELFDRYEKIWKVRLPRRPGKPATEVWENILEGNIRALYVFGEDPMLADTNINHVQQALEKTDFLVVQDLFLTETAKLADVVLPAACFAEKDGTFTCTERRVQRVRKAVEPPGEAKPDWQIFCELAKRMGYQMHYDTAEDIFAEIRQLLPQYKGITYQRLEQVGLQWPVPDEEHPGTPVLHVGQFTRGRGLFVPEKFIPPAEPVNGEYPMLFTTIREYARYNFSSMTGKTREIDVIAPEALAEVHPNDAGRMGITDGVMLRLTSRRGSVDIRAKVTDQTQEGTISAPYNFAETPVNRLTLDALDRLSRTPEYKLCAIRVEVLEQ

SEQ ID NO: 5950 - protein, 323 aa, Deinococcus radiodurans; identical to SEQ ID NO: 366

SEQ ID NO: 5951 - protein, 342 aa, Oryza sativa
MAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 5952 - protein, 379 aa, Desulfotalea psychrophila
MRMKDIFEFADELGPLKVIHVYEPSVNLRAVLVVDNIARGPSLGGVRMATDVSVEECVRLARAMTYKNSAAGLPHGGGKAVLYGDPKMAKVEKEKMIRALAKVLRNEDSYIFAPDMGTDEECMAWVQDEIGRVVGLPREIGGIPLDEIGATGFGLSHAVDVALNYCDFQLEGARVVVQGFGAVGKHAARYLSQRGAVLVAVADSRGAIYNPDGLDVQQLIALKAAGGFVGDYPEARKMTGDDLLDVACDIWIPAARPDVIHEANVHRLNTRLVVEGANIPLTHGAERILHERGILCLPDFIANAGGVICAAMEYQGASQVAALAMIEEKLRANTEQVLAMVKDRDMLPREAAMEMALGRLKKAMSYRRFSLFSSGPKFI

SEQ ID NO: 5953 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKEFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 5954 - protein, 477 aa, Glycine max
SARDYHSLHHSSPVPESFTAGNATLLEHLIMTVIIGTPILGASLMGYGSASLIYGYVLIFDFLRCLGHCNVEVVPHQLFEKLPFLRYVIYTPTYHHLHHSDKDTNFCLFMPLFDALGNTLNKKSWQSPKLPSSGSGNGDTVPHFVFLAHMVDVSSSMHVQFVFRSFASLPYTTRFFLLPGLPVTFLVLLAMWAWSKTFLVSFYYLRGRLHHTWVVPRCGFQYFLPFATEGINNQIEQAILRADKIGVKVISLAALNKNESLNGGGKLFVDKHPNLRVRVVHGNTLTAAVILNEIPQDVKEVFLTGATSKLGRAIALYLCQKKVKVLMLTLSTDRFQRIQKEAPPEYQSYLVQVTKYQAAQNCKTWIVGKWITPREQYWAPRGTHFHQFVVPPILPFRKDCTYGDLAAMRLPEDVEGLGCCEYTMDRGVVHACHAGGVVHSLEGWPHHEVGAIDVNRIDLVWEAALKHGLRPVSSFTQ

SEQ ID NO: 5955 - protein, 338 aa, Enterobacter cloacae
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAKELRQQEKDLGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 5956 - protein, 164 aa, Triticum aestivum
GSSSTSATTNGVDLKIVPPAGFLLHRRAAVPSAPILRGRSASGRCGLAILVSSSNVESGAAGLSPLSDSEKKGPVVMEIPLENIRTRANDPDEVQKLMDSIRVIGLQVPVGIFSFNINFYQNYFLLVHKLNYVRTGIFLCGIKYIQIKLYTELIHGRTLLLKKK

SEQ ID NO: 5957 - protein, 443 aa, Ipomoea nil
MLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 5958 - protein, 102 aa, Glycine max
  misc_feature (34)..(34): Xaa can be any naturally occurring amino acid
MGRRPAKCYRQIKNKPYPKSRFRPCVPDPKIKIXDVGMKKEGVDEFPFRVHLVNWEKENVSNEALETARIACNKYMAKFARKDTFHIRVTVHPFHVLMINKM

SEQ ID NO: 5959 - protein, 339 aa, Unknown
  marine gamma proteobacterium HTCC2143
MPTINRRRFLQFGAATAVVASATACSSDGPQATIDKQLPVGPYGADATAESVTKDMDLSGKTAVVTGCNSGIGYETMRVLALRGAHVIGTGRTLEKAQIACASVEGITTPVALELSDFQSAVDCANRIKAMNTPIDIVICNAGINTFGELELIDGIERIFRVNHLGHFVLINNLLPALASANAGRIVHVGSVSGYVQAPAVGIDFDNLRGEKIFDAGEAYGRSKLANALFSLQLSKNLADTTTTSNVIHPGLVLTNIARTAPAFLRKGFEWVGPLFAKTPAQGAATQVYVATHPSLEGISGAYFEDCNPVTISGDHHMFDEAMADKLWSVSMEMTRGFI

SEQ ID NO: 5960 - protein, 221 aa, Brassica oleracea
MAFYSEDNKSEDYLFKIVLIGDSAVGKSNLLARFARDEFYPNSKSTIGVEFQTQKIVINGKEIKAQIWDTAGQERFRAVTSAYYRGAVGALLVYDISRVQTFQSIGRWLNELHTHSDMNVVTILVGNKSDLKDIREVPTSEGKALAEAQGLFFMETSALDSSNVAAAFETVVKEIYNILSRKVMTSQELNKQDPASLSNGKKVVIPSEGESKTGGGGCCSR

SEQ ID NO: 5961 - protein, 337 aa, Mesorhizobium loti
MLEKFERYPLTFGPTPIEKLDRLGKHLGGNVEIYAKREDCNSGLAFGGNKLRKLEYIIPDAIASDADTLVTIGGVQSNHTRMVAAVAAKIGMKCLLVQESWVPHEDVVYDRAGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPEGSRILYAHLGGAPAINGYGYTFRNG

SEQ ID NO: 5962 - protein, 254 aa, Legionella pneumophila
MNNVSMRELLEAGAHFGHRTRFWNPKMSEYIFGSRNKIHIINLEKTLPMLSDVTNYVSRLAANKAKILFVGTKRAAQDSIREHARRCGMPYVDHRWLGGMLTNYKTVRQSIFRLKELKEMKEKGLFNDMIKKEALMLTRELEKLERSLGGIENMGGLPDALFVVDVGFEHIAVEEARRLRIPVIGVVDTNNSPDNIDYVIPGNDDSMRAVDIYVRCVADAILDGKNSNTVGRVSSDSEFVEVTSNSNEEEKSGE

SEQ ID NO: 5963 - protein, 323 aa, Unknown
  marine gamma proteobacterium HTCC2143
MATSNFGYRSTALDVVSGINLSNKNAIVTGGYSGIGIETVVALATAGANVTIAGRDLSRAERTADELNSKGLLGVVDAMSLDLGSLQSVKGFVESYCASHASLEILVNNAGVMACPFETTTDGFELQFGTNHIGHYALSRLLLPLLLNAESARVVCLSSTGHMISPVIFDDINFSQRKYDAWSSYGQAKTANSLTAVALQQLYGSKGVDAFAVHPGGIMTSLQRHMEQKDIEARGWVDAEGNINERFKTVEQGASTSTWAATASELTAKGGVYLEDCDFAEVVASRPDYPKGVIAYAVDSEAARQLWQISESMILDKFSDYFA

SEQ ID NO: 5964 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 5965 - protein, 376 aa, Brassica oleracea
MEGLLSYRSNVLRNIMREREKDRKKMLISEIFSENEDEEVVIIGGLVMVQFVYAGNSLLMSYLMSLSLGPLTIVIFSTFATFLILSPFAILFERKQWPDELSPRLIGKLVLISFAGVTLFQTLFLEGIRLTSPAMATAMPNLAPGLIFFIAWMVRLEKMDMKCVYSKLKILGTLLCVFGALTMSLMHSASIIQDEKDNASIFVFDRDRVVGCMYLLGAVFILSSNVVLQASTLAEFPAPISLSAITSLIGVVITTMLQLLQNPNTKVVTRSLISISNLVGFSLLGGMVSGACVSFNGWAMKKRGPVMVSMFSPIATVISVGLSVVTLGEPVRIGSVGGMALMFIGLYLVLWAKGKEGFSQIDSFESEYDPKKPLLS

SEQ ID NO: 5966 - protein, 1448 aa, Oryza sativa
MARFANGSVVISMDDTHVLSTVAAAKSSEPVRDFLPLTVDYQEKQYAQGVIPTTYMRREGAPKERELLCGRIIDRPIRPLFPPGFYHEVQIMVNVISSDGKQDPDVMAANASSAALMLSDIPWNGPIGVIRVGRIDGNFVLNPTVDELGLSDLNLVYACSRDKTLMIDVQAREITERDLQAGMKLAHAEAVKCINPQLRLAKRAGKKKKEYKISLISDKSYEKIRTLSEAPIEEVFTDSTYGKFERGEALENITQSVKAKLEEECDEDSLKFLHKAVDTVRKQVIRKRIIEKGLRVDGRQLDEVRPLYCESSTYPILHGSALFSRGDTQVLCTVTLGAPGDAQRLDSIVGPPTKRFMLHYSFPPFSINEVAKRGGLNRREVGHDGLHGPIRLGDELRVWIEHKALDPTGFLLTNRLVFWERQWLSAGTLAEKALLAVLPPEGEFPYTVRVNSEVMASDGSTSMASVCGGSMALMDAGIPVREHVAGVSVGLVSEVDQTTGDISSYRILTDILGLEDHLGDMDFKIAGTRRGITAIQLDIKPAGIPLDIICESLEPARKARNQILDRMDQEISSARAFNDGSSPRLATLSFSSDSLRKLLFHRKKIEQETGARVSVSDGTVTIVAKTQPIMDKAIEKVEFLVGREIEVGRTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPKYRTGRKIVAFSATRSHNDEACGSEAASDNRQEMNQKNEPKMRSSSRVAAMSNAGRRRRSLTSIAPSPVSSSSFPSGAREAQAPPSQLPSWKFSQVLGELPLAAAGEGHDNGTLQDDGDTISAIEFDGRGEHLAAGDHAGRVILFRRTDDESHPPPPPSRADLERTDYAAAAPPAYAYMAEFQSHEQELGDRREGEEAEMVRAAEQLVAVHARHQRPHRQALEASRQVSEHRSRKGNGQPRRRRSTPTSASLSEIALLGEGDSSVRNGYYYEWASKKARNYLSPDSAEHSEKASEVGEGYTAKCRRVFARAHVYNINSISNNCDGETFVSADDLRINLWHLEVTDQCFNVVDMKPADMEDLVEVITSAKFHPSSCSLLAFGSSRGFVRLVDLRHSALCDRNVRIFQDRGNSVQPRTLFTEIISCISDVKFTGDGKYLLTRDYMNLKLWDLRVESSPVATYKVHEFLRPKLSELYNNDCIFDRFSCCSSKGGDYFATGSYRFLLLQHINLISGV

SEQ ID NO: 5967 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEDRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 5968 - protein, 248 aa, Triticum aestivum
VTSRTSLYKKAGWYRSGIPGISSTHASDENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 5969 - protein, 554 aa, Tetragonia tetragonioides
MAFDLSYFVSNKLGMLATSDHASVVSMNLFVALLCGCIVLGHLLEENRWMNESITALIIGLGTGVVILLISGGKSSHLLVFSEDLFFIYLLPPIIFNAGFQVKKKQFFRNFITIILFGAVGTLISFTIISLGAMEFFKKLDIGSLDLGDYLAIGAIFAATDSVCTLQVLNQDETPLLYSLVFGEGVVNDATSVVLFNAIQNFDLTHIDHRIALQFAGNFLYLFFTSTLLGAMTGLLSAYIIKKLYFGRHSTDREVALMMLMAYLSYMLAELFYLSGILTVFFCGIVMSHYTWHNVTESSRVTTKHAFATLSFVAETFIFLYVGMDALDIEKWRFVSDSPGISVAVSSILLGLLMLGRAAFVSPLSFLMNFFKKSQAEKVSLRQQVIIWWAGLMRGAVSMALAYNQFTRSGHTQLRGNAIMITSTISVVLVSTVVFGILTKPLILFLLPQPKHFNSTSTVSSENLGSPKSFTLPLLGNHQDSETDIGNHQDSTDRGLGRPSSLRMLLNAPSHTVHHYWRKFDNAFMRPVFGGRGFVPYVPGSPTEQSTNNLTERT

SEQ ID NO: 5970 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAESEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 5971 - protein, 220 aa, Triticum aestivum
  misc_feature (136)..(136): Xaa can be any naturally occurring amino acid
  misc_feature (159)..(159): Xaa can be any naturally occurring amino acid
MARRPARCYRYCKNKPYPKSRFNRGVPDPKIRIFDLGRKRANVDEFPLCIHLVSNEYEQLSSEALEAARICANKYLVKIAGKEGFHLRVRAHPYHVVRINKMLSCAGADRLQTGMRGAWGKPNGTVARVNIGQIIXSVRTRDSHRATALEALRRSQYKXFPGRQKIIVSKNWGFTPLRREEYMEKKASGKVLVDGAYVQFLSNHGKLADNVRRFPAAFEG

SEQ ID NO: 5972 - protein, 853 aa, Oryza sativa
MAKSSADDAELRRACAQAVAASGARGEEVSFSIRVAKGRGIFEKLGRLAKPRVLALTVKQSTKGEAAKAFLRVLKYSSGAVLEGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQSLDKSCLGPLRKAYCHSLNLLLRREAREFANELRASTKAPKNPAVWLEGSNSGGQNGSSADTSTVSDAYSKMLTIFIPLLVDESSFFAHFMCFEVPALVPAGAPNAKSRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLIDKAYTKLVSTMFTTLDKIAHSDPKTADIVLIENYAAFQNSLYDLANVVPTLAKFYHEASESYEQACTRHISSLIYLQFERLFQFSRKVDELTYTIAAEEDVRFMIDLRKHLTFVSLNSDSFPARAVKTDLRRVIKSSLSGIDKSIGAMYRRLQKTLTSDELFPSLWDKCKKEFLDKYESFVQMVTRIYGNEPIMSVADMKDVLANF

SEQ ID NO: 5973 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVDVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 5974 - protein, 249 aa, Unknown
  Acinetobacter sp. ADP1
MADYNVSMRDLLQAGAHFGHQTRFWNPKMRQYIFGARNKIHIINLEHTVPALNDALNFANQLASKKNKVLFVGTKRAASNIIREQAQRAGQPYVDHRWLGGMLTNWKTLRQSINRLKDLQTQSQDGTFAKLTKREALERTREMEKLERSLGGVKNMGGLPDALFVIDVDHEAIAIKEAKNLGIPVIGIVDTNSNPDNVDYVIPGNDDAIRAVTLYASAMADAILAGKEYAQSQANAQAKGEEAPAASEA

SEQ ID NO: 5975 - protein, 72 aa, Passiflora oerstedii
GEVMPGQWEYQVGPSVGIDAGDHIWCSRYILERITEQAGVVLTLDPKPIEGDWNGAGCHTNYSTKSMREDGG

SEQ ID NO: 5976 - protein, 519 aa, Chlorobium tepidum
MERLNIALVHLAVRHGEPEHNRRELIRLNRQAAEAGARIIVNTELAVSGYSFRSPKEVAAVAEPVDGPSVQAMAEIAEAAGCYIVLGYPEIDPCTGICYNSAAVLGQDGKLVLNYRKVTAEARWACPGSHMQESLFETPWGRAAVLICSDSYYGLIPRAAALRGADLLLVPANWPGGSLDPRELWRARACENGCALVACNRTGKDRTMECYDAVSCAYGADGSVIAERSSPDSEVFHVELPLSRGKLRSSSRERFASRTPERYRSIYLDMRYANDMTSWHSLPEPAPVQVHCLHELYFEPGDVSVLDSLLHDREKAAGLVVVLPMLRVANREEAVGFLLDVARAHGAAFCAGLVDTDGVAELICCRPDGSVHRRCPERDDFVLIDLDHLRLTLLSKEECRHPEAVTALAKEGCDLAVVPETGFDEGDRAVLGSRSIEQLAIAACGRDVSFICLPPVDHYRWEEAVGEGVDGASMLIEVEKLRRKRFYDRIDVELLLARNGRSPDACRADETGKREEETP

SEQ ID NO: 5977 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREILTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 5978 - protein, 213 aa, Brassica napus
MGCFHSKVAREFRGHEDPVKLASETAFSVSEVEALFELFKSISSSVVDDGLINKEEFQLALFKNRKKENLFANRIFDMFDVKRKGVIDFGDFVRSLNVFHPNASLEDKIDFTFRLYDMDCTGFIERQEVKQMLIALLCESEMKLADETIEIILDKTFEDADVNQDGKIDKLEWSDFVNKNPSLLKIMTLPYLRDITTTFPSFIFNSEVDEIVT

SEQ ID NO: 5979 - protein, 214 aa, Solanum lycopersicum
QSFKLPNPLISQNHKLTTTSTTASRSFSCKSQSTSTDSTNTEVQELSVYEINERDRGSPAYLRLSQKTVNSLGDLVPFSNKLYTADLKKRIGITAGLCILIKHEEEKKGDRYEAVYSFYFGDYGHIAVQGAYLTYEETYLAVTGGSGIFAGVSGQVKLQQLIFPFKLFYTFYLKGIPGLPSELLCTAVPPSPTVEPTPEAKACEEGAALKNYTN

SEQ ID NO: 5980 - protein, 238 aa, Unknown
  Synechococcus sp. RS9916
MLPSWLTGQTPQRSADEQLRHAVLGTALNAPLMDDQEEALFGCGCFWGAEKGFWRLPGVVSTAVGYAGGQTDQPSYDQVCSGRTGHSEVVRVVWSTPAIDFSDLLKLFWECHDPTQGDRQGNDRGSQYRSAIYTTTPRQLELAESSRAAYQQGLDGKGFGAITTEIAANRTFFSAEAYHQQYLAKPGSRPYCSAMPSGVALEAFDGAAYKLPSTVWSHYDWSISHCILRGDNTPIALA

SEQ ID NO: 5981 - protein, 366 aa, Prochlorococcus marinus
MAFNQTEVVLGGIAHIPLVIGAFYIVKALFYRGQDGELAPFSFSYRQAAQRKSSSTTTSTEKPDTKSPPAQTAIPINLYKPKAPFEGTVLENYSLVKEGAVGRVNHITFDLAGSDPHLSYVEGQSIGIIPAGTDANGKPHKLRLYSIASTRHGDNLEGKTVSLCVRQLQYELDGKTIDGVCSTYLCDIKPGAKTKITGPVGKEMLLPDDEEANVIMLATGTGIAPMRAYLRRMFEPTERSKNGWKFRGKAWLFMGAPYTANLLYDEDFERYLREFPDNFIYTKAISREQQNPKGGRMYIQDRVMEYADQIFKMIENPKTHVYMCGLKGMEPGIDEAMTAAATAKGIDWSELRPQLKKAHRWHVETY

SEQ ID NO: 5982 - protein, 57 aa, Passiflora ornithoura
WEYQVGPSVGIDAGDHIWCSRYILERITEQVGVVLTLDPKPIEGDWNGAGCHTNYST

SEQ ID NO: 5983 - protein, 411 aa, Lupinus luteus
MNALAATNRNFKLASRLLRLDSKLEKSLLIPFREIKVECSIPKDDGTLATYVGFRIQHDNARGPMKGGIRYHPEVNTDEVNALAQLMTWKTAVANIPYGGAKGGIGCDPAELSNSELERLTRVFTQKIHDLIGVQIDVPAPDMGTGPQTMAWILDEYSKFHGHSPAVVTGKPIELGGSLGRDAATGRGVLFATETLLNEHGKSISGQRFVIQGFGNVGSWAAQLISEKGGIVVAVSDITGAIKNSKGLDIPSLIKHSKEHKGVKGFHGGDPIDPKSIFSEDCDVLVPAALGGVINRENANDIKAKFIVEAANHPTDPEADEILKKKGVVILPDIFANSGGVTVSYFEWVQNIQGFMWDEEKVNNELKRYMTKGFKDVKEMCKTHDCDLRMGAFTLAVNRVARATVLRGWEA

SEQ ID NO: 5984 - protein, 381 aa, Yarrowia lipolytica
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 5985 - protein, 342 aa, Solanum lycopersicum
MADLLSNWSSTLEAVPKSHCIPEHERPSDPVEIGDSIPVIDLGKANGEERSVVVKDLLKAFEEYGFFQIINHGVPVDLMDEAMKVYKEFFSLPAEEKENYAKDAANNTNRGAATLYSSSAKHYDSEEHRYWRDVLEHSCNLDGEDKKTWPDNPPRYREVIGAYGDELRRVSKVILGMLSEGLGLEAGFFDKELGQRMLVNHYPACPNPSLTLGVGGHCDPNLITIIQQEVYGLQILKDDKWIGVQPIRNAFVVNSGLPITVYSNGKLTSVAHRVVTNTTESRTSIGTFICPHEIVEPAKALVGPENPPQFKPFHWGIDFMPHYLSKKSVYHASLEPFKTEAN

SEQ ID NO: 5986 - protein, 56 aa, Passiflora penduliflora
  misc_feature (40)..(40): Xaa can be any naturally occurring amino acid
  misc_feature (52)..(52): Xaa can be any naturally occurring amino acid
WEYQVGPSVGIDAGDHIWCSRYILERITEQVGVVLTLDPXPIEGDWNGAGCXTIYG

SEQ ID NO: 5987 - protein, 764 aa, Zea mays
IDLTFHIYHFSPFYIGRDLSYNRFTGPIPFNIGFLQVATLSLQGNKFTGPIPSVIGLMQALAVLDLSYNQLSGPIPSILGNLTYTEKLYMQGNRLTGSIPPELGNMSTLHYLELNDNQLTGSIPPELGRLTGLFDLNLANNHLEGPIPDNLSSCVNLNSFNAYGNKLNGTIPRSLRKLESMTYLNLSSNFISGSIPIELSRINNLDTLDLSCNMMTGPIPSSIGNLEHLLRLNLSKNDLVGFIPAEFGNLRSVMEIDLSYNHLGGLIPQELGMLQNLMLLKLENNNITGDVSSLMNCFSLNILNVSYNNLAGAVPTDNNFTRFSHDSFLGNPGLCGYWLGSSCRSTGHRDKPPISKAAIIGVAVGGLVILLMILVAVCRPHHPPAFKDATVSKPVSNGPPKLVILHMNMALHVFDDIMRMTENLSEKYIIGYGASSTVYKCVLKNCKPVAIKKLYAHYPQSLKEFETELETVGSIKHRNLVSLQGYSLSPVGNLLFYDYMESGSLWDVLHEGSSKKNKLDWVTRLRIALGAAQGLAYLHHDCSPRIIHRDVKSKNILLDKDYEAHLTDFGIAKSLCVSKTHTSTYVMGTIGYIDPEYARTSRLNEKSDVYSYGIVLLELLTGKKPVDNECNLHHLILSKTASNEVMETVDPDVGDTCKDLGEVKKLFQLALLCTKRQPSDRPTMHEVVRVLDCLVNPEPPPQPQQQQQKAHAHHQLPPQPSPPAYVDEYVSLRGTGALSCANSSSTSDAELFLKFGEAISQNMV

SEQ ID NO: 5988 - protein, 444 aa, Triticum aestivum
MAAAAGGTSSEGAARVLLQRYQPFGSPPGEYHHFGPADGGGSADMTEAVVLRTPLKRKHNREDNEVAESNDWMMSPGYANAANSPIPTPPSGKGSKMSAKPKAAKGQKSCPQTPLFSGSPGNPATPVGGCRYDSSLGLLTKKFLNLLKGAPGGMVDLNNAAETLEVQKRRIYDITNVLEGIGLIEKKLKNNIRWKGIDDSRPGEVSDDMSILQGDIEALTLQEHSLDGQISEMRDKLRELTEDENNQKWLYVTEDDIKSLPCFQNQTLIAIKAPHGTTLEVPDPDEVNDYPQRRYRIVLRSTMGPIDVYLVSQFEEMSGMETPPRPAQTISMDYLENPRTPLATGSNKDVEMENVQQGLIMPPDAPTTHDIGGMMKIVPSELDTDADYWLLSDTGVSITDMWKTAPDVEWEGIDINAEDFLEVGTPRQQEQPPSEMVDHPSCIS

SEQ ID NO: 5989 - protein, 602 aa, Ustilago maydis
MKSSTKCGTGCGGCMPLSTSILNKALKEAGVEVSNHLCGHFAYSRQDLYQIIKFKKLKDFTTVMSTVGKKADSLGCEVCRPAIGSILSSLYNDWIMAPQLRQTQDTNDRYLANMQRDGTYSVVPRLAAGEITPAGLKVIGEVAEEYGLYTKITGGQRIDMFGAKKQDLPAIWTKLVDAGFESGHAYGKALRTVKSCVGSTWCRYGVGDSVGLAHELETRYKGIRAPHKFKGGISGCVRECAEAQGKDFGLIATTKGWNVYVGGNGGAKPRHAELIAEDVTRRQAIKILDRFILFYIRSADKLERTARWIEKFPGGLKGLKEVIVDDKLGICEDLEKEMEVLVGTYHCEWTKVVRDPTRHKAFRQFVNTDETQPVSEMMSERDQQRPADWPVETGPLHFSILDVAKEAVWEWRSVCKYTDLDPQKDSPSSATIKYGDTQIAVWNIPGRGVRAAQNMCPPRRAFVLADGLVGEDDKGREYVSCPLHKRNYILSANADEEGGKCNDGDYSIMTFEAKMDEEKDLVYLKLPPTEALDAVLSTSKWMLRRATEESDAMAGGQSHSVEITGPLDMDTLEKGPSSPNKPGSPPAKKTKASCGEQSSLDW

SEQ ID NO: 5990 - protein, 257 aa, Silicibacter pomeroyi
MTPAGHVHLIGAGPGDPDLLTLRALRLLQEAQVVVYDRLVDPRIVAMAPEGARMIPVGKSPKCHPVPQDRINRILLDEARAGHVVARLKGGDPMIFGRGSEEAAFLMAHGVRVDYAPGITAAQGASSATGVPLTHRGLATGVQYVTGHRQAGQVLDLDWKRLADPDTTLVVYMGVANIGQIAIGLMTENLPATTPVLAISRATTPGERRLLSRLDRIAADARAEALEAPTLFIIGKVVSLYAQQPVTDLLEQAVAHG

SEQ ID NO: 5991 - protein, 712 aa, Bacillus cereus
MSQEKQVFSIDLAGRQLTVETGQLAKQANGAVLVRYGDTAVLSTATASKEAKNVDFFPLTVNYEERLYAVGKIPGGFIKREGRPSEKAILASRLIDRPIRPLFADGFRNEVQVVSIVMSVDQDCSSEMAAMLGSSLALSISDIPFEGPIAGATVGRINGEFVINPTVEQQEQSDIHLVVAGTKDAINMVEAGADQVPEETMLEAIMFGHDEIKRLIAFQEEIVQAVGKEKSEVKLYEVDADLNQAVREMAEKDMHSAIQVHEKHAREDAINEVKKRVIEHYEAQEADADTLGQVNEILYKIVKEEVRRLITVEKIRPDGRKGDEIRPLASEVGILSRTHGSGLFTRGQTQALSICTLGALGDVQILDGLGVEESKRFMHHYNFPSFSVGETRPMRGPGRREIGHGALGERALEPVIPSEKDFPYTVRLVSEVLESNGSTSQASICGSTLAMMDAGVPLKAPVAGIAMGLVKTGEHYTILSDIQGMEDHLGDMDFKVAGTAHGVTALQMDIKIDGLSREILEEALQQAKVGRVHILNHMLSVIAEPRTELSAYAPKIITMTINPDKIRDVIGPSGKQINKIIEETGVKIDIEQDGTVFISSINQEMNDKAKKIIEDIVREVQVGEIYEGKVKRVEKFGAFVELFSGKDGLVHISELALERVGKVEDVVKIGDVITVKVIEIDKQGRVNLSRKVLLKEEQEKEAAKEENKQEQQ

SEQ ID NO: 5992 - protein, 57 aa, Passiflora pittieri
WEYQVGPSVGIEAGDHIWCSRYILERITEQAGVVLTLDPKPIEGDWNGAGCHTNYST

SEQ ID NO: 5993 - protein, 238 aa, Bacillus megaterium
MGKVYLVGAGPGDPDLITLKGLKAIQQADVILYDRLVNKDLLEYAKSDADIIYCGKLPNYHTLKQETINNFLVKFAKKGKIVTRLKGGDPFVFGRGGEEAEALVQQGISFEIVPGITSGIAAAAYAGIPVTHREYSASFAFVAGHRKDSKHDAIKWDSLAKGVDTLAIYMGVRNLPYICQQLMKHGKTSATPIALIHWGTCADQRTVTGTLGTIVDIVKEEQIENPSMIIVGEVVNFS

SEQ ID NO: 5994 - protein, 231 aa, Methanobacterium ivanovii
MVVYLVGAGPGDPELITLKAVNVLKKADVVLYDKPANEEILKYAEGAKLIYVGKQAGHHYKSQNEINTLLVEEAKENDLVVRLKGGDPFVFGRGGEEILALVEEGIDFELVPGVTSAIGVPTTIGLPVTHRGVATSFTVVTGHEDPTKCKKQVGWDFKADTIVILMGIGNLAENTAEIMKHKDPETPVCVIENGTMEGQRIITGTLENIAGKDIKPPALVVLEMLSMFLKK

SEQ ID NO: 5995 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 5996 - protein, 228 aa, Plantago major
VQLYELLMGVEEIVGDDNHHTPLLSSSSTSAPYAHTLEQQPHKKGTIWTALAHIITAVIGSGVLSLAWSMSRLGWVAGPLTMLTFAAVSLTSAILLCNCYKSSDLNNGLRNNGSYLDAIQNILGKKSAWAGGIIVRLYFIKLGIVYTITSGISIRAIHRSNCYHFEGHTASCNYGTTFYMLIFGIVQVVASQIPDFTNTKWLSVIAAIMSFMYSGIGSVLGVAKVIEN

SEQ ID NO: 5997 - protein, 176 aa, Triticum aestivum
  misc_feature (83)..(83): Xaa can be any naturally occurring amino acid
  misc_feature (89)..(89): Xaa can be any naturally occurring amino acid
  misc_feature (104)..(104): Xaa can be any naturally occurring amino acid
  misc_feature (117)..(117): Xaa can be any naturally occurring amino acid
  misc_feature (120)..(120): Xaa can be any naturally occurring amino acid
  misc_feature (124)..(124): Xaa can be any naturally occurring amino acid
  misc_feature (128)..(129): Xaa can be any naturally occurring amino acid
  misc_feature (132)..(132): Xaa can be any naturally occurring amino acid
  misc_feature (138)..(138): Xaa can be any naturally occurring amino acid
MDPCPFVRVLVGNLALRMPVAPPAAGAGAGVHPSTSPCYIKIRLGKMACQTAAAPLVLSDAAAAAAEQPPSGALGAGFHLSKXDLEWFXRQALALLPLPAGGGXLKGVRLMPGRKGXTCXVKSXGGVXXERXPSRLDXKGRRNPAVLRAGFSRERLWKRGGGPGGRNPNRGGEPVV

SEQ ID NO: 5998 - protein, 851 aa, Ipomoea batatas
MNAISNLLRIKDVSFSISFLLNFSYYPNLCILRFRHSVKLKAFLSDPEAPSSVIGRRQLPGALFFSGVACDQDSRVISLAISAVPLFGSLPPEIGLLDRLLNLTLTSVNLSGALPSEMAKLTSIKAINMSNNLLSGHFPGEILVGMTELQVLDVYNNNFSGRLPHEVVKLKKLKILNLGGNYFTGEIPEIYSNISSLQTLNLQTNSLTGNIPASLAQLQNLRELRLGYLNTFERGIPPELGSITTLQMLDLRECNLSGEIPKSLGNLKQLYFLYLYGNSLTGHIPAELSGLESLVHLDLSENNMMGEIPQSLAELKSLVLINLFRNTFQGTIPAFIGDLPKLEVLQLWNNNFTSELPVNLGRNRRLRFLDVSSNQISGRVPENLCMGGKLEALILMENKFSGPFPQVLGECKSLNGVRVEKNYLNGAIPPGFLQFAVGLIYVCLQNNYFSSELPTKMLAKNLTDLDLHNNRINGQIPPAFGNLENLWKLSLHSNRFSGKIPNQISHLKKMVTMDLSSNSLTGEVPASIAQCTQLNSFDLSANNLTGKIPKEISSLERLNVLNLSRNLLTGSVPSELGLMNSLTVLDHSFNDFSGPIPTNGQLGVFDNRSFYGNPKLFYSPPSSSPVNHNNHSWTTKRILIITVLILGTAAAFLSAVIWVRCIIVARREKIMKSNNAWKLTTFKKLEYKVEDVVECLKEENIIGQGGAGTVYKGSMPDGVIIAIKRLDRRGTGRRDLGFSAEIKTLGRIRHRHIIRLLGYASNRDTNLLLYEYMPNGSLSGILHGTNGANLLWEMRFRIAVEAAKGLCYLHHDCSPPIIHRDVKSNNILLTSDYIACIADFGLAKSFNNVGV

SEQ ID NO: 5999 - protein, 568 aa, Desulfotalea psychrophila
MAQRVLIIGAVALGPKVACRLRRIDPDAEITVLDRDKLISYGGCGIPYYVGGDVSDIEGLRSTQSHTIRDSKFFGEVKGIDVRTQIEAIEILRKEKQVRIRDLRDNSEELLSYDKLVFATGASPIRPPFPGADLPNVSIVSNLHHAEAIKKRLAQGKIGKAVVIGAGAIGIEMAEALTDLWGVETTIIEMADQVLPQAIGGNLATVVQRHLEESNVEVLVSERVSGITKADDSDTLTVSITDRTIDCDIVILSTGIRPNTELAKAAGLAVGQFGGLLVDRRMRTSDPHIYAGGDCVEVRNLVSGANQMMPLGSLANRQGRIIATNINGGSAHFPGTVGTFCIKVFELGVATAGLTARQAKAAGFDPVVSIVTQADRAHFYPTYQAMYIALIADRNSRKVLGIEAVGKGGDAVKARVDAVASLLHLGVDVAEISNLEAGYAPPFASAMDIVNNAGNVLDNILNGFNKTVDPDEFLKELAETDIRVIDVRGAIQAKPYQEKFGERWLHFPQDDLRTRYTEIPTDEAFFVVCDTGTRSYEGQVVLAAKGITNTRNIQGGLALVKAIAPEFI

SEQ ID NO: 6000 - protein, 487 aa, Legionella pneumophila
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLVITYINLAKVDTFGEIEFWLALIKIISLLAFVFLAILIFFGLIHGSEPPGIIGFKYLLDDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 6001 - protein, 450 aa, Arabidopsis thaliana
MEKQSIRNTCSSSLMLSSPSSFWVRGACIGRGCFGAVSTAISKTNGEVFAVKSVDLATSLPTQSESLENEISVFRSLKPHPYIVKFLGDGVSKEGTTTFRNLYLEYLPNGDVASHRAGGKIEDETLLQRYTACLVSALRHVHSQGFVHCDVKARNILVSQSSMVKLADFGSAFRIHTPRALITPRGSPLWMAPEVIRREYQGPESDVWSLGCTIIEMFTGKPAWEDHGIDSLSRISFSDELPVFPSKLSEIGRDFLEKCLKRDPNQRWSCDQLLQHPFLSQCHNSSPTESSPRCVLDWVNSGFDLEEEEEEVGRSEFEDAAKAIICNLATTGGVIWESDGWVEVRCHASEEEGTTMEYSGSTRVESEYNTSSDPNDDVAGDSAIIDVSMSQNLPPGNGGSAAALPYEFVVVLHLLMEIMVYTTCIFREIVLTMYLLYQYNQSNKLETLSF

SEQ ID NO: 6002 - protein, 101 aa, Arabidopsis thaliana
  misc_feature (83)..(83): Xaa can be any naturally occurring amino acid
MASSMLSSATMVASPAQATMVAPFNGLKSSGGFPGTRKGNNDITFITSNGGRGNWMPGWASIGKEKVETFFYLSDLTDFQLAXGGDFLIRNQGVPWGGIQV

SEQ ID NO: 6003 - protein, 445 aa, Agrobacterium tumefaciens
MRKDWGDGPGGLGTAMQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 6004 - protein, 143 aa, Desulfotalea psychrophila
MHCHKEIVNMSSFLKTFLNVRSLNAATRDLSIEQLESTLQKLGKIVEDRKEVVLAGEKLLEAKLAKMKEFKDLMEEDGIDPFEFAELCSTGNVKQKNSPLPPKYEYMDGAELKTWSGYGRTPEVIKNAIKNEGKSKESFLIER

SEQ ID NO: 6005 - protein, 322 aa, Fusobacterium nucleatum
MEKKLAILTSGGDAPGMNAAIRATAKIAEYYGFEVYGIRRGYLGMLNDEIFPMTGRFVSGIIDKGGTVLLTARSEEFKEARFREIAANNLKKKGINYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVLDIEEKLKGHINSEIRSVVLGHIQRGGTPSGFDRVLASRMAAKAVEVLNKGEAGVMVGIEKNEMVTHPLEEACSVDKRKSIEKDYELALLLSK

SEQ ID NO: 6006 - protein, 178 aa, Brassica napus
MENMGTRVIEPLIVGRVVGDVLDNFTPTIKMNVSYNKKQVSNGHEFLPLAVSSKPRVEIHDGDLRSFFTLVMTDPDVPNPSDPFLKERLPWLVMNIPGTTDAAFGKEVVSYELPKPNIGIHRYVFVLFRQKQRRVKFPSNIISRDQFNTREFAIENDLGLPVAAVFFNAQRETASRRR

SEQ ID NO: 6007 - protein, 571 aa, Solibacter usitatus
MAVDQNNEQVDQTVPESYEHLLEDYSHFAPPSADEVVQGTVLGITVKDVIIDFGYKSEGIVPIEQFQSPSGEVTVKRGDVVDVMIDRSEQVEGYVLLSHTKAARLRIWDNLEHAANEQLVLSGRVLGRVKGGLAVDVGIKAFMPGSQADPRPVHNLDALVGQDIPVKIIKLNRRRGNVVVSRKMAIEEEINSRKTVTLDHLFEGAAVTGTVKNLTDYGAFIDLGGIDGLLHVTDMSYGRITHPSEMLQVGQEITVKVLKFDRTKERVSLGIKQLEPDPWDTVIERYPVNGRVIGRVVNVTDYGAFVELEPGVEGLIHISEMTWSRRMKHPSKVVKAGDQVEAVVLEVHPKDRRISLGLKQLEPNPWTTIDQRYSVGSVVEGRVRNMTDFGAFIEIEEGIDGLVHVSDLSWTKRVKHPSEVLKKGMIVQAVILNIDSSSHRLSLGIKQLQPDAWESYFQTHQVGDTVHGRVCRIASFGPFVELAEGVEGLCHFSEIPGYSNRRGAEEMPVHIGDEYDFKIIKMSEAEKKIGLSLRAVTEDEEKTRLEDYQRQAAAATTTIEEVMSLKDRNQE

SEQ ID NO: 6008 - protein, 178 aa, Brassica napus
MENMGTRVIEPLIVGRVVGDVLDNFAPTIKMNVSYNKKQVSNGHELFPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 6009 - protein, 458 aa, Aspergillus oryzae
MSNLPIEPEFEQAYKELASTLENSTLFQKNPEYRKALAVVSVPERVIQFRVVWEDDNHQVQVNRGFRVQFNSALGPYKGGLRFHPSVNLSILKFLGFEQIFKNALTGLNMGGGKGGSDFDPKGKSDNEIRRFCVAFMTELCKHIGADTDVPAGDIGVTGREVGFLFGQYRKIRNQWEGVLTGKGGSWGGSLIRPEATGYGVVYYVEHMIKHATDGKESFAGKRVAISGSGNVAQYAALKVIELGGSVVSLSDSKGALIVNGEGSFTPEEINTIAQIKVDRKQISEIASTEAFASKFKYIPGARPWTHVGKVDIALPSATQNEVSGEEAQALIDAGCKFIAEGSNMGSTQDAIDIFEAHREANKGASAIWYAPGKAANAGGVAVSGLEMAQNSARINWTSEEVDARLKGIMEDCFKNGLETAIEYATPAEGVLPSLVTGSNIAGFTKVAAAMKDQGDWW

SEQ ID NO: 6010 - protein, 268 aa, Arabidopsis thaliana
MYVITGYIGIEYSSPTLASAINNITPALTFILAIIFRMEKVSFKERSSLAKLMGTILSLIGALVVIFYHGPRVFLASSPPYVNFRQFSPPLSSSNSDWLIGGALLTMQGIFVSVSFILQAHIMSVYPAAFRVSFLYTVCVSIVTSTIGLVVEKNNPSVWIIHFDITLITIVTMAIVTSVYYVIHSWTVRHKGPLYLAIFKPLSILIAVVMGAIFLNDSLYLGCLIGGILITLGFYAVMWGKANEEKDQLSFSEKEKTPLLLNRKNDQV

SEQ ID NO: 6011 - protein, 333 aa, Aspergillus oryzae
MSSTQSRYAKAHESLGGPGDARPTALQIVQDENRVNDLTDKVIMITGCSSGLGIETAKALFHTGATLYLTARDLGKAKTALGDLVDSPRVHLLHLDLNSLASVRACAEEFKSKESTLNILIEDAGVMACPEGRTADGFETQFGTNHLAHFLLFYLLKPQFLSSSTFSFQSRLVVVASSAHRVSSVHFDNITLEGEYEPWKAYGQSKTANIWTANEIERRYGSQGLHAFSLHPGAIATELLRHVSDEQKSVWDADDWLKKYWKSPEQGAATSVWGAVARDLEGTGGKYLDNCQIASPADPTKRHGPGYATWAYNPDGEAKLWAKTLELLELKDE

SEQ ID NO: 6012 - protein, 270 aa, Oryza sativa
MAMAKELQETSSSSSSSAASTSSCSSAVTDAWSSPARPNAVAGGKRKKEVVGEADEAAGGGAGEEEEEEAEAAAAGKSSAATKKRKRSSDGSTRCTAAAMRAWGKWVSEIREPRKKSRIWLGTFATAEMAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 6013 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 6014 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDCEKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 6015 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASCRR

SEQ ID NO: 6016 - protein, 161 aa, Nostoc punctiforme
MSNTISDIAVKTINGEDKQLKDYTGKVLLIVNVASYCGYTSQYEGLEKLNQKYREQGLRILGFPCNDFGAQEPGSNEEIVQFCTSKYSVTFELFDKIHAKGPQQHPLYERLTKAVEPTGTIAWNFEKFLVNKKGEVTARFNSSVQPNSPELIAIIEKELAK

SEQ ID NO: 6017 - protein, 404 aa, Brassica oleracea
MPGIRGPSDYSQEPSRDPSLKINAKASPPPFFFDFEPFNAEPPRSALVSSYVTPVHLFYKRNHGPIPIIDHIDNYSVSVTGLIDNPTKLFIKDIMSLPKYNVTATLQCAGNRRTAMSKVRNVRGVGWDVSAIGNAVWGGAKLADVLELLGIPKLTSSTGLGGRHVEFVSVDRCKEENGGPYKASIPLNQATNPEADVLLAYEMNGEILNRDHGYPLRLVVPGVIGARSVKWLDSINLLAEECQGFFMQKDYKMFPPSVNWDNIDWSSRRPQMDFPVQSAICSLEDVQMVKPGKVSIKGYAVSGGGRGIERVDISMDGGKSWVEASRTQKPGKDYISEHNSSDKWAWVLFEATIDVSQSTTEVIAKAVDSAANVQPENVESVWNLRGVLNTSWHRVLLRLGHSNL

SEQ ID NO: 6018 - protein, 177 aa, Brassica oleracea
ENMGTRVIEPLIVGRVVGDVLDNFTPTIKMNVSYNKKQVSNGHELFPLAVSSKPRVETHDGDLRSFFTQVMTDPDVPNPSDPFLKERLHRLVMNIPGTTDATLGKEVVSYELPKPNIGIHRYVFVLFRQKQRRVKFPSNIISRDQFNTREFAIENDLGLPVAAVFFNAQRETASRRR

SEQ ID NO: 6019 - protein, 773 aa, Alkaliphilus metalliredigenes
MDDMKKEEVNTNYKNVLEDLMDIILIVDKNGKIVYGNKRAVETYGYTYEELVNLSVFDLRNQDIEEPVQEQLKQALLRGIEFKTYHYKKNGTKFPVEVRSRYSGEQSKGNVVSIIRDISHIDKIAKDAEMFSVSLDILDDAIVTFTKDLKVSLWSKAAEEKLGYTKEEIVGQNIKILVPNEKIKEFENEIFEVRKGNVVERLETIRLHKNGNAIDVSISVSPFYDPDGVLIGVLGVYKDISQRKELAKQLKRNEERWRYALEGGRFGIWDWDIENNKIFSADLWKEILGYNEGELNDTYEDWMSKVHPEDFPYVKDKLNKHSRGEKYIDEFRMKCKDNTYKYLRAKGQIIEWREDGNPLRMMGTLEDITDRKIIEEELKEKYKQLELLKEEAENANKAKSQFLANMSHEIRTPMNGIFGVVQLLESTDVGAEQNKYINMLKESTHTLAGIINDILDISKIESGTFKLNNEPFNLTEMISSIYHGLLVDGNAKGLEVGYYLDPNINPQVIGDELKLKQILTNLISNAVKYTEQGFVSFRVNRISFDEHTEKIQFNVKDSGIGIKDGFKEKIFEDFSQEDSSTRKKYQGTGLGLAISKNLALLMQGDISFESKLGEGSIFTFTCELQKSRTEDVNTKNHDIVKEKVEYSNQNSNKVILCVEDNIMNQEVMESIVTKKGYQYLAAYNAKEALDILENKKVHLILMDIQLPDLNGFEITKSIRMAKGPMKDVPIIAVTAYVDHKIENKCIQAGINDYMPKPLDLEKLYEMLESYLEG

SEQ ID NO: 6020 - protein, 607 aa, Ustilago maydis
MAILSVIIALMFSTLLLIGFPVNQPVGALLDSKMRSGTQSLTASNDSKADLEITEAVGNDQHPGMASMLRPGTNTGMVTSEEYMTEDEKKTKDLKDFGYHKFQWSSLWRPAVINPLNGKSHTFPIFRIWDAYSTAFWLSTLGFFVAFLSWFAFAPLVPEAVKVDLKLSSVQVTHSNMASLGGTAIVRLIAGPACDRYGPRKVMAALLILGAIPSGMAALVQNASGLYAVRFFISILGATFVCCQAWCSTFFDKSVVGTANAFSGGWGNMGGGVTIAAMIGLFERYRHAGLSAHMAWRVCFPTLPVPALMFVAGLILLFGKDHPAGKWSQRHQFSGTAIAIAQGEKIELDSAERAEYERRTADNEKGPAKAAHFREQDPADAGKHVAAVDTAQSEPITLKRLMVILADPRVWMCIVCYLLTFGLETAMDAALPGLITTLFQSKTFTAIDAAYAASMYGLLNLYARPLGGVVSDVLFSKYGLRGRVFWLLVTSFSQGIAMIGLGFYCNRSPTLSGVLWFIFLIGTTGFLANGANYGIPAIICPSAIGTVSGLVGAGGNLGGLLYLGIFLAVPGARPKKTLGTKFWIAGVVNAGAVLPFFAVLLPGKYGV

SEQ ID NO: 6021 - protein, 1145 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 6022 - protein, 174 aa, Borrelia hermsii
MDEEISTLFTEEKIKSKIKELAQKIRNYYKDKSNVVFISLLKGSFMFFADITREIGLNVKIDFLQVSSYKNKTHSSLNVLIKKDIDIDIKDSYVIIFDDIIDTGLTYDKIITYLKTKNPKEIKICTLFNKPSRRLIELKIDYAGFEIENDFIVGYGIDFNEKHRTLKDVAKINK

SEQ ID NO: 6023 - protein, 414 aa, Thiobacillus denitrificans
MFNRQDTLAKTDPDLWAAIQQEDRRQQDHIELIASENYTSPAVMQAQGSQLTNKYAEGYPGKRYYGGCEYVDIVEQLAIDRVKALFGAEAANVQPNSGSQANQAVFMAFLKPGDTIMGMSLAEGGHLTHGMALNMSGKWFNVVAYGLNEKEEIDYEAMERLAREHKPKLIIAGASAYALRIDFERFAKIAKEIGAIFMVDMAHYAGLIAAGLYPNPVPHADVVTSTTHKTLRGPRGGIILMKAEHEKAINSAIFPGLQGGPLMHVIAGKATAFKEAATKDFKRYQEQVIDNALVMCKVLVERGLRIISGRTESHVFLVDLRAKNLTGKEAEALLGRAHITVNKNAIPNDPQKPFVTSGIRIGTPAMTTRGFTELEAEQLAHLIADVLDAPNDEAVVERVKGEVAKLTAKFPVYG

SEQ ID NO: 6024 - protein, 58 aa, Passiflora punctata
WEYQVGPSVGIEAGDHIWCSRYILERITEQVGVVLTLDPKPIEGDWNGAGCHTNYSTK

SEQ ID NO: 6025 - protein, 74 aa, Passiflora quadrangularis
TNGEVMPGQWEYQVGPSVGIDAGDHIWCSRYILERITEQAGVVLSLDPKPIEGDWNGAGCHTNYSTKSMREDGG

SEQ ID NO: 6026 - protein, 75 aa, Passiflora quadrangularis
GTNGEVMPGQWEYQVGPSVGIDAGDHIWCSRYILERITEQAGVVLSLDPKPIEGDWNGAGCHTNYSTKSMRDDGG

SEQ ID NO: 6027 - protein, 408 aa, Arabidopsis thaliana
MGIHFVDKADLWKSALLFNLKLRDRFRIAVDDHRGRATDLTAEEESALFRMLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 6028 - protein, 107 aa, Oryza sativa
MTEKKNRREKKIPREAKITFEGLVMEALPNGMFRVRLENDTIILGYISGKIRSSSIRILMGDRVKIEVSRYDSSKGRIIYRLPHKDSKRTEDSKDTEDLKDTKDSKG

SEQ ID NO: 6029 - protein, 615 aa, Medicago truncatula
MMMFEDMGFCGDLDVFCGTLGEGDISSVRQTEPDSVVEDDYSDEEMDVDELERRMWRDKMRLKRLKEQTKAKEGIDAAKARQSQEQARRKKMSRAQDGILKYMLKMMEVCKAQGFVYGIIPEKGKPVTGASDNLREWWKDKVRFDRNGPAAISKYQADNAIPGKNDGCNSIGPTPHTLQELQDTTLGSLLSALMQHCDPPQRRFPLEKGNPPPWWPAGTEDWWPQIGLPKDQGPPPYKKPHDLKKAWKVGVLTAVIKHMSPDIAKIRKLVRQSKCLQDKMTAKESATWLAIINQEESLARELFPDYCPPLSSGGGTGSMVINDCSEYDVDGADGESNFDVEDRKPENLHPSNLGMDRMRGSFPVQQPSHQIKGEVVTNLDFIRKRKISNDFNMMMEPKMYTCEHPQCAYSEARLAFQDRPSRDNHQLNCPHRNRNNPAVYGDPNFHATEVKPVIFPQSFVQPNSTVQPASLVPPSFDLTGFGVSEDGQKMISDLMSGYDTHVIGNNNASSTNCVVIENQNLSQPIIQQQQQDNFFLNQGMVMEANFFTREENQFDRFKAMNSPFEANLNNNNNMHPMYGSSCDLASFDFKEDLQLQGGVGMDALYKQPDVSIWNY

SEQ ID NO: 6030 - protein, 458 aa, Listeria innocua
MAQTSTIQNDTKAAEEYAARVFETIKQRNPGETEFHQAVEEFLNSVIPALAKEPKYEAHGILEQLTEPERLISFRVPWVDDAGTVQVNRGYRVQFNSAIGPYKGGLRFHPSVTGSIVKFLGFEQIFKNSLTGLPIGGGKGGSDFNPKGKSDAEVMRFCQSFMTELQKHIGPDTDVPAGDIGVGGREIGYLFGQYKRLRGAYDAGTLTGKGLSYGGSLARTEATGYGLVYFTVEMLEAAGESIRGKKIVVSGSGNVAIYAIEKAHELGAKVVACSDSAGFVYDKEGIKVETVKQLKEVERKRISEYVTLHPSAEYYAGGDVWSVPCDIALPCATQNEINADQARALVKNGVIAVAEGANMPSTLEAVDIYHENKVLFGPAKAANAGGVAVSALEMAQNSTRMSWTFQTVDEHLQNIMKDIYKNSSNAASEYGAPGNLVVGSNIAGFLKVADTMIAHGII

SEQ ID NO: 6031 - protein, 246 aa, Solanum tuberosum
MATVSSASAALRAISSSSYKLPSAFQITSLSQKIQSLKLPNPLISQTHKLTTTSTTASRSFSCKSQNSSTDSTNTEVQELSVYELNERDRGSPAYLRLSQKNVNSLGDLVPFSNKLYTADLKKRIGITAGLCILIKHEEEKKGDRYEAVYSFYFGDYGQIAVQGSYLTYEDSYLAVTGGSGIFAGVSGQVKLQQLIFPFKLFYTFYLKGIPDLPSELLCTAVPPSPTVEPTPEAKACEDGAALKNY

SEQ ID NO: 6032 - protein, 106 aa, Brassica napus
  misc_feature (60)..(60): Xaa can be any naturally occurring amino acid
MVPLGSMSMRPRPTGGFPMPMMTPPPMPMMTQPPMVMVPPPMLMTPPPMPMVPMPMTPFXSPMSQPTTMAPSPEPALDMASPPMMPELDFFLFPGPMPPAMAFPDS

SEQ ID NO: 6033 - protein, 242 aa, Prochlorococcus marinus
MFKFLKKIMNKNETISENKNNFLHRILNTNIREEPNSQEDSIIFGCGCFWGAEKCFWKLPGIVTTSVGYAGGEKKNPTYYEVCSGITGHAEVVKVVWNINELDISDLLKMFWECHDPTQKNRQGNDMGTQYRSTIYYTNKNSKDIINLSKEAYQKELTANNFGEIETEIKMIDTYYYAEEYHQQYLAVEGSRQYCSASPTKVKLGNFNGSNYRLPKEIWDNFNWDIDKCVLRSNNKPIEINK

SEQ ID NO: 6034 - protein, 554 aa, Clostridium perfringens
MNKKWWKELIAYQIYPKSFMDSNGDGIGDIQGIISKLDYLKDLGIDLIWLCPMYKSPNHDNGYDISDYKDILDEFGTMDDFNELLSEVHNRGMKLIIDLVINHTSHEHPWFIESRASRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYDIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYDDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 6035 - protein, 422 aa, Nitrosomonas europaea [sequence omitted]

SEQ ID NO: 6036 - protein, 661 aa, Unknown
  Piromyces sp. E2
TQDYARHLELSILFYEAQRSGKLPENNGIFWRHDSMVDAGKDNNVDLTGGYDAGDNVKFNFPQASALTILAYGAYKWKDGYKQAGQWEYMKDLLKWGMDYFLKCHTDKYVLYGQVGNGSLDHGAWVPPEDITYKYPSYKITASAPGSDLAAETSASMVAASMALREDDPTYADTLLKHGRELYDFAEKYRGTYDLSIDDAKGYYRSYSGFNDELVWGAAMLYAATGEEQYKAKVDKIWDTPYGDLDPDKFLGSTGPISWDDKKAAAYALMAITTGESKYVEESTRHSDLMVNYQTTPGGLWYDTNLSMWASNRYAANAAFTVAMLATTMDENDSKRKQYVKFIKKQIDYILGDNPAKVDYVVGADPSSPKAVHHRGASGSKGADKGPDENVFILYGALAGGPGQKDNYKDARNNYEMNEVALDYNAAFQGLLAFLITEGLNVPDPKQTWDGAWPPREPKPEVKWEWKLTADEDSYMAGEPQISTGDGLKCANWCFDLTFDSNVSVQNMWGGKTVEIKGSTYTVCSEYDNGYLDGKGTPQHWNFNFKKPNGGKGVDILPKTAIVYCNGKKNGRAYLVNTDGSGAQPYGWEAGACRPAFLCDGSQATAPVVTTTKKKITTTTTKKSDPTSSTSCFSVKKNLGYKCCQYCEISFTDGDGDWGVE

SEQ ID NO: 6037 - protein, 236 aa, Oryza sativa
MTRRYWNINLKEMIEAGVHFGHGIKKWNPKMAPYISAKRKGTHITNLARTTRFLSEACDLVFDAASQGKSFLIVGTKKRAADLVASAAIRARCHYVNKKWFSGMLTNWSITKTRLSQFRDLRTEEKMEKFHHLPKRDVAILKRKLSTLQRYLGGIKYMTRLPDIVIVLDQQKEYIALRECAILGIPTISLADTNCDPDLANISIPANDDTMTSIRLILNKLVFAICEGRSLYIRNH

SEQ ID NO: 6038 - protein, 239 aa, Triticum aestivum
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVYGQVKLNQIVFPFKIFYTFYLKGIPDLPKELLCTAPVPPSPTVEPTPAAKATEPHACLNNFTD

SEQ ID NO: 6039 - protein, 993 aa, Xylella fastidiosa
MFSASHFCSGSLMMSHPLSSLRDLEYHGAFVERHIGPNDVEIAQMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQVDVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDALAIHCAAAAAGMNLRMIDNAQIGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLVECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKGDSEIQDLIEEDASRC

SEQ ID NO: 6040 - protein, 157 aa, Agrobacterium tumefaciens
MHFVPESRASEVFSSRPLPIWHNTCILVAERELPALTGEAERYFLMKKIEAIIKPFKLDEVKEALQEVGLQGITVTEAKGFGRQKGHTELYRGAEYVVDFLPKVKVEVVLADENAEAVIEAIRNAAQTGRIGDGKIFVSNIEEVIRIRTGETGVDAI

SEQ ID NO: 6041 - protein, 177 aa, Brassica oleracea
ENMGTRVIEPLIVGRVVGDVLDNFTPTIKMNVSYNKKQVSNGHELFPLAVSSKPRVEIHDGDLRSFFTLVMTDPDVPNPSDPFLKGRLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 6042 - protein, 197 aa, Unknown
  marine gamma proteobacterium HTCC2143
MADRKATVSRNTLETQITVSINLDGTGQSRFETGVPFLDHMMDQIARHGLIDLDIEAKGDLHIDAHHTVEDIGITLGQAFNEAVGDKKGIVRYGHSYVPLDEALSRVVIDFSGRPGLEWHVPFTRGSVGGFDVDLFIEFFHGFINHAKVSLHVDNLRGKNTHHQAETVFKAFGRALRMALSADERMAGVMPSTKGTL

SEQ ID NO: 6043 - protein, 335 aa, Eustoma grandiflorum
MKVQRVQEIASLSKVIDTIPAEYIRSENEQSVISTVHGVVLEVPVVDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSSINYQFWPKNPPAYREANEEYAKRLQLVVDNLFKYLSLGLDLEPNSFKDGAGGDDLVYLMKINYYPPCPRPDLALGVVAHTDMSAITVLVPNEVQGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLFKLPQ

SEQ ID NO: 6044 - protein, 571 aa, Desulfotalea psychrophila
MFCFQCQETAKGTGCTVKGVCGKQETTANLQDLLIYDLKGIAVLAKGLKNAGVKVDKSVGLFISQGLFTTITNANFDNASLEGWIKRSQAIKQGLKTELDGLGSASEQASIWKTLMNFLGSDDKALASDQLDGSALWFASDPAMFQEKAKTVGVLATENEDVRSLRELLILGLKGIGAYAEHAAVLGVEKEEIYDFVIEGMASTTEDHSVDEMVSLVLRAGECAVTTMAALDTANTTSYGHPEISEVNIGGSDKAAILISGHDLKDLEELMIQTQGTGIDVYTHGEMLPAHYYPTFKKYENLKGNYGSSWWHQNKDFESFNGPILMTTNCIVPIRESNSYKNRIYTTGMAGYPGVSHIADRVMGKAKDFSAIIKQAKGCSAPEEIETGTIVGGFAHNQVIALADKVVEAVKSGAIKRFVVMAGCDGRQKGRGYFTEVAEKLPKDTVILTAGCAKYRYNKLNLGDIGGIPRVLDAGQCNDSYSLAVIALKLKEVFQLEDINELPISFDIGWYEQKAVAVLLALLHLGVKGIRLGPSLPAFISPAVLKVLVDNFNIKPIGTAESDIADMMAGN

SEQ ID NO: 6045 - protein, 569 aa, Desulfotalea psychrophila
MSWGFSGNEIKGVSMFCHQCQETAKGTGCTVQGVCGKREEVANLQDLFIWTLKGISVWGLKGKEFAIYDEKVAFFIVKGMFATITNANFNGADFIGFIKEAVVHRQHLQAQVLQAHLLAHGTAFVEDLPECATWSFGDETDILAKASRGTGGWLEIVDEDERSLKATVLYGLKGLCAYAEHAYQLGGHSREIFEFLMEALAALVDSTQTLEELLALVLKTGGMGVQTMALLDQVNNESYGATEISTVSLGVGDKPGILVSGHDLKDLEELLVQTEGKGVDIYTHSEMLPAHYYPKLKKYDHLVGNYGNSWWLQKREFDSFHGPVLFTSNCIVPPKPEHVDRIFTTGAVGVVGCAHIPDRSGGEAKDFSQIIDLALSSQPPEQIETGTIVGGFGHNQVLALKDKIIDAVKSGAIKRFVVMGGCDGRHKSRNYYTEVARLLPKDTIILTAGCAKYKYLKLDLGDIGGIPRVLDAGQCNDSYSLAVIALELQKAFALENINDLPISYDIAWYEQKAVLVLLALLSLGIKGIRLGPTLPGFFSENIASILTEHFEIKAIGTPEEDVAAMMAGH

SEQ ID NO: 6046 - protein, 590 aa, Pseudomonas fluorescens
MCGLAGELRFDHQPADLAAVERITHHLAPRGPDAWGFHSQGPIALGHRRLKIMDLSDGSAQPMVDNQLGLSLAFNGAIYNFPELRAELEAKGYAFYSGGDTEVLLKGYHAWGADLLPKLNGMFAFAIWERDAQRLFIARDRLGVKPLYLSRTGQRLRFASALPALLKGGDINPLLDPVALNHYLNFHAVVPAPRTLLAGIEKLPPATWMRIEADGRTEQQTWWTLPYGPRADETNLTLEDWRDRVLDSTREAVAIRQRAAVDVGVLLSGGVDSSLLVGLLREVGVDNLSTFSIGFEDAGGERGDEFQYSDLIARHYGTRHHQLRIDEREIIEQLPAAFRAMSEPMVSHDCIAFYLLSREVAKHCKVVQSGQGADELFAGYHWYPQVDGASDPYAAYRAAFFDRSYDDYAATVQPQWLTANDAAGDFVREHFAQPGADAAVDKALRLDSTVMLVDDPVKRVDNMTMAWGLEARTPFLDYRLVELSARVPARFKLPDGGKQVLKEAARLVIPSEVIDRKKGYFPVPGLKHLQGATLDWVRELLLDPSQDRGLFKPAMLDRLLTDPQGQLTPLRGSKLWQLAALNLWLSEQGI

SEQ ID NO: 6047 - protein, 366 aa, Desulfotalea psychrophila
MSDPIFAKRLRACPLIGAGVICFFATIFCLAESNAAESIMKNREDLSITTLAGGCFWCLEADLEKLPGIVDVVSGYSGGDQKNPSYEEVSTGRTGHLEAVQIRFDPEVISYEEILQRFFRLHDPTDAGGSFVDRGRQYSSAIFYHDEVQKEIAERVRDELAPTFSRPIVTELISFRAFYPAEDYHQNYSLKSPQAYARYRSLSGRDSFIEAIWGSAGEMNYEKMSDDQLRKRLTALQYEVVREDGTEPPYDNAYWDNKRAGIYVDIVSGEPLFSSRDKYKSGTGWPSFIRPLVAENVVELKDNSFFLRRTELRSLHADSHLGHLFTDGPAPTGLRYCINSASLRFIPREVMQAEGYGEYLSSFLHN

SEQ ID NO: 6048 - protein, 968 aa, Buchnera aphidicola
MKRMLINATQQEELRVALVDGQRLYDLDIESSRSEQKKSNIYKGKITRIEPSLEAVFIDYGMEKHGFLPLKEISKNYFPENYNCDVRLNIKDILREGQELIVQINKEERGTKGAALTTFITLAGSYLVLMPNNPKIAGISRRVEGSDRIELKELLSSLKIPEKMGLIIRTAGVGKSIKSLQWDLSLRLKHWNAIKKASKKKSAPFLIYQESNVIVRAFRDYLRQDIGEILIDNPKILDIAREHITALGRPDFINKIKLYTGEIPLFSYYQIESQIDSAFQRKVRLPSGGSIMVDTTEALTAIDINSSRSTRGADIETTAFNTNLEAVEEISRQLRLRDLGGLIVIDFIDMTTISHQKIIENKLREIVREDRARIQIGHISKFGLLEMSRQRLSSSLGESSHHICPRCTGTGTIRDNESLSLSILRLIEEEALKENTYEVHAIVPIEIACYLLNEKREAVYAIEKRQAGGKTIIVPNKNMKTPHYLVSRIRKGEQIRSMSYCLSNVRKNKIFNNIKKEIVDKKHKLNSTLTNISLSDDSFDKQKEEKEKFLRKKNYNNSIINALFNNKNLFFKFIVWIKNSFLKKHIFVKNESFKRNIFQNKKNILFAKKEEFNSIEEIHKKDNQVSSIDNNKKKQLLNKVKKNNNHQYSHVFDNNTKYTSLKKIDFQKNTIDFELNSLNFLKKNNFYIFSKYNFLYTKKYAKNKFKDFENIKSQNDMICYESFQKDLENNTSFKKKLLYNIIFNNCYPNNILVNINSTIFQIYKNSEFFKFFPIKISILMTPLNIFSLELILEPSSKKCSSFKENQVKKRLRINNYKKLNSSFIHKKNNFVKNSVLWPKKFTTEEIKINHLYKKNKKNTKSYFFETSFKYKTVTKNISKLKVKLTSKKNDYLISNQKKLFLNKTLKKENTKNKSSAPITKIFSDVFLSKNQKIMNSSIFLKKSNKKIKNSAGAHSATNFSTSPVKKSE

SEQ ID NO: 6049 - protein, 194 aa, Triticum aestivum
MVSPDAIRTVIGVIAMEPPLVLFLSPVPTFISIWKKKTVEQYSAVPYLATLLNCMMWVLYGLPLVHPHSMLVITINGTGMLIELTYIALFLTFSVGAARRRVLLLLVAEVAFVAGVAALVLSLAHTHDRRSMVVGILCVLFGTGMYAAPLSVMKMVIQTKSVEYMPLFLSVASLVNGICWTAYALIKFDLYITI

SEQ ID NO: 6050 - protein, 226 aa, Arabidopsis thaliana
MSQCVDGIKHLCTSVLGCFDLDLYKQSGGLGDPELLARDTVFSVSEIEALYELFKKISSAVIDDGLINKEEFQLALFKTNKKESLFADRVFDLFDTKHNGILGFEEFARALSVFHPNAPIDDKIHFSFQLYDLKQQGFIERQEVKQMVVATLAESGMNLKDTVIEDIIDKTFEEADTKHDGKIDKEEWRSLVLRHPSLLKNVTLQYLKDITTTFPSFVFHSQVEDT

SEQ ID NO: 6051 - protein, 991 aa, Unknown
  Polaromonas sp. JS666
MLLTKKSHGIHGDPAHRAGSARFVQSLSRGLSGALPTMDRRAFLRRSGLGVGVGLAATQLTLVKKAKAATSAAGDGSGKIEVKRTVCTHCSVGCAIDAVVENGIWVRQEPVFDSPINLGAHCAKGAAVREHGHGEFRLRYPMKLVNGKYERITWDTALGEISAKMLELRKASGPDSVYWIGSSKHNNEQAYLMRKFVSFWGSNNCDHQARICHSTTVAGVANTWGYGAMTNSYNDMQNSKVALYIGSNAAEAHPVSLLHMLHAKETGCKMIVVDPRFTRTAAKADEYIRIRSGSDIPFLFGMLYHIFKNGWEDKKYINDRVYGMDKVKEDVMAKWTPDKVEEACGVPEARVYMAAEAMAKNRPSTIVWCMGQTQHTIGNAIVRASCILQLALGNVGTSGGGTNIFRGHDNVQGATDVGPNPDSLPGYYGLAEGSWKHFAKIWGVDFDWIKGRYASPAMMGKPGITVSRWIDGVMEKNELIDQDPNLRAVVFWGHAPNSQTRGLEMKRAMDKLDLLVVIDPYPSATAAMAAMPGKAEDLNPNRAVYLLPAATQFETSGSVTASNRSLQWREKVIEPLWESRTDHMIMHQFAEKLGFAKELSKNYKMQKVKGLDEPMPEDILREINKTCWTIGYTGQSPERLKAHMRNMHLFDVKTLKSKGGKDKETGYDTTGDYFGLPWPCYGTPELKHPGSPNLYDTSKHVMEGGGNFRANFGVEKDGVNLLAEDGSHSLGADITTGYPEFDHLLLKKLGWWDELSEAEKAAAEGKNWKTDSSGGIIRVTMKNHGCHVFGNAKARAVVWNFPDAIPQHREPLYGIRPDLVAKYPTHDDKKAFWRMPTLYKTIQQKNITDKVHEKFPLILTSGRLVEYEGGGEETRSNPWLAELQQEMFIEINPKIAADRGIRNGERVWVSTPTGARLNVQALVTERVGPDTVFMPYHFSGRWQGADMLAHYPSGAHPIVRGEAANTATTYGYDSVTMMQETKTTICNVERA

SEQ ID NO: 6052 - protein, 954 aa, Bordetella bronchiseptica
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMSCRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARINLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 6053 - protein, 181 aa, Arabidopsis thaliana
  misc_feature (10)..(10): Xaa can be any naturally occurring amino acid
  misc_feature (144)..(144): Xaa can be any naturally occurring amino acid
MAASMLSSFXFVTSPAQATMAGPFTDMKSFAFFPDTRKANNDITFITNNGGRINFLKAWPPFEKKTVGTLYYLPDLTDVELAKEVDYLLRNKRIPCVEFHLEHGFVYREHRNTTGYYDGRYWTMRKLTLIGCTDYAQVLKEVEXCKKDYPGALIMIIGINNTRHVQSITIIAYKRSSFTDA

SEQ ID NO: 6054 - protein, 270 aa, Prunus persica
ERPKVAYNNFSNEIPIISLAGIDEVEGRRADICKKIVEACEDWGIFQIVDHGVDTKLISEMTGLAREFFALPSEEKLRFDMSGGKKGGFIVSSHLQGEAVQDWREIVTYFSYPIRHRDYSRWPDKPEGWREVTQKYSDELMGLACKLLGVLSEAMGLDTEALTKACVDMDQKVVVNFYPKCPQPDLTLGLKRHTDPGTITLLLQDQVGGLQATRDDGKTWITVQPVEGAFVVNLGDHGHFLSNGRFKNADHQAVVNSNSSRLSIATFQNP

SEQ ID NO: 6055 - protein, 740 aa, Escherichia coli
MSLVARMRRRSGINTSTVRYCLRKRKDITLLNPIVRKFQYGQHTVTLETGMMARQATAAVMVSMDDTAVFVTVVGQKKAKPGQDFFPLTVNYQERTYAAGRIPGSFFRREGRPSEGETLIARLIDRPIRPLFPEGFVNEVQVIATVVSVNPQVNPDIVAMIGASAALSLSGIPFNGPIGAARVGYINDQYVLNPTQDELKESKLDLVVAGTEAAVLMVESEAELLSEDQMLGAVVFGHEQQQVVIQNINELVKEAGKPRWDWQPEPVNEALNARVAALAEARLSDAYRITDKQERYAQVDVIKSETIATLLAEDETLDENELGEILHAIEKNVVRSRVLAGEPRIDGREKDMIRGLDVRTGVLPRTHGSALFTRGETQALVTATLGTARDAQVLDELMGERTDTFLFHYNFPPYSVGETGMVGSPKRREIGHGRLAKRGVLAVMPDMDKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKINPDKIKDVIGKGGSVIRALTEETGTTIEIEDDGTVKIAATDGEKAKHAIRRIEEITAEIEVGRVYNGKVTRIVDFGAFVAIGGGKEGLVHISQIADKRVEKVTDYLQMGQEVPVKVLEVDRQGRIRLSIKEATEQSQPAAAPEAPAAEQGE

SEQ ID NO: 6056 - protein, 274 aa, Prunus persica
DEGPQVPTIDLKEIDSENENVRERCREELKKAAVDWGVMHLVNHGISDELMDRVRKAGKAFFDLPIEQKEKYANDQASGKIQGYGSKLANNASGQLEWEDYFFHLVYPEDKRDLSIWPQTPADYIEATAEYAKELRALATKVLRVLSLGLGLEEGRLEKEVGGLEELLLQMKINYYPLCPQPELALGVEAHTDVSALTFILHNMVPGLQLFYEGKWVTAKCVPNSIIMHIGDTIEILSNGKYKSILHRGMVNKEKVRISWAVFCEPPKEKIILK

SEQ ID NO: 6057 - protein, 281 aa, Oryza sativa
MGMEAECDRIKGPWSPEEDEALRRLVERARGEELDGDREGDPGEVERRPFTAEEDAAILRAHARLGNRWAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDPLTSLSLSLSLPGFHHDSARSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 6058 - protein, 85 aa, Glycine max
  misc_feature (14)..(14): Xaa can be any naturally occurring amino acid
  misc_feature (25)..(25): Xaa can be any naturally occurring amino acid
  misc_feature (66)..(66): Xaa can be any naturally occurring amino acid
  misc_feature (71)..(71): Xaa can be any naturally occurring amino acid
VGFEDPHVLLTVGXDGLSFVEGFPXGTYHTIIEDSSDPIGPAQELSEKLFIRPIQMLSHKKIVCNXTESIXSYMHIIEDIVSNCL

SEQ ID NO: 6059 - protein, 67 aa, Passiflora racemosa
GTNGEVMPGQWEYQVGPSVGIDAGDDIWCSRYILERITEQAGVILSLDPKPIEGDWNGAGCHTNYST

SEQ ID NO: 6060 - protein, 600 aa, Oryza sativa
MEIGAVENGGVVGGEVVAGKRGKTPQGWKCMPFIIATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRVGHSSWLTDNINLGKLDYYFYFIALMGVLNLIYFLICSHFYQYKVMSLHSEESIKIPTKEEEATEIDIDTDAPSK

SEQ ID NO: 6061 - protein, 58 aa, Passiflora reflexiflora
WEYQVGPSVGIDAGDHIWCSRYILERITEQAGVVLTLDPKPVEGDWNGAGCHTNYSTK

SEQ ID NO: 6062 - protein, 889 aa, Desulfovibrio vulgaris
MCGIAGIISRKDRNVSSQPLNRMLTSQEHRGPDAGYGVSFRRQSTGAFAAGRRHSADALAAGLEPAPVWLGHRRLSILDLSDKSAQPLRRGDLHIVFNGELFNYIELRSELTALGEHFETSGDTEVLLASYRHWGAGCLERFNGIFAFAIFDASRGSLFAARDPFGVKPFHYGVKPFHYAVTHDFLIFASEIKAISASGLVLRKWDPDVASAYLSYALTTAPQGRTFFENIRQIPPGHCLTLASPDDEPSVTRYYAPRITETPRSLHELVDEGAGLIRQSCRIRMRSDRDVGLCLSSGIDSANVAAALVAEGIAPECYSIDAASSSMLDEFPLITALADKLGLHVNPIRHPDAIPTADIVRYMLFNDEPSLFWGSYNQFHLYREMRKLGVIVSMSGHGGDELFCGYQRYYPAVVRDMLAQRRIMSLIWWCLRQSRHLMQDRRTIRSTWDSYSHPLGWANDYAHDIAALHLKHTIADPEEWISTFVGASSWGEQQQKSLFTYELQYLLRDADRNSMAHGIEERVPLLDTRLYEFCASVPLKDLCQDGYLKGLARQLFPAIPESLRFHQIKRGLYTDISSKLPQLQADLMPLVHRSPLLRELVDLQKLPQQLPGIVWWRLCSLAVLDVSGIEEWTAQTPLPRLVDDEMAERIGGVPSGTGRTAVIRHVLDEGLSYLEPGALHGLAETVGLIESAAIPGCIIEAGCALGGSTMVLATAKAKERPLHVFDVFGCIPPPGSNDGEEARARFAVIAAGESTGLNGKRYYGYEPDLLKNVQDNFVALGLPPAEHGITFVPGLYENTLYPSGPVALAHIDCDWYQSVKTCLERIAPHISPGGRMIIDDYDHYSGCRRAVDEFLEASNGQFIRERYARVHLVRTKADGQETDVHRPGD

SEQ ID NO: 6063 - protein, 194 aa, Listeria innocua
MRSASKTRITGETSIELSINLDSQADSTISTGVGFLDHMLTLFSKHSRITLNVKADGDTYVDAHHTVEDVGITLGLCLKEALSDKASINRYGSSYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 6064 - protein, 329 aa, Neisseria meningitidis
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWVEELVPQLNTSVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 6065 - protein, 401 aa, Medicago truncatula
MDEAGSSSSLPPFLAKTYEMVDDRSSDPIVSWSASNKSFVVWNPPEFARVLLPRFFKHNNFSSFIRQLNTYGFRKVDPEQWEFANDDFLRGQPHLMKNIHRRKPVHSHSLHNLQAQAPLTESERQSMVDEIEKLKQDREQLLMETNRYQHDWETYEIQMHCSKDQLEKLEHKQQKMLSSVSEALQKPMIAVNLLPLAEAMERKRRLPARSGCFNNEASVEDAMETSVALPRENAEDNSTLTLNTERLDQLEASVAFWETLAHEVGGNFVHTHSNMDLDESTCCADSLSISSQQLDGEVRPKSPEIDMNVEPASAALEAVALKEQPARITTAATGVNDVFWEQFLTEDPGASEAQEVQSERKDNSSRKNEGKPSDHGRFWWNMRKSNNHPEQMGHVSQVEKI

SEQ ID NO: 6066 - protein, 125 aa, Pinus pinaster
MAPKAEKKPAPKAEKKLPKEGGEKKGKKKHKKSVETYKIYIFKVLKQVHPDVGISSKAMGIMNSFINDIFEKLASEASKLARYNKKPTITSREIQTAVRLALPGELAKHAVSSRAQGCDQILPVL

SEQ ID NO: 6067 - protein, 139 aa, Unknown
  Frankia sp. EAN1pec
MAQNGPVNQPSPARPRADFYEAVGGEATFRALVARFYEGVASDPVLRPLYPDEDLAAAEERLRLFLIQYWGGPTTYSEQRGHPRLRMRHVPFAIGPAERDAWLRIMESAVDSLGLAPEHRAQLWDYLLMAANSLQNRPG

SEQ ID NO: 6068 - protein, 521 aa, Triticum aestivum
MGNQNGTPGNDYYNRFPREHPASRPTAAGILRQGLDPTSISVLGRKTADLREHYILGRKLGQGQFGTTYLCTEISTGCDFACKTILKRKLITKVDVEDVRREIQIMHHLSGHKNVVSIKDVYEDVQAVHIVMELLPGGELFDRIQGNGRYSEMKAAEITRIVVSIVAMCHSLGVMHRDLKPENFLLLDKDDDLSIKAIDFGLSIYFKPGQVFSELVGSPFYVAPEVLHKRYGPESDVWSAGVILYVLVSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGLGRPTMETSLNVTLRDAAQVH

SEQ ID NO: 6069 - protein, 116 aa, Zea mays
  misc_feature (79)..(79): Xaa can be any naturally occurring amino acid
MDGLFDAAASAGLPIGDEGSVKRAEITFCDAPVFVDPDGRGSRALCTAQIDYVLDPARCTIRVRALQHRCSTDMNLSDXSLFIYPSNIGMKTCGTTKLLLTIPRIHDPAEELCMPL

SEQ ID NO: 6070 - protein, 465 aa, Triticum aestivum
GQAEEVADVIEELEQTLATPTPLLRGIADAMVEEMERGLRADPHAPLKMLVSYVDNLPTGDEHGLFYALDLGGTNFRVLRVQLGGKEKRAVQQYEEVPIPPHLMVGTSTELFDFIAAELERFVETEGDDFHLPEGRHRELGFTFSFPVHQTSISSGTLVKWTKGFCINGTVGEDVVAELSSAMERQGLDMKVTALVNDTVGTLAGGIYADNDVVAAVILGTGTNAAYVEHANTIPKWKGPLPRSGNMVINMEWGNFKSDKLPRSDYDIALDFESLNPGEQMYEKMISGMYLGEVVRRILLRLAHDASLFGDVVPSKLEKLFVLRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEVA

SEQ ID NO: 6071 - protein, 132 aa, Schizosaccharomyces pombe
YLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRS

SEQ ID NO: 6072 - protein, 216 aa, Glycine max
MSSSSTSFSPDQQHLSPSDQLCYVHCNFCDTVLAVSVPCTSLFKNVTVRCGHCTNLLSVNMRGLLLPSANQLHLGHTFFTPQNLMEEIRNAPSTNIMMNQLPNPNDLVMSTMRGGPEETPKPPSANRPPEKRQRVPSAYNRFIKDEIQRIKAGNPDISHREAFSAAAKNWAHFPHIHFGLMPDNQPVKKANVRQEAEDVLMKDGFFAPANVGVSPY

SEQ ID NO: 6073 - protein, 175 aa, Xylella fastidiosa
MHPKNFQHQLKTIPQPPEETRDFVFNHTMLRVKDINASLDFYARILGFRLIDQRDFPEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 6074 - protein, 320 aa, Pseudomonas aeruginosa
MTIRQTPINSGFGAKTQASEVMAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 6075 - protein, 357 aa, Arabidopsis thaliana
MSSPEKFSPAPESNSNPSLPDALIISCIARVSRLYYPILSFVSKSFRSLLASPELYKERSLLNRTEGCLYVCLYLNPFESPSWFTLCLKPDQALSSETSNKKKSSGYVLATVSIPHPRLVQRSSLVAVGSNIYNIGRSISPYSSVSIFDCRSHTWREAPSLPVELVEVSAGVLDGKIYVAGSCKDGDSLNLKNTFEVFDTKTQVWDHVPIPYNETKHNIYSKSLCIDEKWYVGAKRKVVSYNPKKGIWDLVESEMCSYKSSYDYCEIENVLYSVEKTWRGTVFRWYDTELGRWRKLEGLNMPYSGTGDRGGKKMIWCAVITLERRKNSGIWGNVEWFAHVLTVPKTFVFQKFLAATV

SEQ ID NO: 6076 - protein, 507 aa, Pisum sativum
MPNPDSSRQPHRSKTRPSSSSVRSKPRPKDRVPLTKLLRVASVAGGIQFGWALQLSLLTPYVQQLGIPHAWASIIWLCGPLSGLIVQPLVGHLSDRCTSRFGRRRPFILGGAISIALSVLIIGHAADLGWKFGDTKEHRRSAVAFFVFGFWILDVANNVTQGPCRALLGDLTGKDHRRTRVANAYFSLFMAIGNILGYATGSYSGWYRVFPFTLTPACNISCANLKSAFFLDIVFMLITTYISITSANEVPLGSSGEPDAEAEGESGGSAEEAFLWELFGTFKYFSKPIWIVLSVTALTWVGWFPFLLFDTDWMGREIYGGEPNEGTNYDSGVRMGALGLLLNSVVLGVTSLLMEKLCRKRGAGFVWGIANILMAVCFIAMLVLTYVANDIGYLGKDLPPTSIVIAALTIFTVLGFPLAITYSVPYALISTHIQPLGLGQGLSMGVLNLAIVFPQMIVSLGSGPWDQLFGGGNSPAFAVAAIAALVSGGIAVFAIPRTGSQKPRNPV

SEQ ID NO: 6077 - protein, 599 aa, Glycine max
  misc_feature (378)..(378): Xaa can be any naturally occurring amino acid
MANHSLVLDNNTSVSTVTVAEQPLVIGQEFPDVETCRRTMKDIAIAMHFDLRIVKSDRSRFIAKCSKEGCPWRVHVAKCPGVPTFTVRTLHGEHTCEGVQNLHHQQASVGWVARSVEARIRDNPQYKPREILQDIRDQHGVAVSYMQAWRGKERSMAALHGTFEEGYRLLPAYCEQIRKTNPGSIASVVATGQENYFQRLFISYRASIYGFINACRPLLELDRAHLKGKYLGTLLCAAAVDADDALFPLAIAVVDSESDENWMWFMSELRKLLGVNTDNMPRLTILSERQRGLVEAVETHFPTASHGFCLRSVSENFRDTFKNTKLVNIFWNAVYALTAAEFESKITEMMEISQDVISWFQQFPPYLWAVAYFEIRLXGHFTLGVTELLYNWALECHELPVVQMMEHIRQQMVSWFNDRQDMGMRWTSILVPSAEKRILEAIADAHCYQVLRANEVEFEIVSTERTNIVDIRSRECSCRRWQLYGLPCAHAAAALISCGHNAHMFAEPCFTVQSYRMTYSQMINPIPDKSQWRDLGEGAEGGGGARFDIIICPPKTRRPPGRPKKKVIRVENFKRPKRVVQCGRCHMLGHSQKKCTMPI

SEQ ID NO: 6078 - protein, 511 aa, Pisum sativum
MDNPSTNESSNISSIHLESASNRKPTPLIKMIAVASIAAGIQFGWALQLSLLTPYIQLLGVPHKWAANIWLCGPISGMIIQPIVGYYSDRNRSRFGRRRPFIFFGAIAVAVAVFLIGFAADIGHSFGDDLKKKTRPKAVVIFVFGFWILDVANNMLQGPCRAFIGDLAADDHRRMRTGNALFSFFMAVGNVLGYAAGSYRKLFMMLPFTKTEACNEFCANLKTCFFIAIFLLVLLSTFALLYVEDIPLPSIESQSQTQTQTQSEPEQQVSCFGEILGAFNGLQKPMWMLMLVTAINWIAWFPFFLFDTDWMGHEVYGGNPGBDAYNRGVRAGAMGLMINAVVLALMSLAVEPLGRFVGGAKRLWGIVNIILAVGLAMTIVITKAAQHERHVSNGNTPSAGISAASFAFFALLGIPLAINFSVPFALASIYSSASGAGQGLSLGVLNIAIVVPQMIVSALSGPWDSLFGGGNLPAFVVGIGAAVISGVLAIIILPTPKATDVAKVPIAGGFH

SEQ ID NO: 6079 - protein, 413 aa, Unknown
  Acinetobacter sp. ADP1
MSNYDVIIVGTGHAGGQAAVALRQQGFTGSILMIGEELHLPYERPPLSKEYFSGEKTFERILLRPEQFWKDKNIDLKLGQRVIQIDAQSHRILTQQNHEYHYGKLIWATGGKPRRLSCEGADLDGIHYIRNREDVDRINQELDRVQKCVVIGGGYIGLEAASALRKINRDVTLVEAQSRVLARVAGPIISDFYQQYHQQKGIEFYLGQGVDHLEGDQGRVHTVILANGTRIATDMVIVGIGLNPEINALIEAGAISSNGIETDRRCRTSLPDIFAIGDCANHENIFADGQRIRLESVQNANDQAMIVAKEILDKGEDYAAIPWFWSNQYDLKLQTIGLSIGYDQEVLRSEPDSGSFTVIYLRQGTIIALDCVNRPADFIQGKAIIQQSISIPTEQLSDHTLPFKELIQRYKNS

SEQ ID NO: 6080 - protein, 466 aa, Buchnera aphidicola
MSRISISEIYKDDIIVNTPITIFGWVRSRRSSKSGFSFITVYDGSCLNSVQVVADKTLSNYYKDILHLTIGCSVTITGILILSIGDKQKYEIKATKFQVLGWIKNPDTYPISAKKHSLEYLREVAHLRSRTNLIGVIVRIRHHIFQSLHKFLNKQGYYWIPTPIITGLNTEGTGEMFRVSTMDMRNIPKKINGSVDFKKDFFGKESFLTVSGQLNLEAYACSLSKVYTFGPTFRAENSNTSRHLAEFWMLEIESSFCNLDEILIFSEDMLKYICKSLLKYCINDIKFLKNYIDNDIINRLKKFLSVNFIRINYKDAIDILLNSKKKFDNVVSFGVDLNAEHERFLVEKHFKAPVVIINYPKELKAFYMRLNDDKKTVAAMDLLVPGIGELIGGSQREERISVLDLRLSELGLRKEDYWWYRDLRRYGTVHHSGFGMGFERLISYITGISNIRDIIPFPRTVKNADF

SEQ ID NO: 6081 - protein, 762 aa, Unknown
  Vibrio sp. Ex25
MSHVNSKSAQEFHAELTDIGHKLIEERDVIVNRYAVEDRKNYELTTSLVDIEVAAEKLLNSSRESVWFPVTPNHKKVEDTLNLFKNRVLDTTLKLDMLIGVQVENQYALLMLFNLYQQDISTDTGKTLSGHHYFEFLNQLLLTQNVVESESEANFLDRLQASDKRIELLTNELLDHGYFVFIEDAEHRLLNIAQSEARFTWLFVFIAVMLLVSAFLYQSQYRMYNLKQLNLEIEEARNKAERAAKAKSSFLAAMSHELRTPMNGVLGLSQMIAEETNEPTTKEYVKVILDSGQHLMTILNDILDFSKVEENKLEFEQAKFNLDQVISPVCSAIKPLIDEKNIELIVENEVPEYVEFTGDCARLRQILFNLAGNAVKFTSEGHVLIRTELDKVNHCLVMIVSDTGIGIALDKQEHVFNSFEQADSSTTRKFGGTGLGLAIVKKLTGLMDGKITLKSVEGVGSQFIVELPIPWVECELPKAQEPPKTRKKTHNLQILLAEDNRVNAIVAKGFCEKLGHEVDVAENGLVAVKKARDNEYDLILMDNHMPEINGVEATRVIRQELGIKTLLFAYTADVFREAHDSFIQAGADHVLTKPLQQESFSDALKQFATRLEPKENLPLTNDNNVLQLQRKPIEKLRLTEEELSSSEMLISLQEAPEAIDELLKSIIVDFESSVDELIDYFMAEDFASLEDTLHKTKGMALNLGLPILAGQTEALENTLKAKQTPEIERLQMLINRLQVNIHQANRLLDDIQKKNVDPQQIL

SEQ ID NO: 6082 - protein, 503 aa, Phaseolus vulgaris
MEPSSSSLQVETGERQQPSPLRKMFAVSSIGAGIQFGWALQLSLLTPYVQTLGVPHAWSSFIWLCGPISGLLVQPIVGYSSDRCTSRFGRRRPFILSGAVAVAISVFLIGYAADIGHATGDDITKKTRPRAVAIFVVGFWILDVANNMLQGPCRAFLGDLAAGDQKKTRTANAFYSFFMAIGNVLGYAAGSYDKLHHLFRFTETEACGVFCANLKSCFFFSIVLLLVLCAIVLTCVDDPQFTPDCVNANNPQTGSWYSCFGELGIAFKGLQKPMLMLMLVTAINWVAWFPYVLYDTDWMGREVYGGEVGSNAYDNGVHAGSLGLMLNSVVLAVMSLVVEPLGRVVGGVKWLWAAVNVILAVCMAMTVVITKAARHERNHDGVLVGHPSFGVKAGAMSFFSILGIPLAITYSVPFALASIYSSTSGAGQGLSLGLLNVAIVVPQMIVSAISGPWGSWFGGGNLPAFVLGAVAAAVSAVLAVVMLPSPKPADVSKASSVTVGNFH

SEQ ID NO: 6083 - protein, 166 aa, Unknown
  Polaromonas sp. JS666
MRALHQARRYLNSATHPGTRMQIEENPPGNPPFETPFAWIGGEERVKALVERFYDLMDLEPGYAALRAAHGSTLDNARQRLFWFLCGWLGGPQHYTERFGHPRLRMRHMPQQTGGGAIGSIGILERDQWLACMDQAMRETGVDDALRTRLNASFFQTADWMRNRGE

SEQ ID NO: 6084 - protein, 450 aa, Unknown
  Vibrio sp. Ex25
MSHIHDTIVALQHSSPAQKEFYQAVEEVLTSLAPVIESNNKYKEQAIIQRIVEPERQIMFRVPWVDDAGNVQVNKGYRVEFNSALGPYKGGLRFHHSVNASIIKFLGFEQIFKNALTGLPIGGGKGGSNFDPKGKSDGEIMRFCQSFMNELYRHIGPVTDVPAGDIGVGAREIGYMFGQYKRLTGRYEGVLTGKSLLWGGSLVRKEATGYGTVYFAECMLNDRNDSLKGKTCLVSGAGNVAIYAIEKLYHMGATPVTCSDSRGTIYHEHGIDLQLLKQLKEVKRASLEEYLDTYPEAEYTPLGDYPNEGHAVWRYQADAAFPCATQNELTSNDALALIDNGCVLISEGANMPTTRDAANIIVDSEMAYGPAKAANAGGVATSQLEMAQNASMQNWTFEQVDSQLQTIMKNIFVNANETSREFGQPGNLVLGANIAGFRRVADAMIEQGIV

SEQ ID NO: 6085 - protein, 255 aa, Glycine max
MTATDIARTAVGIIGNIISGALFLSPALKKNIQYRPTFVEICKKGSVEQYSAAPYLATLVNCMVWTLYGLPMVHPNSILVVTINGSGCIIELIFVTLFLIYSGGKKRLKVLLWLLLELIFISVLTFITLTKVHTFKKRSAIVGTTCILFNIMMYASPLAIMKLVIKTKSVEYMPFYISLASFGNGVAWTTYSLIRFDKFITIPNGLGTLFAVAQLILYATYYKSTQRQIAARNGNGGVNLSQVVVGRDDQSKPDN

SEQ ID NO: 6086 - protein, 341 aa, Streptomyces coelicolor
MRIGVLTAGGDCPGLNAVIRSVVHRAVDNYGDEVIGFEDGYAGLLDGRYRALDLNAVSGILARGGTILGSSRLERDRLREACENAGDMIQNFGIDALIPIGGEGTLTAARMLSDAGLPVVGVPKTIDNDISSTDRTFGFDTAVGVATEAMDRLKTTAESHQRVMVVEVMGRHAGWIALESGMAAGAHGICLPERPFDPADLVKMVEERFSRGKKFAVVCVAEGAHPAEGSMDYGKGAIDKFGHERFQGIGTALAFELERRLGKEAKPVILGHVQRGGVPTAYDRVLATRFGWHAVEAAHRGDFGRMTALRGTDVVMVPLAEAVTELKTVPKDRMDEAESVF

SEQ ID NO: 6087 - protein, 337 aa, Aeropyrum pernix
MPLRLSAVRAPKIPRGEEYDTVIVGAGPAGLSAAIYTTRFLMSTLIVSMDVGGQLNLTNWIDDYPGMGGLEASKLVESFKSHAEMFGAKIVTGVQVKTVDRLDDGWFLVRGSRGLEVKARTVILAVGSRRRKLGVPGEAELAGRGVSYCSVCDAPLFKGKDAVVVVGGGDSALEGALLLSGYVGKVYLVHRRQGFRAKPFYVEEARKKPNIEFILDSIVTEIRGRDRVESVVVKNKVTGEEKELRVDGIFIEIGSEPPKELFEAIGLETDSMGNVVVDEWMRTSIPGIFAAGDCTSMWPGFRQVVTAAAMGAVAAYSAYTYLQEKGLYKPKPLTGLK

SEQ ID NO: 6088 - protein, 437 aa, Brassica oleracea
MALSLSAASHSLCSSSTTRVSLPPAAVSSSSSSPSSPSLVSFSSLRSLASSSSSSSSSLFPHSPSLVQRKHPNRGSSNTVVSPTRAAASDAAQLKSAKEDIKVLLRTKFCHPILVRLGWHDAGTYNKNIEEWPQRGGANGSLRFEPELKHAANAGLVNALKLIEPVKEKYSNISYADLFQLASATAVEEAGGPEIPMKYGRVDVSAPEQCPEEGRLPDAGPPSPADHLREVFYRMGLNDKEIVALSGAHTLGRSRPDRSGWGKPETKYTKAGPGEPGGQSWTVKWLKFDNSYFKDIKEKRDEDLLVLPTDAALFEDPSFKNYAEKYAGDPAAFFKDYAEAHAKLSNLGAKFDPPEGIIIDNGPAQGEKFVAAKYSTQKKELSDSMKKKIRAEYEAIGGSPDKPLPTNYFLNIIIAISVLVLLFTFLGNNNSSDYSGF

SEQ ID NO: 6089 - protein, 226 aa, Unknown
  Mycobacterium sp. S65
MADTDGEGLDAAVAELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 6090 - protein, 349 aa, Glycine max
MAEKLVLVSDMASTMKQVPSNFIRPLGDRPNLQGVVQSSDVCIPLIDLQDLHGPNRSHIIQQIDQACQNYGFFQVTNHGVPEGVIEKIMKVTREFFGLPESEKLKSYSTDPFKASRLSTSFNVNSEKVSSWRDFLRLHCHPIEDYIKEWPSNPPSLREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 6091 - protein, 64 aa, Passiflora rufostipulata
GEVMPGQWEYQVGPSVGIDAGDHIWCSRYILERITEQAGVVLSLDPKPIEGDWNGAGCHTNYST

SEQ ID NO: 6092 - protein, 497 aa, Nicotiana tabacum
MKKATVGAAVVGAATVCAVAAFIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEDAGIFGDEVPPKLKSPFVLRTPDMSAMHHDISSDLRVVGDKLKDILEISNTSLKTRRLVVELCNIVATRGARLAAAGILGILKKMGRDTPRQGGPEKTVVAMDGGLYEHYTEYRTCLENTLKELLGDELATSIVFEHSNDGSGIGAALLAASNSMYLEDKS

SEQ ID NO: 6093 - protein, 55 aa, Passiflora sandrae
WEYQVGPSVGIDAGDHIWGSRYILERITEQAGVVLTLDPKPIEGDWNGAGCHTNY

SEQ ID NO: 6094 - protein, 179 aa, Oryza sativa
MAGGGGAGSKVSVAAVQFACTDVESENVDTAERLIREAHKKGANIVLVQELFEGQYFCQAQRLDFFQRAKPYKGNPTIIRFQKLAKELEVVIPVSFFEEANNAHYNSVAIIDADGTDLGLYRKSHIPDGPGYQEKFYFNPGDTGFKAFKTKYATIGVGICWDQWFPERARAMVLQGAEI

SEQ ID NO: 6095 - protein, 1085 aa, Candida albicans
MYATAHTIKQQQQQHPPPPPLNGGLHASGAPPNSHEAAAIAQQQQQQQQHHNGPGMIVAAAAASANQQAVQARAQQQQQQQQQQRLPSSAALNETTVSTWLAIGSLAESLGDIERATASYNSALRHSPNNPDILVKIANTYRSKDQFLKAAELYEQALNFHVENGETWGLLGHCYLMLDDLQRAYAAYQRALFYLENPNVPKLWHGIGILYDRYGSLEYAEEAFVRVLDLDPNFDKANEIYFRLGIIYKHQGKLQPALECFQYILNNPPHPLTQPDVWFQIGSVYEQQKDWNGAKDAYEKVLQINPHHAKVLQQLGCLYSQAESNPPTPANGAAQPHKPFQQDLTIALKYLKQSLEVDQSDAHSWYYLGRVEMIRGDFTAAYEAFQQAVNRDARNPTFWCSIGVLYYQISQYRDALDAYTRAIRLNPYISEVWYDLGTLYETCNNQISDALDALDAYRQAERLDPNNPHIKARLEQLTKYQQEGNTHPPQPPPSSQQPRLPQGMVLESTQQQQQQQQQQPPPPPPPPQQLQHQSQSQSQPQPQQPPQIQSQPSLLQHQSSLPPQQIQPLHQQAAKPLVNQQQSPPPPHLMNLGQPGQQPRQLPPHLPPHTQQPSQIQEKPPTQEQPHHQPPPPPQHQQQSQSQPQPPHQPQHTQNQSPQLAQLPPHHSNPPANPHGAPQQRTGLPDLLHNSANIIIAPSQVPQPQQQYQQPHIAPVRQEQVNHVPSIYSAPRPTETTLPQINNPNESTTTQVPQLKKEEPKPEATVSAPVPEAIKVQDQVTIQESAPAAAAVSAPASAPVGDIKTDTVSTTTPATSTTADAVPVSVSQVGEAPNVVQEKKVPDTEQIVSQVEKPVESQPEVTPAPTPAPALATAPTEPAPTDKDVVMAPSKSATPIPQSIVEQNTRVSEATKAPESNGKHDLEDKNDEEKILKRPTVETTTESVPVNQPVEKENEKVEVPPPPEQPSSEKREKEVNGSIKKPLENESKVDIPQFSSNITAQNEEAKSGEETKKDTTKTSPAKQGEVKEVIPSSTETVSKPDVEKDNKEKDKDEDEVMADEDDVKKDENPEPPMRKIEEDENYDDE

SEQ ID NO: 6096 - protein, 482 aa, Pseudomonas syringae
MQLIWLRSDLRAQDNTALTAAMERGPTLAVYLLSPAQWRSHDDADCKVDFWLRNLVELEKALGELNVPLLIREADTWDQAPEVLATLCTQFKVEGLHLNQEYGINETRRDQAVQKAMGKAGVHFNSYLDQLLFKPGSILTKTGNYFQVFTQFKKVCYTRLHEAMPHPVRTPQAQAAQSIKSDAVPKQVKGFATPSKALRDLWPAGEAEARRRMDAFAAEQISYYKTERDFPAKPGTSQLSAYLAAGVISPRQCLHAALASNQGEFETGDVGTVTWINELLWREFYKHTLVGYPRVSRHRAFRPETEALKWRDAPEELRAWQEARTGLPIIDAAMRQLLETGWMHNRLRMVVAMFLTKNLLIDWREGERFFMRHLIDGDLASNNGGWQWSSSTGTDSAPYFRIFNPLSQSERFDPEGVFIKRWLPELADMNKKQIHDPSLIGDLFGAADYPKPIVDLSKSRARALAAFKALPARQPAAGVEHG

SEQ ID NO: 6097 - protein, 168 aa, Ralstonia metallidurans
MTTQIETAILAGGCFWGMQDLLRRYPGVLSTRVGYTGGDVPNATYRHHGTHAEGIEIAFDPSQISYRQILEFFFQIHDPTTKNRQGNDVGTSYRSAIFYLNDEQKQTAEDTVADVNASGLWPGKVVTEIAPAGPFWDAEPEHQDYLERYPNGYTCHFIRPGWKLPKRG

SEQ ID NO: 6098 - protein, 497 aa, Nicotiana tabacum
MKKATVGAVVVGAAVTVAVGALIVRHRMRKSSKWARARAILKEFEEKCGTPDAKLKQVADAMTVEMHAGLASEGGSKLKMLISYVDNLPTGDEEGVFYALDLGGTNFRVLRVQLGGKDGGIVHQEFTEASIPPNLMVGTSEALFDYIAAELAKFVAEEEEKFHQPPGKQRELGFTFSFPIMQTSINSGTLIRWTKGFSIDDTVGQDVVAELTKAMQRKGVDMRVSALVNDTVGTLAGGRFSNKDVSIAVILGTGTNAAYVERAQAIPKWHGPLPKSGEMVINMEWGNFRSSHLPLTEYDHAMDTDSLNPGEQIFEKICSGMYLGEILRRVLLRMSEEAAIFGDEVPPKLKNQFILRTPEMSAMHHDTSSDLRVVGDKLKDILEISNTSLKTRRLVVELCNIVATRGARLAAAGVLGIVKKMGRDTPRESGQEKIVVAMDGGLYEHYTEYRKCLENTLVELLGEEMATSIVFEHANDGSGIGAALLAASNSLYVEDKS

SEQ ID NO: 6099 - protein, 61 aa, Passiflora sanguinolenta
EVMPGQWEYQVGPSVGIDAGDHIWCSRYILERITEQAGVALSLDPKPIEGDRNGAGCHTNY

SEQ ID NO: 6100 - protein, 376 aa, Thiomicrospira crunogena
MLTRSDIHQKSRRWVVKIGSALLTNDGRGLNKDAMAQWVSQMVTLRQQGIELVIVSSGSVAEGMQRLGWSQRPSELNELQAAAAVGQMGLVQAYESEFAKNGIHTAQILMTHDDLSNRARYLNASNTIQTLLEHGVVPVINENDTVVTDEIRFGDNDTLAALTANLVSADVLVILTDQNGLYNDNPRTNPNAELISEAQVSRKDIEAMASSEGGSLGKGGMYTKVMAAKRAARSGTATFIASGREDNVLPRLLAGEPLGTLLIPDLEPLTAKKRWLAGHLQAKGQLVLDEGAVKALQSSGKSLLPIGVKGMSGEFQRGEMVVCVNENNQEVARGLVNYPFFETQKIMGHPSSEINQLLGYSDGEFLIHCDNLVLAD

SEQ ID NO: 6101 - protein, 380 aa, Vibrio parahaemolyticus
MKKISKLLVGFSFALPVLFLLLSKTGTADTMDKMKALENAEIATLAGGCFWCTESDLEQLPGVLDVVSGYSGGHVKNPTYRQVSSGKTGHIESIEVKYDPNVVNYEQVLDYFFRHIDPTDDKGSFVDRGPQYRPAIFYHNAEQKQIAEQFMMEIDNAKVYPKPLKTELIKFETFYPAEEYHQDYYKKSSLKYKYYRYASGRDKYLDEVFGDDRKEHPKTLRQLIDEKKLLSKVKAYNKPSQSKIKSTLTELQYYVTQEEGTERPFDNEYWDNKEAGIYVDIVTGEPLFSSTDKYKSGTGWPSFTKPINPGYIVEKTDYKLIYPRTEVRSKFGDSHLGHVFTDGPKPTGLRYCMNSAAMKFVPVSKMAQLGYGDYLFLFEQ

SEQ ID NO: 6102 - protein, 498 aa, Nicotiana tabacum
MGKVVVGAAVVCTAAVCAAAVLLMRHKMKNSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATALVKFVATEDDDFRLPPGRQRELGFTFSFPVKQLSIASGTLIKWTKGFSIDDTVGQDVVRELTKAMERVGLDVRVAALVNDTVGTLAGGRYNNPDVIAAVILGTGTNAAYVERANTIPKWHGLLPKSGDMVINMEWGNFRSSHLPVTEYDQSLDTESLNPGEQIYEKMISGMYLGEILRRVLCRMAEEASFFDDYVPPKLKTPFILRTPDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAESIVIELSNDGSGIGAALLAASHSQYLGLEES

SEQ ID NO: 6103 - protein, 675 aa, Schizosaccharomyces pombe
MQHTFIYDTCLWILSILIDFFFREVKTRGSFRVPRKGPLILVAAPHANQFVDPLILMLQLRREVGRRTSILVAAKSYRQRFIGLMSRAFGAIPVERAQDLAIRGEGKIFVVAEGDKTAIHGKDTLFTKHSVGDTLLLPNNYGSSHIASIKSDTLLYVKREFRGEDAERVLLSPEGSSYKVAPEIDQTYVYNEVRRRLVKGACIALFPEGGSHDRPEMLPLKAGVAIMALETLSQHPDCGLQLLPCGMNYFHPHRFRSRAVLEFGSPLSIPTEYVELYKAKKRREAIQGVLDMIYDALLSVTVQAPDYETLMVIQACRRLYKPAHIQFALPKVVDLNRKLIVGYNHFKHDPRVIRLHDKILLYNRQLYRLGLRDHQVQSLQYSRFMILYKLVYRCCKLFLLALGALPGAILFSPVFIAAHRISVKKAAAALKASSVKIQGRDILATWKLLVALGMTPILYSFYALLCCYYIYSYKLIPHSSIFVYTVPIISTFLFPMVTYAALRFGEVAVDIYKSIRPLFLALIPSKANAVYILKDERKQLVAEVTDLINKLGPELFPDFDPDRITTTIEKPERPSRFARRLSSSVASDVDNLSQLHDTDLNSEVSAPAPLQNVYLYSPNPSALPPSDEEEKDINDKAKLIRNALRQRMGQRMTEIRSRDTPPEEVFSESDEELSD

SEQ ID NO: 6104 - protein, 285 aa, Arabidopsis thaliana
MPTLYKKAGFMIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAMKVGPTTVNSASSLTMCPRCERVTPAASPSRAVVPVPAKKTFPPQERDR

SEQ ID NO: 6105 - protein, 187 aa, Neisseria meningitidis
MTDLETKRLETQAMLENADLLFDQGQCRAALQKVADEITRDLGGKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKPKPIRADYVGLDVPNRYVFGYGMDAAGCWRNLGEIYALDGK

SEQ ID NO: 6106 - protein, 497 aa, Unknown
  delta proteobacterium MLMS-1
MKCALIIPPWLPEEIFASKTAGSQINYWQPLGTLYVAAALQQAGHQVRFFNGAFMGHGEIMAAVADFAPDFIGLYSTTFGWQKAKDMAAALRAAGGDFLLAVGGPFPIAAQEQCLEESPELDVVVTGEGEETVVEILGRWQQVGAAGGAEAAAAAGPRRRLATGLELDGVLGVVWRRGAEIIKNPPRPLITDLDALPFPARELMGQAVDQYVPPPATYKRRPVAVIITSRGCNRRCLYCFQIDKSRQSGIRYRSVDNVLAEIRACLAEGYREIKFIDDTLADDYERALELARRIKQEGLDFTWFASACVNQVDEQLLRAFKEAGCWAILFGVESGVQKDLNTIRKGITIAQIRKAVAAAKKVGITVYTPFIFGIPGQTYEDGLKSIDFALELDPDIANFHALTPFPGTELWDNLEKYGTVSHDLADYTYQGAAFVPYSMTREEIAELRRIAFKRFYSRPKFLFRRLLALRSVNDLRAAWQGVKSLFWLHVGGKIFQR

SEQ ID NO: 6107 - protein, 186 aa, Brassica napus
  misc_feature (8)..(8): Xaa can be any naturally occurring amino acid
KENNYCLXREGQLQDVYEHVLSNNALLICKVVQLQDGRGKHKPLDRVENKSLTLNGSGVPSQLSNATHYRLEPDGTGHNYASAMKGAKVVDQNKEAKGASNVLGKDHDKYLRNPCSVSNKYVVIELAEETLVDTVRVANFEHYSSNLKEFSLSGSLSYPTDTWTHAGRFVAANAKQVQTFRLQEPK

SEQ ID NO: 6108 - protein, 340 aa, Photorhabdus luminescens
MNSTVSMTVIGAGSYGTSLAITLARNGHNVVLWGHNPEHVGALQRVRCNQKFLPDVSFPDSLLLETDLIKALTASRDILVVVPSHVFGEVLKQIKPHLRPDSRIVWATKGLEADTGRLLQDVAREILGNEIPLAVLSGPTFAKELAAGLPTAIAISATESAFGDGLQQLFHCGKSFRVYKNPDFIGVQLGGAVKNVIAIGAGISDGMGFGANARTALITRGLAEMSRLGAALGADPSTFMGMAGLGDLVLTCTDNQSRNRRFGMMLGQGISVEEAQYQIGQVVEGYRNTKEVRALANRANVEMPIAEQIYQILYCNKNVIEAAQALLGRARKDESDNVRS

SEQ ID NO: 6109 - protein, 537 aa, Medicago truncatula
MVSTCVNFKANNHVANLRKDSIFHQDNGFLGERIKVGVNYSPWIGNQFGISLRTKERVKKAKPGVVSAVLTSNDATETKTFQVPSFIRRKADPKNVASIVLGGGPGVQLFPLTKRAATPAVPVGGCYRLIDIPMSNCINSGINKIFVLTQFNSASLNRHIARTYFGNGINFGDGYVEVLAATQTPGEAGKNWFQGTADAVRQFTWVFEDAKNTNIENVIILAGDHLYRMDYMDLVQSHIDRNADITVSCAAVGDSRASDYGLVKVDSGGRIIQFSEKPKGADLKSMSCVSDASLQQADTSLFGLSNQDALRSPYIASMGVYVFKTDVLLKLLKWRYPTSNDFGSEIIPASVKEYNVQAFFFGDYWEDIGTIKSFYDANMALTEESPMFKFYDPKTPIFTSPGFLPPTKIDKCRIVDAIISHGCFLRECSVQHSIVGERSRLDYGVELQDTVMMGADYYQTESEIASELAEGKVPIGIGSNSKVRKCIIDKNARIGKDVIIMNKDGVQEADRPEDGFYIRSGITIVMEKATIEDGTVI

SEQ ID NO: 6110 - protein, 338 aa, Bordetella holmesii
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIHGVRGSYPGDLYCHVVVE

SEQ ID NO: 6111 - protein, 306 aa, Desulfotalea psychrophila
MTTTIGQSIGNTPLLKLGRLDRDCAATILVKQESRNPAGSVKCRVAVSMIETGLREGKISKGTTIVEPTSGNTGIGLAFVCAAKGLRLILTMPESMSIERRKLLAHLGAEIVLTPAAEGMTGAITKAEELLTGLADGFMPDQFNNPANPEIHRQTTGKEILRDTDGRVDIFVAGVGTGGTLTGVGSVLKAKNPRVQVIAVEPATSAVISGEAPGPHGIQGIGAGFIPGNLDISLIDETIKVNDEDALVAAQELATQEGILCGISSGAAFWASLEVAKRPENIGKTIVTILPDTGERYLSTNLFSTS

SEQ ID NO: 6112 - protein, 347 aa, Zea mays
MARLLIPLPFAAASASSLHLAVSRLPLAAVSAARRECLFGGRVVGGVVRAPARLSKRGLCAGAEAGDSAVTVEAMEWVKKDRRRLLHVVYRVGDLDKTIKFYTECLGMKLLRKRDIPEERYTNAFLGYGPEDSHFVVELTYNYGVESYNIGTGFGHFGIAVEDVAKTVELIKAKGGTVTREPGPVKGGKSVIAFIEDPDGYKFELIERGPTPEPLCQVMLRVGDLDRAINFYEKAFGMELLRKRDNSEYKYTIAMMGYGPEDKNAVLELTYNYGVKEYDKGNAYAQIAISTDDVYKTAEAIRVNGGQITREPGPLPGITTKITACTDPDGWKTVFVDNIDFLKELEE

SEQ ID NO: 6113 - protein, 303 aa, Thermotoga maritima
MGSDKIHHHHHHMMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 6114 - protein, 269 aa, Prunus persica
DWRDFLPYLRWVPNKSLEMKIQRLYTRRSAVMNALIDDRKKGIASGEELNCYTDYLLSEAKTLTSEQIAMLLWETIIETADTTLVTTEWAMYEIAKDSNRQGRLYQEIQNVCGSNKITEEHLSQLPYLSAVFHETLRKHSPAPIVPLRYAHEDTQLGGYYVPAGSEIAINIYGCSMDKNQWESPGEWKPERFLEPKYDPMDLYKTMAFGAGKRVCAGSLQAMLIACTTIGRLVQEFEWKLRDGEEENVDTVGLTTHKLHPMHAILKPRN

SEQ ID NO: 6115 - protein, 341 aa, Oryza sativa
MAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPSPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMANNRPDTWDPALLRPGRLDRKVEFGLAEL

SEQ ID NO: 6116 - protein, 476 aa, Phaseolus vulgaris
GGSGVQFGWALQLSLLTPYVQTLGVPHAWASFIWLCGPISGLLVQPIVGYSSDRCQSAFGRRRPFILAGALAVAIAIILIGYAADIGQLAGDDITQKTRPRAVAIFVVGFWILDVANNMLQGPCRAFLGDLAAGDQKKTRTANSFFSFFMAVGNVLGYAAGSYDGLHKIFPFTETEACNVFCANLKSCFFFSIVLLLALCIIVLTCVNDPQYIPSNPEKEAEEEGKTQVSCFLGECCVAFKGLQRPMWMLMLVTAINWIACFPYVLFDTDWMGREVYGGDVGQKAYDAGVHAGSLGLMLNSVVLAVMSLAVEPLGRLVGGVKWLWAIVNVILAACMALTVLITKVAEQQRALNPALIGNPSMEVKGGAMAFFSVLGIPLAITYSVPFALASIYSSTSGAGQGLSLGLLNVAIVIPQMIVSAISGPWDDWFGGGNLPAFVLGAGAAAISAILAVILLPSPKKEDEAKISSLSMGSFH

SEQ ID NO: 6117 - protein, 269 aa, Fragaria grandiflora
DWRDFLPYLRWIPNKTMETKIQRLYTRRKAVMTALINEQKKRIASGEEINCYIDFLLSEGKTLTMDQITMLLWETVIETADTTMVTTEWAMYEIAKNPKQQDRLYQEIQKVCGSEMVAEEHLSKLPYLNAVFHETLRKHSPAALVPLRYAHEDTQLGGYYLPAGTEIAINIYGCNMDKHQWESPEEWKPERFLDPKYDPMDLYKTMSFGAGKGACAGSLQAMLIACPTIGRLVQEFEWKLRAGEEENVDTVGLTTHKRDPMHAILKPRS

SEQ ID NO: 6118 - protein, 138 aa, Arabidopsis thaliana
  misc_feature (2)..(2): Xaa can be any naturally occurring amino acid
  misc_feature (11)..(11): Xaa can be any naturally occurring amino acid
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (52)..(53): Xaa can be any naturally occurring amino acid
  misc_feature (57)..(59): Xaa can be any naturally occurring amino acid
  misc_feature (64)..(64): Xaa can be any naturally occurring amino acid
  misc_feature (68)..(69): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (100)..(100): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(111): Xaa can be any naturally occurring amino acid
  misc_feature (117)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (128)..(129): Xaa can be any naturally occurring amino acid
  misc_feature (131)..(131): Xaa can be any naturally occurring amino acid
  misc_feature (133)..(136): Xaa can be any naturally occurring amino acid
MXSSMLSSAAXGTSPAXATMVAPFTXLKSSAXFPXTRKNNKDITSIASNGGXXNCMXXXPPIGXKKFXXLSYLPDLRDXKLGKEXDYXLRXKGIPXGEFXLKNGXFVYXEXGKTPGXXXGXXWXXGKXXLXGXXXXLK

SEQ ID NO: 6119 - protein, 244 aa, Rhodobacter sphaeroides
MTTKNTSGRGQRELRVRVKTAKGRKLSSTLWLERQLNDPYVIRAKKEGYRGRAAYKILELDDKFGFLKPGGRVVDLGCAPGGWCQVAVERVNALGQKKNKPEGTVLGVDLQEVEPISGAEIHQLDFLSDDADEKVKGWLGGRADVVMSDMAAAASGHKGTDHLRIIALCEAAAAFAFDVLEEGGTFVAKVLAGGAENELQALLKKNFTKVANVKPPASRADSSEKFVVAMGFRGRASEPEEGEA

SEQ ID NO: 6120 - protein, 231 aa, Brassica napus
PPVSRNFFASLAPSGNCGLLAPGGPQAALPILHVEECFLPSSRGGFGRFAMQPGPPLAPVFCVGPPGVSWWCKPCHPLFLLPFGARLFPPLFSGGFLGPPPPFPPPLLVVVGPPLVVRKLPPPPDGFVAEVPRLFGAPLEVLFLLFSTPAFFSVLLFLLFFFLFVLVVLFFFLLFLFFFWWFFFFFRLFFSLFLPFFYNKTPKNKKKKKKKKKKKKKKKKKKKKKKKKRAA

SEQ ID NO: 6121 - protein, 346 aa, Comamonas testosteroni
MLVKNTWYVAGMATDCSRKPLARTFLNEKVVLFRTHDGHAVALEDRCCHRLAPLSLGDVEDAGIRCRYHGMVFNASGACVEIPGQEQIPPGMCVRRFPLVERHGLLWIWMGDPARANPDDIVDELWNGAPEWRTDSGYIHYQANYQLIVDNLLDFTHLAWVHPTTLGTDSAASLKPVIERDTTGTGKLTITRWYLNDDMSNLHKGVAKFEGKADRWQIYQWSPPALLRMDTGSAPTGTGAPEGRRVPEAVQFRHTSIQTPETETTSHYWFCQARNFDLDDEALTEKIYQGVVVAFEEDRTMIEAQQKILSQVPDRPMVPIAADAGLNQGRWLLDRLLKAENGGTAP

SEQ ID NO: 6122 - protein, 226 aa, Unknown
  Mycobacterium sp. S65
MADTDAGRLDAAVAELAESGAAVCGVVGDVCRRDVADGVAERALTEFGQLDALFNVVGGSLARNVEEISEEQWRTQLDMNLGSVFQMSKPAIPLLRQGGGGSIVNVASTAGLLAENRCSAYSASKGGVVLLTKNMALDFARDNIRVNAIAPGGTRTPRIERFLTEHPEHSSMMVDLCAMQRFGWPDEIAAPAVFLASPEASYITGAVLPVDGGMTAGVTFRAFEAG

SEQ ID NO: 6123 - protein, 336 aa, Beta vulgaris
MRLISTTSAVATLLFLVVILPSIQLTEAQIGVCNGRLGNNLPSEEDVVSLYKSRGITRMRIYDPNQRTLQAVRGSNIGLIVDVPKRDLRSLGSDAGAASRWVQNNVVPYASNIRYIAVGNEIMPNDAEAGSIVPAMQNVQNALRSANLAGRIKVSTAIKSDLVANFPPSKGVFTSSSYMNPIVNFLKNNNSPLLANIYPYFSFIGTPSMRLDYALFTSPNAQVNDNGLQYQNVFDALVDTVYAALAKAGAPNVPIVVSESGWPSAGGNAASFSNAGTYYKGLIGHVKQGTPLKKGQAIEAYLFAMFDENQKGGGIENNFGLFTPNKQPKYQLNFNN

SEQ ID NO: 6124 - protein, 707 aa, Buchnera aphidicola
MLNPIVRKFQYGQHTITLETGIMARQATAAVMASMDDTAVFVTVVGEKTTNSSQKFFPLTVNYQERTYAVGRIPGGFFRREGRPSENEILTARLIDRPIRPLFPKGFCNEIQIIATVVSVNPQINPDIISIIGASAALSLSGIPFYGPIGAARVGFVNNQYVLNPTIDDMKSSFLDLVVSGTQNAVLMVEAESKVLSEDKILGAIMFGHQQQQVVINNIRSLSNEASKLPWIISYPEINTELELKITKLAEKDISNAYLIFNKQERYEKLNFLKEEIIKLFFSENSNIDISEIEDIFEKIEKNIVRKRILNNENRIDGREKDMIRALDIRTGVLPRTHGSSLFTRGETQSLVSVTLGTSRDAQNLDELLGDKTDNFLFHYNFPPYSVGEIGIVGSPKRREIGHGRLAKRSLLAVMPKLDDFPYTIRIVSEITESNGSSSMASVCGASLALMDAGVPIKSAVAGISMGLVKEGDKYVLLSDILGDEDHLGDMDFKVSGTEEGITALQMDIKIEGITNEIMRIALNKAKSARLHILNVMKQALSKPRNEISEFAPRIHKIKINPEKIKDVIGKGGSVIRMLTEETGTIIEIEDDGTIKISATIGEKAKNAIRRIEEITAEIEVGRIYSGKVTRIVDFGAFISIGIGKEGLVHISQISNKRVEKVSDHLTVDQIISVKVLEIDRQGRLRLSIKEVENSIISNKSINNIYI

SEQ ID NO: 6125 - protein, 300 aa, Prochlorococcus marinus
MSWKVADIPDQKGRVALVTGANSGLGLETAKALLNKGARVIMACRSLPTGEDVRQVILERNDSTKLDLIELDLADLASVRRAAEQVESQYSRVDLLINNAGVMATPKTLSKQGLELQFAVNHLGHMALTLKLLPLLAKQHGARVVTVTSGAQYMGRIAWDDLQGIKQYDRWAAYSQSKLANVMFALELDKRMRQTASGIASLLAHPGLARTNLQPKSVAANKSWQEGLAYRLMDPMFQSAAMGSLPQLHAATAPTAQGGEQYGPRFNFRGYPKLCSVAPLALREEDRQRLWSISEKLLEI

SEQ ID NO: 6126 - protein, 372 aa, Thiobacillus denitrificans
MSKRDYYEVLGVAKNASDEEIKKAYRKLAMKHHPDRNPGDHAAEDKFKEAKQAYEILSDSDKRAAYDQFGHAGVDPQSGMGGGGFGGGGFSDAFSDIFGDIFGGGGGNRRDRVYRGADLRYNLEIGLEEAARGTETKIRIPTLEECGTCHGSGAKPGTQPTTCSACGGHGQVRVQQGFFSVQQTCPRCGGTGKMVSDPCPSCHGEGRVKKHKTLSVKIPAGVDSGDRIRLAGEGEAGVNGGPSGDLYVVIHLKDHPVFKRDGDDLHCEMPISFATAALGGEVEIPTLDGHAKIKIPAETQSGKVFRLRGKGIKGVRSHAPGDLLCHMLVETPVNLSERQRELLREFEALSPGRNNNPRAQSFMDKVKSFFGT

SEQ ID NO: 6127 - protein, 498 aa, Nicotiana tabacum
MGKVVVGAAVVCTAAVCAAAVLLMRHKMENSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATTLVKFVATEGDDFHLPPGRQRELGFTFSFPVKQLSIASGTLIKWTKGFSIDDAVGQDVVRELTKAMERVGLDVRVAALINDTVGTLAGGRYNNPDVIAAVILGTGTNAAYVERANTIPKWHGLLPKSGDMVINMEWGNFRSSHLPVTEYDQSLDAESLNPGEQIYEKMISGMYLGEILRRVLCRMAEEASFFDDYVPPKLKTPFILRTQDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAENIVVKLSYDGSGVGAALLAASHSQYLGLKES

SEQ ID NO: 6128 - protein, 499 aa, Nicotiana tabacum
MGKLVVGVSVVCTAAVVCGVAVLLMKRRMKNSGEWGKVEALLKDFEEKCATPMGKLKQVADAMTVEMHAGLASEGGSKLKMLISYVDNLPTGDEEGLFYALDLGGTNFRVMRVQLGGNEKRIVKHEVKEVSIPQNVMAGSSSEVLFDFIATALAEFVATEGDDFHLPPGRQRELGFTFSFPVKQLSIASGTLIKWTKGFSIEDVVGQDVVGELAKAMERAGLDVRVTALVNDTVGTLAGGRYNDPDVIAAVILGTGTNAAYVERAHAIPKWHGLLPKSGEMVINMEWGNFLSSHLPVTEYDQNLDVESLNPGEQIYEKMISGMYLGEILRRVLCRMAKEASLFGDYVPSKLKIPFILRTPDMAAMHHDESADLKVVGNKLKDILEVPNSTLKMRKIVVELCDIITSRGARLSAAGIVGILKKLGKDTLKDGENQRSVIAVDGALFERYTKFRNCLEETMKELLGDTADSIVIELSNDGSGVGAALLAASPSQYTDLEES

SEQ ID NO: 6129 - protein, 185 aa, Pseudomonas syringae
MSADLEHIRQVMREADCLYTEAEVDAAIARVGAQINAELAERNPVVFCVMNGGLIFSGKLLTHLNFPLEASYLHATRYRNETTGGDLFWKAKPEVSFMDRDVLIIDDILDEGHTLGAIIDFCKHAGARAVHTAVLIDKDHDRKARPDLKADYVGLPCIDRYIFGFGMDYKGYWRNAAGIYAVKGM

SEQ ID NO: 6130 - protein, 254 aa, Unknown
  Synechococcus sp. RS9916
MPDIVGQRRASESRSRFMLSGLSSTPSLTVEQLLERFRTGSARQRRSLIPTVEKRAEELASLGSAALAGFDPKGDDWAAGWLLQVFQRQQPQVLPSLLGASNGWFDAPSAVGIDYSPLQRDLLAEQFEEADRFTSRVLRQLAGPDAEQRGYVYFSEVPPMQGLDLITLDRLWTAYSQGRFGFTAQAKLLAALDGRYERLWPRIGWKQDGVWTRYPGAFTWSLTAPEGHMPLINQLRGVRLMDALLNHPSLEGRR

SEQ ID NO: 6131 - protein, 467 aa, Listeria innocua
MTSVMWFRRDLRVNDNKALYHACKEEDLILLFQVNPEQFIKGSPSHQAFFASVAHFQQELNKNTHLQIMFGEPIELLKQLKEKIPTWDKVFFNRDETGYGASRDEAARAFFADKEITVHSYHDSYLHSAEEVKKSATEYYKIFTPYYKKWREEIKEMPLKVTLKPEKIRKESLFPNYEEQFRELIQDLPAFDSGEKAANTRLANFVKEDLADYDKARDVPALDKTSHLSRYLRTGEISIRTVWQALQKEEATEGRATFEKELCWRDFYNMIYVSFPKQKNEPIQENYRFIEWENNREFFKKWQDGQTGFPLVDAAMRQLKETGWMHNRLRMITASFLTKDLLIDWRFGEKYFQQMLIDYDPASNIGGWQWAASTGTDAVPYFRIFNPTTQSEKFDPDGTFIRKYVKELRDLPDKFIHQPEKMSETEQKEHGLILGKDYPLPIIDHKERRKLAIARYEFSKEHSRGNI

SEQ ID NO: 6132 - protein, 474 aa, Kluyveromyces lactis
MISKIEGISGETLRCGSVRVRDHKLYTGPPAMRLPVTLKRVFETARTNGGTPVKIDQVSGWVKNVRPLKTITFVEIQDGTTLQDLTVVLKQGAPSFKPSLGQSVTVLHPEIVQRKNQQFETLCMPENLKLIGPTVEYPVQNKQTSLPTLRKLPEFKHRTTYLSNLLRFRHKVESQLTKTLDGLDFTMVRPPILTSIDCEGAGEMFNLKQDHWDEIVNLTVSSQLHLEVLMMGLGRVYCLQPCFRAEKSDTNRHLCEFWMLEVEASFVDKNESLMDLVELMVKSVVLSLSETKDLPKYFPVGCNIDITSRWAKLLQDWKRITYTDAVEALLSSGVKFEHDLAWGKDLNSEHERWLCDHFGGPVFVTNYPRDCKAFYMKLRPDGTTVECFDLLFPEIGEIVGGSVREDDYDTLKQEIERRDMASNQLDWYLNLRKEGTVPHGGFGIGIERLVSYLYGNPNIRDSIPFHRTAGQIDL

SEQ ID NO: 6133 - protein, 241 aa, Unknown
  Frankia sp. EAN1pec
MQPLVLERAGRKHLSGHRSMQFGRETTAAEVLQGVDLEGRRAIVTGASSGIGVETARALADAGAEVTLAVRNTEAGGRVADDIIAGTGNKAIFVSKLDLADRASVTGLVEAWNGPLHILVNNGGVMALPQLQRTPEGWEQHFATSHLGHFALALGLRDALAAAGSSRVVSVSSDGHVHANAPVDFDDIRFERRDYSGHRAYAQSKTANILFAVEGAKRWAKDGIAVNALHPAGSRPASSGT

SEQ ID NO: 6134 - protein, 317 aa, Haemophilus ducreyi
MATKHTKLLILGSGPAGYTAAVYAARANLSPILVTGMQQGGQLTTTDEIENWPGEYEQTTGTALMDKMLKHAEKFETEIVFDHIHHVDLSVRPFVLTGDNHSFTCDALIIATGASAKYLGLASEEAFKGKGVSACATCDGFFYRNKPVAVVGGGNTAVEEALYLANIASEVHLVHRRDSFSAEKILLGRLAKRVEQGKIILHTDRVVDEILGDDFGVTGVRLSSTQQNLSEEIAVAGCFIAIGHAPNTAIFEGQLALENGYIKVNSGLEGNATATSVAGVFAAGDVMDHIYRQAITSAGTGCMAALDAERFLDAQAH

SEQ ID NO: 6135 - protein, 831 aa, Streptomyces avermitilis
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 6136 - protein, 265 aa, Aspergillus nidulans
MSTPNIPHQGEFGCPGSFWLGLRTNLDDPEFFDFTEGFGEDFTDPTMLSPHLVPTGIMASKDSLGDVPAGTVSPSDLFMDASAPPSTSFTDLSTPSFDSPGYFSQDTSPVFGADLDLAPGHEEWAPLFPSNDGMSMPFDPTGLEIAAPVPAVKAEPTVSSPTVKPVSSPARSPTATSRSTTKHSTVAGVSARRSKPLPPIKYDESDPVAAKRARNTEAARKSRARKLERQGDMERRIAELSKELEETRQMVEFWKSQAQARARGA

SEQ ID NO: 6137 - protein, 80 aa, Arabidopsis thaliana
  misc_feature (60)..(60): Xaa can be any naturally occurring amino acid
MASSMLSSATMVASPAQAIMVTPFTGIKSTAAFPSTGNAKKYTTSHQKRTVSRVHCKHVXPPIVKKKFETLSYRPDLTDS

SEQ ID NO: 6138 - protein, 855 aa, Mycobacterium avium
MSADGISRDGCAPRHIIVVGHGMVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPACHVYRTLDDLDAIRADAQRAAQTAHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPWVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 6139 - protein, 215 aa, Brucella suis
MRVKKKAGTIKESSRRWLERHLNDPYVHKSRQDGYRSRAAYKLIEINDRYNLLKKGQKIIDLGAAPGGWSQIAARIVGSTDENPQVVGIDYLHVDPLPGVILLEMDFLDDEAPQKLMDALGDKPDLVISDMAAPTTGHRRTDHLRTVHLCEVAADFAVSVLKPGGHFLTKTFQGGTENELLALLKQKFRSVHHVKPPASRAESVELYLLARDFKG

SEQ ID NO: 6140 - protein, 405 aa, Chromobacterium violaceum
MTKPRAVYLQSGGPTAVLNASAQGAIETARRLGLSLYAAYDGLAGLLDGRLCDTDGVSDTAIAQLAFMPGGSFGVSRRMIGTFEEAPEDWLRLRDVLAKHDIHYLLINGGNGSLGCAERLVDFEKHTGYKLGVIGIPKTIDNDLVGTDNSPGYGSSAKFLASAMREVGLDMTSMGWGRVFIMETMGRHTGWLAAACAAASRNPHEAPHLLLLPEVPFDQARFLAALDASLAKYGQCAIAVAEGITGQDGRFVAEAKKSETYGHEQLGGAGHWLAQLILRERGISAHVAQVDYLQRAGGHLASATDVRQAYVMGERAVEWLLAGKTGLMAGIRRLNDHPYCWDVAEVPLSAVGDKEKRLPPEFIGADGFSVTQAFLDYVKPLIEGERIPPFKDGLPDYRPIAWPRV

SEQ ID NO: 6141 - protein, 435 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYESLKRTCRGEYVNVHPHDTECLKFVEEFNKLTNRVCERHILHSCCETETPSCYSYRFMLTTYWANDETVRKALQINKEDLRLQESIGEWTRCYRGIPYNHDIKSSVPYHMNNSIDGYRSLIYSGDHDIQVPFLGTQAWIRSLNYSIIDDWRPWMIKDQIAGYIRGGGHTAEFTPKETFMMFQRWINGQPL

SEQ ID NO: 6142 - protein, 186 aa, Arabidopsis thaliana
  misc_feature (108)..(108): Xaa can be any naturally occurring amino acid
  misc_feature (126)..(126): Xaa can be any naturally occurring amino acid
  misc_feature (167)..(167): Xaa can be any naturally occurring amino acid
  misc_feature (174)..(174): Xaa can be any naturally occurring amino acid
  misc_feature (176)..(176): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXREHGNSPGITMMDGYWTXMWEAFPCSGLHRLPVKVLKEVEEVKEGGPPMPLIRAIGLDXTRKASGXGXIAYKPPRFTG

SEQ ID NO: 6143 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVVGFEMSQNSERLSWTAEEVDSKLHQVMTDIHDGSAAAAERYGLGYNLVAGANIVGFQKIADAMMAQGIAW

SEQ ID NO: 6144 - protein, 290 aa, Brassica oleracea
MATPSEASALSFIKKHLLDESSPLPKVTTTNPWIASETISNFSIFGSFDQTGFDFSEFETKPEITDLVTHRFTDSFESEPEANAEIQLASSESFTFQSNPRGVSGPASRSNRKPPLKIDPPSRTEWIQFATENPQPEQLPVHVAAEEKRHYRGVRMRPWGKFAAEIRDPNRRGTRVWLGTFDTAIEAARAYDQAAFRLRGSKAIVNFPLEVGTWNQRADVGQNKRKRDGEGEEVTVVAKVLKTEESHAVETETSSLTAVDDWDLTELLSMPLLSPLSPHPPFGYPQLTVV

SEQ ID NO: 6145 - protein, 987 aa, Candida albicans
MPSSSDAINRISYISLVTSDNDKFNQTFQFYSQLGFRLTKSFSKVSSYGSGLGANHPEFQLGVSHDSLKEVWLESYPLQNVDSNGNLRPWQEMEVYDGDNCERLNESTVIKVRLLGETPLKSISQKQFVFFTTQLNKIEKILTDANVKYGKVVDNVILAEDPLSNIISFSNTQNELCKTRFQSPEEYVEKTTAEILAKRKKSQLGSKFGSFEEISPSEVGGGNGLRKKKIGVMTSGGDAPGMNPAVRAVVRAGIYYGCDVYAVYEGYEGLVKGGDLLKKMEWSDVRSYMSLGGTSIGTARCKEFRERAGRLQGAYNMIKNGIDALVVCGGDGSLTGADLFRSEWPSLVKELVDTGKLTKEEVSPYEHLTIVGLVGSIDNDMSGTDVTIGAFSALERITEMVDYIGATAASHSRAFVVEVMGRHCGWLALLSGLATGADFVFIPERPPKAGLWKEQLKEVCLRHREYGRRKTTVIVAEGAIDDELNPITSEEVKQVLADLGLDTRNTILGHVQRGGTAVAFDRRLATLQGVEAVKAVLEMTPDTPSPMIGILKHKIVRIPLVDAVKQTKAVAEAISNKDFDKAMSLRDNSFYDDYRYFRDISIYDDGSKQLSEDKRLNIAIVHVGAASAGLNAATRAVALYSLSRGHKLYAVQDGFAGLVKGDLKNLTWMDVEGWHSLGGSEIGTNRSLPSQNIGKVAYNLQKFNIQGLLIVGGFEAFTSLHELSEQKANYPIFEIPMVVVPATVSNNVPGTEYSLGADTCLNQLVSYCDAVQQSASSTRRRVFVVEVQGGHSGYVASYCGLITGALATYTPESNINLRELQGDIDLLQKVFATDRGEDHNGTLIVRNEQASAVYSTQLIADILKENANKRFETRTAIPGHVQQGFTPSANDRVMAVKFSLKAMEFIETRNGCYGKHDRKFSDEEISEHSQVVIGIHGDVVKFTCIKHLYDNEANVALRKGKTVHWTDMIDVANILNGKSLLKKQERY

SEQ ID NO: 6146 - protein, 181 aa, Idiomarina loihiensis
MANNEYEQATLGGGCFWCVESAFLQVKGIQSVKSGYTGGHTIDPTYEQVCSGETGHAEVAQLQYDPEQISYRQILEIFFTLHDPTQVNRQGNDVGTQYRTSIFYHNDAQKREAESIIAELEADAAFAAPIVTEVTELGTFYPAENYHENYYARNPENPYCQAVISPKLAKFRKTFAGLLKD

SEQ ID NO: 6147 - protein, 630 aa, Mesorhizobium loti
MCGIFGIVLKNEGTPVCAAAVERCADALAHRGPDASGLYINQSVAFAHRRLSIVDAHSRANQPYRDANTGVVVTYNGEIFNYREIKAELRDMGFSFSTVSDTEVLILSYIAWGKSFLNRLDGIFAFALFDPRKSLVLIARDRLGVKPLYYTICDVGLLFASQPNALIRWPGVMHGPDMIGALSFLSYRAVVGARTLFAGISKLEPGHLLEIRNGRHTSERWWNLSARISRSKPDYSDIRRLFGSAVERQLVADVPVAALLSGGLDSSILAYEASARSQIRPVCYTGKVETPDYDETAYAMEVAAEFGLTHRVVPIGEPSDINAVAELVRLRGHPLGMHNETAMFTLAKAISKEHKVVLTGEGADEIFAGYSRLFRTPYDYNRSKIITALPPALAQIARRRLGLGVHCSQLQFFLERYSYFPADEIRSLAIDGQMRTEHEMELFDHFSTQFAEAGGDFFSKISYVLVSTHLPALLEMVDNTTMAAGLEARVPYTDHQLVTAAMAMPGSQRLRWRSPIASAQALWHPVASFSERLDVSKYPLRREYRSVLPKSVLSRKKMGFPLPLGQWAVGEGATEYRRLLFDKDSPLGDLFDPAALRRWFKAGRRNPSDSFGRKFWLLANLGIFFKEVFS

SEQ ID NO: 6148 - protein, 181 aa, Antirrhinum majus
MAAKISSDPLVIGRVIGDVVDHFTSTVKMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 6149 - protein, 642 aa, Arabidopsis thaliana
MDEETMATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 6150 - protein, 1016 aa, Zea mays
  misc_feature (67)..(67): Xaa can be any naturally occurring amino acid
SSSGATLAVRSACPLSPARTATLLSSLLPLCLRIRSARRCTAADAAAAGNATALPTLAGASADPSGXLCAHGTPVAAGCSRACLSRDATDTRVICLYRSCLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLRSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKQQQQQEGPHDSPPQQDLLSI

SEQ ID NO: 6151 - protein, 148 aa, Vicia faba
MEFTLRQEALVNSSWEAFNQNLPLFSVLFYTFILEKAPIAKNMFSVLKDANEIPLANPSINAHTEMVFEMVRDAAAQLQTTGQVVLGDTTLGVVHTQKRVDGLHFMVVKEALLKTIKEAVGDKWSEELSNAWEIAYDGLAVAIMKEMS

SEQ ID NO: 6152 - protein, 206 aa, Buchnera aphidicola
MISKKKSNSSNRWLSEHFQDQYVKEAKKQKIRSRSWFKLEEIDKNNRLFKPGMNVLDLGSSPGGWSQYAAKKIGKKGYILACDILPMKKIKGVDFFQGDFCNKKTLNLILTNLSNVNLNLIMSDMAPNITGCSSIDMPRIIEICKTVFTISDHVLSRNGVVLVKSFQGEGFNEFFAQMKNLFSKIKICKPKTSRSRSREIFMLATR

SEQ ID NO: 6153 - protein, 181 aa, Antirrhinum majus
MAAKISSDPLVIGRVIGDVVDHFTSTVQMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 6154 - protein, 474 aa, Oryza sativa
QRKKNLPSKRTANRLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 6155 - protein, 112 aa, Nostoc punctiforme
MKKVEAIIRPFKLDEVKIALVNAGIVGMTVSEVRGFGRQKGQTERYRGSEYTVEFLQKLKVEIVVDDNQVDMVVDKIIAAARTGEIGDGKIFISPVEQVIRIRTGEKNTEAV

SEQ ID NO: 6156 - protein, 365 aa, Nicotiana plumbaginifolia
MSTLHKHNTPQMAAITLLGLLLVASSIEIAGAESIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFVDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLKNLIQHAKEGSPRKPRPIETYIFAMFDENNKNPELEKHFGLFSPNKQPKYNLNFGVSGSVETNATASLISEI

SEQ ID NO: 6157 - protein, 349 aa, Yarrowia lipolytica
MTETLRTQCTWLGLYFFFNLALTLFNKAVLGSFPFPYTLTGIHTLCGTLGCALLHWRGVFKLTRLSDQENTTLILFSILYTINIAISNVSLQMVTVPFHQVVRATTPFFAMLINVVFLRHSYTVLTYLSLVLVCAGVGFATAGDYYFTAMGFILTILGAVLAAVKTVVTNRIQTGRFRLSPLELLYRMSPLAFVQTLVYAYLAGELDVLGLRLSSPEDVVGATASATSGPLSFLGGIDYTEIEFEYSQKLMLHLLLNGIIAFGLNIVSFTTNKKTGALTMTVAANVKQILTIVLAIFFFNLTVTPLNMMGILVTLLGGAWYAKLELDRKSDNSGAESALPVKEANRSQA

SEQ ID NO: 6158 - protein, 262 aa, Rhodospirillum rubrum
MALPTFSMRQLIEAGCHFGHNTRRWNPKMAPYLYGQRDNVHIIDLQQTVPMLYRAMQAVRDVTAGGGRVLFVGTKRQAQDVVAEHARRCGQYYVNHRWLGGMLTNWKTISHSIKRLRDLEERFGGGDLLGLTKKEQLNLGREKDKLDMALGGIKEMGGLPDMLFIIDTVKESLAVNEANKLGLPVVAVIDSNSDPRGITYPIPGNDDAIRAIQTYCELISGAAIDGIQAQLGAAGVDVGAAEIVPAETLAAEAPAAEQQPTA

SEQ ID NO: 6159 - protein, 348 aa, Phaseolus vulgaris
QIGVCYGMMGNNLPSANEVINLYRSNNIRRMRLYDPNQAALQALRNSGIELILGVPNSDLQGLATNADTARQWVQRNVLNFWPSVKIKYIAVGNEVSPVGGSSWYAQYVLPAVQNVYQAVRAQGLHDQIKVSTAIDMTLIGNSYPPSQGSFRGDVRSYLDPIIGYLLYASAPLHVNVYPYFSYSGNPRDISLPYALFTSPNVVVRDGQYGYQNLFDAMLDSVHAAIDNTRIGYVEVVVSESGWPSDGGFGATYDNARVYLDNLVRRAGRGSPRRPSKPTETYIFAMFDENQKSPEIEKHFGLFKPSKEKKYPFGFGAQRMQRLLLMSSMQHIPLRVTCKLEPSSQSLL

SEQ ID NO: 6160 - protein, 239 aa, Prochlorococcus marinus
MFPSWLTPKASKEAAIPSGTQQHAVLGTRLNDPLTTDQEDALFACGCFWGAEKGFWKLPGIITTAVGYAGGHQEQPTYQEVCSGRSGHTEIVRVVWNKSVIDYSDLLKLFWECHDPTQGNRQGNDRGSQYRSAIYTTTIQQIELAQASRDSFQQLLSKAGFGAITTEIKADQQFHYAESYHQQYLAKPGSRPYCSAMPTQVALNDFPGANFKLPVSVWQEYDWSVSHCVLRSGNEKIKL

SEQ ID NO: 6161 - protein, 351 aa, Nicotiana tabacum
MALWYLFNKRSLGAAVLILVGLLMCNIQMTGAQSNIGVCYGKIANNLPSEQDVINLYKANGIRKMRIYNSDTNIFKSLNGSNIEIILDVPNQDLEALANSSIANGWVQDNIRSHFPYVKFKYISIGNEVSPSNNGQYSQFLLHAMENVYNALAAAGLQDKIKVTTATYSGLLANTYPPKDSIFREEFKSFINPIIEFLARNNLPLLANIYPYFGHIYNTVDVPLSYALFNQQGTNSTGYQNLFDALLDSIYFAVEKAGGPNVEIIVSESGWPSEGNSAATIENAQTYYRNLVNHVKGGAGTPKKPGRIVETYLFAMFDENEKNGEVTEKHFGLFYPNRTAKYQLNFMYSDT

SEQ ID NO: 6162 - protein, 756 aa, Oryza sativa
MAASSSLDLVKTMAASGFLLRCPAAPSAVPLWGRSGRGGGGGLAFSASSSNGAAVPSSLSDSEKKGPVVMEIPLDKIRRPLMRTRANDPAKVQELMDSIRVIGLQIDVLEVDGVYYGFSGCHRYEAHQRLGLPTIRCKAPYAMKLEWTYYFSQKAKTTVRKAAALARAQTAAHASGEETGMAAVEEEGRWEPTAAAAEEEEMGVEAEEAMEDGEVEGEVGQQQQEEEGNGDAGKSEEHGSAGGRMVWKKKHHHHHQPRTPVAAESRATWRGGKGSGKGRGGGGGGGGFHHCPWNLQPDNLNRFNKPGVYGGAIIICNHMTKRGFFEKKLFGLPGYAATFIKKIRVGMLLFVFELGERKLYGVFEATSNGALDILPNAFTSLRKPRPAQVLFRRIWFCKPLAETEFSSAIKGNCLYPQMSFFGISYQQVLNLVHLFASKRIELQPYQKPKSRVIYDYKISLAHLGREFSPRTHNKTFSSHSSSTFCNNRFSLPRSSYLYTKQNAKHDACKYESPLHSPLKSVIFKAPDVKGESLEPNPDYIPLELDDSKSDSDADPSDSLETVSFYPTLEGCISYEDQDLKPFNGKFNGDDGHHSHVLIRGLNSECETDRNSVFSRNVKERQSSLAKGGKGCKRKAIVEFDEQSSPRRGCTMKRVSFSFSGEEISVTSEKSLHRPTAFAELPNTRESSAEEGKQEVGCVVQKARSKGEDVSAKIKLMGLSLPEALRTNRVHSCSSNSQSLVTQTGINLTCTLLTDKE

SEQ ID NO: 6163 - protein, 423 aa, Rhodospirillum rubrum
MDQITEFQLDINRALKETLALVLAGGRGSRLRDLTNRESKPAVPFGGKYRIIDFPLSNCMNSGIRRMCVITQYRAHTLIHHIQRGWGFLRAEIGEFVELWPAQQQTDKESWYLGTADAVHQNLDLIRMHDPRFVLILAGDHIYKQDYSKLLAHHIARGSDCTVACVDVPREEATGYGCVEVDNDDNIVHFLEKPANPPGIPGRPDRAFASMGIYIFNADFLYEILESDALNEASQHDFGRDIIPSQVGKARIVAHRFSQSCVYSVGRREPYWRDVGTVDAYWSANIDLVSVTPALDLYDADWPIWTYQMQRPPAKFVFDTDERRGMAKDSLVSAGCIVSGGAVTGSLLFNDVRVNSYSSVIDTVILPMGDIGRHARLTKCILDTGCRIPEGLVIGEDPILDAKRFHVTEQGITLVTPDRLALL

SEQ ID NO: 6164 - protein, 351 aa, Nicotiana tabacum
MALWYLFNKRSLGAAVLILVGLLMCNIQITGAQSNIGVCYGEIANNLPSEQDVINLYKANGIRKMRIYYPDTNIFKALNGSNIEIILEVPNQDLEALANSSIANGWVQDNIRSHFPYVKFKYISIGNEVSPTNNGQYSQFLLHAMKNVYNALAAAGLQDKIKVSTATYSGLLANTYPPKDSIFREELKSFINPIIEFLARNNLPLLANIYPYFGHIYNTVDVPLSYALFNQQETNSTGYQNLFDALLDSIYFAVEKAGGPNVEIIVSESGWPSEGNSAATIENAQTYYRNLVNHVKGGAGTPKKPGRIIETYLFAMFDENEKQGEITEKHFGLFYPNRAAKYQLNFMYSDS

SEQ ID NO: 6165 - protein, 412 aa, Glycine max
  misc_feature (185)..(185): Xaa can be any naturally occurring amino acid
ILATSIVASGAYADDLDNSDGLIYTGQGGNVMNTDKEPEDQKLERGNLALKNSIEEKNSVRVIRGSESMDGKCRIYVYDGLYVVESCWQDVGPHGKLVYKFRLRRILGQPELALKEVKKSKKFKTREGVCVDDISYGKERIPICAVNTIDDENPPPFNYITSMIYPNCHVLPAEGCDCTSGCTRXDLEKCSCVVKNGGEIPFNHNGAIVQAKPLVYECGPTCKCPSTCHNRVSQLGIKFQLEIFKTDTRGWGVRSLNSIPSGSFICEYIGELLEDKEAEQRTGNDEYLFDIGNNYSNSALWDDLSTLMPDVHTTSCEVVKDGGFTIDAAQFGNVGRFINHSCSPNLIAQNVLYDNHDTRMPHIMFFAADNIPPLQELTYDYNYEIDQIRDSGGNIKKKYCYCGSVECTGRMY

SEQ ID NO: 6166 - protein, 227 aa, Brassica napus
  misc_feature (141)..(141): Xaa can be any naturally occurring amino acid
MGTPESSREPCPDRILDDIGGAFGMGAVGGGAFHFIKGTYNSPKGSRFMGGRQAVTMNAPRLGGSFAVWGGLFSTFDCSMVYLRQKEDPWNSIFAGAATGGFLAMRQGPSSAVRSALFGGVLLALIEGAGIALNKMLAQPXQHMQMEEGMMPGMPGMQMGQVPGMQMPSQVQAQAIPEDTSSSSPSSWLGGLFGKKNDEAQGQTSSGSETKVLESFDAPPVPSFEYK

SEQ ID NO: 6167 - protein, 238 aa, Prochlorococcus marinus
MTEEKSHPSKESIEEFLGAFRMASERKRLGLLNRLEERVEELLGLGSTLMSGFDPGICDWTPGFILQLIHKTDKDFIRNTLNCDNLSWFDSPSDVGFDYSPLQRFLLNESYEDADRFTSLKLRELAGEKAVKRGYVYFSEVESIPSIDLSTLDKLWVVYSRGKFGFTVQAKILDSLGGRYDKLWLRIGWKKDGIWTRYPKAFNWSIEAPNGHMPLVNQLRGVRLMDALLNHQGFKAKS

SEQ ID NO: 6168 - protein, 495 aa, Ustilago maydis
MTARRYTQGVRCSTGDAVDGRVRGRDKKGKAKQMSAEDAVGLQGQMRRPVSSMSGLAWRPTGVVRTASMWSKRRCLVDARWTGWLLSHGVHTFTGAMNAARTSSARSSSVSSTGPSTSPTAPVAPASSSPYSPATPASLAGLGTTQLSPDIMLRCTIFDSTGSATSTSGVFKKSRLCSDHGLEPRDLRKIDSRVPNLVPTILVRRGGILVNILHIRAMIKKDKVLLFDSYGSTDSQLHSAFVYNLQHNLRPPHQNAHQHTSTSSSPGALAYEFRALESILVSVLDALRIELGVVRGWTSEVLEQLDDDVDRDKLRTLLQVSRKLNAFLSRSKAVKNAVVEVLENDEDMQLMHLSSIPPSASTDKGCASSNDAHTSSANTSSSCDATASNDGSQAMDELELLLESFDKQVEEVVAETTQLHSDMTNTQEVVELILDNNRNKLLALDLKTSIATMGISAGTLWAGLFGMNLKSHMEELDWAFAGTRKVAQGGLGHEG

SEQ ID NO: 6169 - protein, 842 aa, Glycine max
SMSCKDGSRNGIGMDNGKYVRYTPEQVEALERLYHDCPKPSSIRRQQLIRECPILSNIEPKQIKVWFQNRRCREKQRKESSRLQAVNRKLTAMNKLLMEENDRLQKQVSQLVYENGYFRQHTTQNTKQQPTKDTSCESAVTSGQQHNLTTQHPPRDASPAGLLSIAEETLAEFLSKATGTAVEWVQMPAAARRRQKGGIVAISHSCTGVAARACGLVGLEPTRVAEILKDRPLWFQDCRAVDVLNVLPTANGGTIELLYMQLYAPTTLAPARDFWLLRYTSVLEDGSLVICERSLKNTQNGPSMPPVQHFVRAEMLPSGYLIRPCEGGGSIIHIVDHMNLEPWSVPEVLRPLYESSTVLAQKTSIVALRHLRQISHEVSQSNVTGWGRRPAALRALSQRLSRGFNEALNGFTDEGWTTIGNDGVDDVTILVNSSPDKLMGLNLSFANGFPSVSNAVLCAKASMLLQNVPPAILLRFLREHRSEWADNNMDAYTAAAIKVGPCSLSGSRVGNYGGQVILPLAHTIEHEEFLEVIKLEGIAHSPEDTIMPREMFLLQLCSGMDENAVGTCAELISAPIDASFADDAPLLPSGFRIIPLESGKEASSPNRTLDLASALDIGSSGNRASNECAGNSSYMRSVMTIAFEFAFESHMQEHVASMARQYVRSIISSVQRVALALSPSHLSSHAGLRSPLGTPEAQTLAHWICNSYRCYLGVELLKSNNEGNESLLKSLWHHSDAILCCTLKALPVFTFSNQAGLDMLETTLVALQDTPLEKIFDDHGRKILFSEFPQIIQQGFVCLQGGICLSSMGRPVSYERVVAWKVLNEEENAHCMCFMFMNWSFV

SEQ ID NO: 6170 - protein, 488 aa, Haemophilus ducreyi
MLGCLSVSAWAETPTNQPESLTDKALKHEKLGVVVESANHKFAEKYRLQYDSWKATAESTDRSSALEADPRLVVLWAGYAFAKEYNKPRGHYYAVTDVREILRTGAPKDENDGPQPMACWTCKGPDVPRLIEEKGERGYFDPKWAKYGAEIVNSIGCADCHDTTSKAFEEGKPALRVARPHVLRALESVGWRFEDLDKHGKRVAVCSNCHVEYYFKDKKDVTFPWAKGVDVDSIEKYYDESQFTDWTHALSKAPMLKTQHPDFEVWSQGVHGKNGVTCIDCHMPKVKDKDGKVYTEHKIGNPFDRFDATCKTCHEQSKQTLQDRVKEHKAQVKEAMIRLEDQIVKAHFEAKVAWDAGATAEEMQDILMAIRHAQWRWDYSAAGHGNHFHAPDVMLHTIATGLDRVADARAKLGVVLTKHGVETPIVMPDISTREKAQKAVGIDIAKDQAAKDEFLRTVVPQWERQARERGLLPEVTPKSVTTPKVDAK

SEQ ID NO: 6171 - protein, 987 aa, Streptomyces avermitilis
MTEGEAVGVPAQGCPSKVASDQEASAMTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 6172 - protein, 477 aa, Brucella suis
MPVSLSQTRLLADFPAFFRVSGEVVAVVGGGEEALNKARLVAQTAARLRIIAEKAEPHLAAFIESHGVEHIASPFAPELLDGAKLVFVATGDEAGDRAAAAAARARKIPVNVVDRPALCDFLTPAIVNRAPVTIAIGSQGTAPVLAQMVRARIDAAFSPRLGELAHFAESWRPLVERALPKGLARRGFWRTFFSGKVARAVESGDHEAAHRAAAELIGQGQDASGHVWLVGAGPGAEDLLTLRAQRVLMEADVIVHDALVPEGVIAMGRRDAERLPVGKRKGCHSKSQDEINRLLVKLGQEGKRVVRLKSGDPLVFGRAGEEMAALRAAGIGFEVVPGITSAFAAAADMELPLTLRGVASSLVFTTGHDMTGDVLPGWAKLAVSGATIAVYMGSTVAASVASRLIAAGLHEDTAVAVVENASRSNKRMFHGTLKDLPQLENRKELSGPVMVVIGDAVAGAAIGRAQALSLKPVPVAA

SEQ ID NO: 6173 - protein, 469 aa, Streptococcus pyogenes
MVSVMWFRRDLRIDDQKALAHAIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYPQPIVDHAKQREQAIAKYEWAKEKAKIE

SEQ ID NO: 6174 - protein, 274 aa, Unknown
  Pseudomonas sp. MCI3434
MKIELVQLAGRDGDTAYNLSRTLNAIATCAGDTDLLVFPETYLSGFVGGAQLAQVAEPLHGTTLQTLLQAVRQRDVAVVLGFAEVHQGRFYNSSVLVTPEGIALQYRKTHLWPSERSDFSPGDRFTTVLWRGVRVGLLICYDIELPETSRALAQLGAEVVIVTNGNMDPYGPVHRTAIMARAQENQLFAVMVNRVGAGDDGLVFAGGSMAVDPFGRVLFEAGRDEVRHVVELDLDQLKAARRDYDYLKDRRLMLSGEQTEHPDGRRELLIGASQ

SEQ ID NO: 6175 - protein, 298 aa, Bacillus halodurans
MEIGLIGLGRMGYNLGLNILDHEHQLVAYDVNREAVKEIGLAGAKEADSLEELVSKLSAPRKIWVMVPAGDITENVVSQLSSLLDEGDVVIDGGNANYKDTLRRAKQYEAKGLHFVDAGTSGGIDGAREGACLMVGGTKEVVESLAPLLKEIAVEDGYLYTGPVGSGHFLKMIHNGIEYGMMQAIAEGFDLLENSPFDYDYEAVAKVWNNGSVIRSWLMELTESAFSKDANLEKIRGVMHSSGEGKWTVETALDLQIEAPVIALSLMMRYRSLRDDTFSGKVVAALRNEFGGHAVVKS

SEQ ID NO: 6176 - protein, 181 aa, Rhodobacter sphaeroides
MPTRPYVIDQLISPKQIAARVEVLARQITEHFAETEKLVVVGLLRGSFVFIADLVREIHLPVEVDFLEASSYGDAMTSSREVRILKDLRGEIAGRDVLVVEDIVDTGFTLSHVVRLLRSREPKRLEVCALLDKPSRREVDIRATWTGFEIPDEFVVGYGIDFAQRNRNLPFIGKVRFLEEG

SEQ ID NO: 6177 - protein, 425 aa, Unknown
  Shewanella sp. MR-7
MSQTNQAQYLQQLGSQAKQASYALANLSAAQKADLLEAIAEALTQNIQAILAANAKDVAAAKAEGLNDAMIDRLLLNESRLAGIIGDIGDVVRLADPVGEEFGSRVLDNGLRLTRRRVPLGVIGVIYEARPNVTVDIAVLALKTGNAVILRGGKETLESNKLISEVIRGAIASQGLPVDAVQLIDSPDRALVTGLLKLDQYVDMIVPRGGQALQRLCAEQATIPVILGGIGICHLYVDKHADLERALEVIANAKVQRPTVCNALDTLLVDNAVAERFVPQIAEYLHRLGVRFSVCEQSYALLDGLGFDISPATEQSFATEWLSLTLGIKVVNGIDTAIAHIRTYSSGHSEAILTDDIHAATHFMNEVNSAAVYVNASTRFTDGGQFGLGAEVAVSTQKLHARGPMGLEALTTYKWLAWGDYTSRA

SEQ ID NO: 6178 - protein, 140 aa, Roseovarius nubinhibens
MKYLHTMVRVKDLEASMRFYELLGLRETRRYDSEEGRFSLIFMAPPGQEDCPVELTYNWDGDDALPSDSRHFGHLAYEVENIYATCQYLLDNGVVINRPPRDGRMAFVRSPDNISVELLQAGDPLPAEAPWSAMENTGHW

SEQ ID NO: 6179 - protein, 349 aa, Glycine max
MAPNLECRMYEAKYPEVDMAVMIQVKNIADMGAYVSLLEYNNIEGMILFSELSRRRIRSVSSLIKVGRIEPVMVLRVDKEKGYIDLSKRRVSEEDIQACEERYNKSKLVHSIMRHVAETLNIDLEELYIHIGWPLYRKYGHAFELLSKLHSMQAFKIIVTDPDTVLSTLTREVKEVGPDGQEVTSVVPAVSEEVKDSLVKNIRRRMTPQPLKIRADIEMKCFQFDGVLHIKEAMRKAEAVGNDDCPVKIKLVAPPLYVLTTQTLDKEQGILVLNNAIASCTEAIEQHKGKLVVKEAARAVSERDDKLLAEHMAKLRQDNEEVSGDEDSEEEEDTGMGEVDVDNGAGITE

SEQ ID NO: 6180 - protein, 322 aa, Staphylococcus epidermidis
MKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 6181 - protein, 94 aa, Secale cereale
DDDKQFTMSEVRKHGSKDSAWIVVHGHVYDCTGFLKDHPGGADSILINAGTDCTEEFDAIHSDKAKALLDAHRIGELITTGAGYNSDNSVHAAP

SEQ ID NO: 6182 - protein, 253 aa, Rhodobacter sphaeroides
MDMALPEFSMRQLLEAGVHYGHQTARWNPKMAEFIYGDRNGIHIVDLTQTVPMLDQALKVVRDTVAKGGRILFVGTKRQAQKPIAEAAEKCAQHYMNHRWLGGTLTNWKTVSQSIQRLKQLDEVLATGAEGLTKKERLNMEREQQKLQASLGGIREMGGTPDLLFIIDVGKEDLAIAEAQKLGIPVVAVVDTNNSPKGVDYVIPGNDDAARAIALYCDLVSRAALDGMSAQMGAAGIDLGALDVAPEEETLEA

SEQ ID NO: 6183 - protein, 472 aa, Shigella flexneri
MTTHLAWFRQDLRLHDNLALAAACRNSSARVLALYIATPRKWETHNMSPRQAELINAQLNGLQIALAEKGIPLLFREVDDFVASVEIVKQVCAENSVTHLFYNYQYEVNERARDVDVERALRNVVCEGFDDSVILPPGAVMTGNHEMYKVFTPFKNAWLKRLREGMPECVAAPKVRSSGSIKPAPSITLNYPRQSFDTAHFPVEEKAAIAQLRQFCENGAGEYEQQRDFPAVEGTSRLSASLATGGLSPRQCLHRLLAEQPQALDGGAGSVWLSELIWREFYRHLMTYYPSLCKHRPFIAWTDRVQWQSNPAHLQAWQKGKTGYPIIDAAMRQLNSTGWMHNRLRMITASFLVKDLLIDWREGERYFMSQLIDGDLAANNGGWQWAASTGTDAAPYFRIFNPITQGEKFDREGEFIRRWLPELRDVPGKAVHEPWKWAQKAGVKLDYPQPIVEHKEARVQTLAAYEAARKGK

SEQ ID NO: 6184 - protein, 464 aa, Mycobacterium leprae
MRIAQHISDLIGGTPLVRLNSVVPAGTGVVAAKVEYFNSGGSSKDRIAAKMIDAAEASGQLKPGGTIVEPTSGNTGVGLALVAQHRGYKCVFVCPDKVSEDKRNVLLAYGAEVVVCPTAVPPDDPDSYYSVSDRLVAKIDGAWKPDQYANPAGPASHYETTGPEIWADTDGRVTHFVAGIGTGGTITGVGRYLKEVSGGLVRIIGADPEGSVYSGGTGRPYLVEGVGEDFWPAAYDPMVPDQIIAVSDSDSFNMTRRLAREEAMLVGGSCGMAVVAALQVAEEAGPAALVVVLLPDGGRGYMSKIFNDAWMSSYGFLRSRLDGSTEQPIVGDVLRRKSGALPDLVHTHPSETVRDAIGILREYAVSQIPVVGAEPPVMAGEVVGSVSERELLSAVFEGRASLADAVSEHMGPPLRLIGDGELVSVAGEALRDSDALMVVEKGKLVGVITRYDLLGFLSEGAPLR

SEQ ID NO: 6185 - protein, 370 aa, Nicotiana tabacum
MSTSHKHNTPQMAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFVDAIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 6186 - protein, 370 aa, Nicotiana tabacum
MSTSDKHNTPQMAAITLLGLLLVASTIEIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFTDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNLNFGVSGGVWDSSVETNATASLISEM

SEQ ID NO: 6187 - protein, 541 aa, Roseovarius nubinhibens
MFKVQDELKARGEAARARGILPLFEEDAGRAEAFSIGFDGLLFDYAKTHLDREDRAALLGWAEAAGVAARRDAMFSGARINETEGRAVLHTALRNLEGGPVEVDGRDVMPEIRDTLERMKRFARRVRAQSYKGAGGEITDVVNIGIGGSHLGPEMAVRALETFRQGPRCHFLSNVDGADAADILDHLDPRQTLVIVASKSFTTQETMTNAATVRDWMATAVDNPAKQFVALSSSKEKTAEFGVPPEQVFDFGDYVGGRYSVWGPIGLSLMIAIGPEAFGMMLRGGAAMDRHFREAPLAENMPVMLGLVGLWHHQVMGFPTRAVLPYAQRLERLPAYLQQLEMESNGKRVRMDGRTLDLPSGPVVWGEPGTNGQHAFYQLIHQGTQVVPCEFIVAAEGHEPTLAHHHRLLLANCLAQSEALMRGRDMATAQALMAEAGYEGAERDRQAAHRVFEGNRPSVTLMIDQLTPYRLGQIIALYEHRVFVEGVMLGINSFDQWGVELGKELARALEPVLAGEESAEGKDGSTRALVAYAQRFWARER

SEQ ID NO: 6188 - protein, 206 aa, Unknown
  Oceanobacter sp. RED65
MARSKSSKQWLNEHVNDVYVKRAQNDGYRSRASYKLLELIEKDKLVRPGMVTMDLGSAPGGWSQVLAPIVGDKGRVIASDILPMDAMAGVDFIQGDFTEDEVFDEIMAKLDNAPVDLVVSDMAPNISGVNAADQASSMYLVELALDMARQVLKQNGSFVAKVFQGAGYEEYLKDVRSSFNKVLIRKPDASRPRSREVYVVAKGFKG

SEQ ID NO: 6189 - protein, 343 aa, Nicotiana tabacum
MTLCIKNGFLAAALVLVGLLICSIQMIGAQSIGVCYGKHANNLPSDQDVINLYNANGIRKMRIYNPDTNVFNALRGSNIEIILDVPLQDLQSLTDPSRANGWVQDNIINHFPDVKFKYIAVGNEVSPGNNGQYAPFVAPAMQNVYNALAAAGLQDQIKVSTATYSGILANTYPPKDSIFRGEFNSFINPIIQFLVQHNLPLLANVYPYFGHIFNTADVPLSYALFTQQEANPAGYQNLFDALLDSMYFAVEKAGGQNVEIIVSESGWPSEGNSAATIENAQTYYENLINHVKSGAGTPKKPGKAIETYLFAMFDENNKEGDITEKHFGLFSPDQRAKYQLNFN

SEQ ID NO: 6190 - protein, 418 aa, Arabidopsis thaliana
  misc_feature (363)..(363): Xaa can be any naturally occurring amino acid
MISLNLSPSLNPGLLHKTRTCQQPTRLSALLVTNPKPFNHRHPLGLSPIPNLQIRDVSAKPLLSLTNPESSSGFSRKPRSIAAVGSSDSNPDEKSDLGEAGKKEKKAKTLQLGIVFGLWYFQNIVFNIFNKKALNVFPYPWLLASFQLFAGSIWMLVLWSFKLYPCPKISKPFIIALLGPALFHTIGHISACVSFSKVAVSFTHVIKSAEPVFSVIFSSLLGDSYPLAVWLSILPIVMGCSLAAVTEVSFNLGGLSGAMISNVGFVLRNIYSKRSLQSFKEIDGLNLYGCISILSLLYLFPVAIFVEGSHWVPGYHKAIASVGTPSTFYFWVLLSGVFYHLYNQSSYQALDEISPLTFSVGNXTMKRVVVIISTVLVFRNPVRPLNALGSAIAIFGTFLYSQATAKKKKIEVGGDKKN

SEQ ID NO: 6191 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKEVVGDKWSEELNTAWTIAYDELAIIIKKEMKDAA

SEQ ID NO: 6192 - protein, 147 aa, Medicago sativa
MSFTDKQEALVNSSWEAFKQNLPRYSVFFYTVVLEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 6193 - protein, 147 aa, Medicago truncatula
MSFTDKQEALVNSSYEAFKQNLSGYSVFFYTVILEKAPAAKGLFSFLKDSAGVQDSPQLQAHAEKVFGLVRDSASQLRATGGVVLGDAALGAIHIQKGVVDPHFVVVKEALLKTIKEAAGDKWSEELSTAWEVAYDALATEIKKAMS

SEQ ID NO: 6194 - protein, 325 aa, Staphylococcus aureus
MSVEEYGKVYLIGAGPGNPNYLTKKAERLIREADVILYDRLVNPLILQYANLTTEIIDVGKKPYAKHIQQEKINDCIVEAARRYNKVVRLKGGDPAIFGRVQEEVDTLNEHHIAFEIVPGVTSASAAVATMQTGLTMRTVAKSVTFSTGHFKDSEENEVDVNSLVNGGTLAIYMGVKRLGKIITQIQQYTDIDYPIAIVFQASCFNEFVVKGRLSNIISKLQHYSIEAKPGICIIGEVVGYTENVSTTSNPTQQFYVVSGSKHDALMLCEHLYDEGYGCLLNPNNTSNGTYHSSQYDYYDAFIKQQENVTYISTDRADANTVLCH

SEQ ID NO: 6195 - protein, 419 aa, Thellungiella halophila
MPTSSGAAALDRSLNSGAFKPLEIPSTKPLHWKPPISDVAKFESNQQKEKTFSRPQMSPSLYATPKEIPLPFSPSSSPPSPYICCHKARWPILLKSSSELDLPCHPNTLIADAEGTTSLRSFPISQAIAEDHTNGVHDRPVWDCSPPHRKLWNDNSANNGLEWESYLLESVRMKANKSEDFCTTAQSVSEFTSDTGLEDDAGAENSHKLFSSGGEFYDARDELSTDSGTQSSVNHIESELRGMRLSLLMEIERRRQAEETLEKMQLHWRRLREQLAHVGLFVPLDPTSSQYSMNIADELRCQLEVARFVSDSVGSDLAKAEVEMEMESELEAKNFEITRLSDRLHYYETCFNTLDTRDGKARRAKEKEEAEMDLGINCCNHHAWWCSLGLAVPPFINGCSSVISNRLMRLPNQIMRTKL

SEQ ID NO: 6196 - protein, 322 aa, Staphylococcus aureus
MKKIAVLTSGGDSPGMNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQYINVDNRVSVLGHVQRGGSPTGADRVLASRLGGYAVDLLMQGETAKGVGIKNNKIVATSFDEIFDGKDHKFDYSLYELANKLSI

SEQ ID NO: 6197 - protein, 363 aa, Spinacia oleracea
MAISAIGFEGFEKRLEITFFEPSIFVDPEGKGLRALCKAQLDEILGPAECTIVDSLANESVDSYVLSESSLFIYAYKIIIKTCGTTKLLRAIPPILRLAGKLSLDVKSVRYTRGSFIFPGAQSYAHRSFSEEVAVLDGYFGKLAAGSKAFVMGDPAKPQKWHVYSASAETISFEEPVYTLEMCMTGLKKEKASVFFKSQSPNAAVMTESSGIRKILPDSKICDFDFEPCGYSMNAIEGPAISTIHITPEDGFSYASFEAVGYDLKKTDLNQLVERVLACFEPSEFSIAIHAEIAANSMEHNCYVNVNGYSREEGGIEELGFGAASVFYQKFCKASTGFGATNKPKPALKCCWKEDKFEEEKDY

SEQ ID NO: 6198 - protein, 242 aa, Idiomarina loihiensis
MANVSMRDMLKAGVHFGHQTRFWNPKMKPYIFGARNKIHIINLEKTVPMFNDALSYMQHVASNKGKILFVGTKRAAAEAVKEAAINCGQYYVNHRWLGGMLTNWKTVRQSIKRLKDLETMSQDGTFEKLTKKEALVNTREMEKLEKGLGGIKNMGGLPDVLFVIDADHEHISIKEANNLGIPVVSVVDTNSNPDGVDYIVPGNDDAIRAVQLYLNTAAEAVKEARTAQVEAKDSDDFVEATE

SEQ ID NO: 6199 - protein, 496 aa, Arabidopsis thaliana
MGKVAVGATVVCTAAVCAVAVLVVRRRMQSSGKWGRVLAILKAFEEDCATPISKLRQVADAMTVEMHAGLASDGGSKLKMLISYVDNLPSGDEKGLFYALDLGGTNFRVMRVLLGGKQERVVKQEFEEVSIPPHLMTGGSDELFNFIAEALAKFVATECEDFHLPEGRQRELGFTFSFPVKQTSLSSGSLIKWTKGFSIEEAVGQDVVGALNKALERVGLDMRIAALVNDTVGTLAGGRYYNPDVVAAVILGTGTNAAYVERATAIPKWHGLLPKSGEMVINMEWGNFRSSHLPLTEFDHTLDFESLNPGEQILEKIISGMYLGEILRRVLLKMAEDAAFFGDTVPSKLRIPFIIRTPHMSAMHNDTSPDLKIVGSKIKDILEVPTTSLKMRKVVISLCNIIATRGARLSAAGIYGILKKLGRDTTKDEEVQKSVIAMDGGLFEHYTQFSECMESSLKELLGDEASGSVEVTHSNDGSGIGAALLAASHSLYLEDS

SEQ ID NO: 6200 - protein, 489 aa, Unknown
  Photobacterium sp. SKA34
MSTELLINVTPSETRVAMIEHGVLQEIHIERESKRGIVGNIYKGRVSRVLPGMQAAFVDIGLDKAAFLHASDIVPHTECVAENEKKQFQVRDISELVRQGQDIVVQVVKDPLGTKGARLTTDITLPSRYLVFMPGASHVGVSQRIESEKERDRLKKAVLQHCDDLGGFIIRTAAEGANTDEVAQDAAFLKHLWRKVLERRAKYKPRSMLYGELGLAQRILRDFVGTEIDNIKVDSRQAFDKLKEFTDEFVPEVTDNIEYYSGQQPIFDLYDTESEIQRSLDRKVEMKSGGYLIIDQTEAMTTVDINTGAFVGRRNLDETIFNTNIEATKAIARQLRLRNLGGIIIIDFIDMISDEHQQRVLQTLEQALSYDRVKTNINGFTQLGLVEMTRKRTRESIEHVLCGTCPSCDGRGTVKTVESVCYEVLREITRVNRAYDADRFIVYVSSAVGEALMGDESHALAELEVFIGKQVKIKPEPLYNQEQFDVVMM

SEQ ID NO: 6201 - protein, 99 aa, Anabaena variabilis
MTTYQVRLINKKRAIDITIPVDENTTILDAAEQQDIELPFSCQSGSCSSCVAKVVEGEVDQSEQVFLDEEQMAKGFIVLCVSYPRSDCTIRTHQEPYLV

SEQ ID NO: 6202 - protein, 146 aa, Medicago truncatula
MGFTEKQEALVNSSWELFKQNPGNSVLFYTIILEKAPAAKGMFSFLKDTAGVQDSPKLQSHAEKVFGMVRDSAVQLRATGGVVLGDATLGAIHIQKGVVDPHFVVVKEALLKTIKEVSGDKWSEELSTAWEVAYDALAAAIKKAMG

SEQ ID NO: 6203 - protein, 341 aa, Unknown
  Mycobacterium sp. MCS
MAHAQRQPKVVVLGGGSWGTTVASICSRRAPTIQWVRSEDTAKDINANHRNSRYLGEDVVLSESLRATTDFAEAASSADVVVMGVPSHGFRGVLEKLAAELRPWVPVVSLVKGLEQGTNMRMSEIVDEVLPGHPAGILAGPNIAREVADGYAAAAVLAMPDQHLAAQLAELFRTKRFRTYTTDDVVGVEMAGALKNVYAIAVGMGYSLGIGENTRAMVIARAVREMSKLGEAMGGHRDTFAGLAGMGDLIVTCTSQRSRNRHVGEQLGSGKPIDEIIASMNQVAEGVKASKVIMEFADEYGLNMPIAREVDSVINHGSTVEQAYRGLVAEKPGHEVYGSGF

SEQ ID NO: 6204 - protein, 209 aa, Erwinia carotovora
MANKKRSASSSRWLQEHFSDKYVLQAQKKGLRSRAWFKLDEIQQSDKLFKPGMTVVDLGAAPGGWSQYVVTQIGGKGRIIACDILPMDPIVGVDFLQGDFRDELVLKALLERVGDSKVQVVMSDMAPNMSGTPAVDIPKSMYLVELALGMCRDVLAPGGSFLVKVFQGEGFDEYLREIRSLFTKVKIRKPDASRARSREVYIVATGRKL

SEQ ID NO: 6205 - protein, 405 aa, Solibacter usitatus
MASFKHLILGGGMVAGHCAKQYVENGGKAGELAIVSGDDALPYERPPLSKGFLAGKDSEESVRINAAEFYAEHGIDVRLNTRVNSIDARGGRLSTSSGEEFGFEKLILATGAEVRRLDVPGAASSNVLYLRSLNDSKRLRDASIKAKHAVVAGGGFIAMEVASVLASRGIETTILARQNRFGAAFFTPEMSAFFEKYYVDRGVRILKQTEVMGIEKGSRALLKDGRAVDFDLFLAGIGVQPVTVLAEKAGLPVDNGILVNEYLETRDANLYAAGDVANYPDSLFGMKRRRVEHWDNAVSQGQYLAGALLGKREPFVHVPYFFSDVFDLSYEFWGDPSPSDRVVHRGDLQTSSFSIWWLSQNRLVAAFAMNRPDEERELAPELIRSRKLLSAERLREAGSVRDAAA

SEQ ID NO: 6206 - protein, 463 aa, Clostridium tetani
MKKISIKQLYREPEKFINKDIVVAGWIRTERTSKNFGFIELNDGSFFKNLQIIIDTNLDNFDKVSKLPISSSIVVEGKLVATPSAKQPFEVQASKVTVEGTSLQDYPLQKKRHSFEFLRSIAHLRPRSNTFSAVFRIRSLAAYAVHKFFQEKNFVYVHTPIITASDCEGAGEMFRVTTLDLNNIPKNDEGKIDFSQDFFDKDAKLTVSGQLSAESYALAFGNVYTFGPTFRAENSNTARHASEFWMIEPEMAFADLTDYMDVAEEMVKYIINYVLENAPEEMNFFNSFIDKDLFKRLDNVVNSEFKRITYTEAVDLLQKSGEKFQYPVEWGIDLQTEHERYITEKIFGKPVFVTDYPKDIKAFYMRLNEDNKTVAAADLLVPGVGEIIGGSQREERLDVLEERMKEFDLNEKDYWWYLELRKYGSAKHSGFGLGFERILMYMTGISNIRDVIPFPRTPGSAEF

SEQ ID NO: 6207 - protein, 377 aa, Glycine max
HDSTSPRLATLKYNNDALRRLIGPMGALKRKMEEETGARMSVGDGTLTIVAKNQSVMDKILEKIDFIVGRQIEVGGIYTGIVTTIKEYGAFVEFNGGQQGLLHISELSHEPVSQVSEVVSVGQKLSLMCIGQDVHGNIKLSLKATSPRPGGLETNDAVEESVASAKETANIWAPVGNVSSTQEQNSAHELSLGNLELGNAKSQTSQVPVILIRSAAECDEEEKSSSLNLSSKSPHVDNGVQLDRKSKSRSQNAKSRRSQDVDAPSSHSGPLPYTNVKKSKPSMQKESKSDIQKPKGDAQEPKDKVTAEDLKLGTQVTAKVSQIRAHGLVLDLGGGLRGMYRFEENNKRDFKIGDEMRVVCSSFSSKGIPVLSFVNDQ

SEQ ID NO: 6208 - protein, 175 aa, Hyacinthus orientalis
PGFTIHSNFHQPPTASRWRPRRRRSPREKKPAAADKPAGGAQGRSRRRPRRPPPGKKPKAEKKLPAKDAAAATDKKKKKKKGKGVETYKIYIFKVLKQVHPDIGISSKAMGIMNSFINDIFEKLAQESSRLARYNKKPTITSREIQTSVRLVLPGELAKHAVSDGTKAVTKFTSA

SEQ ID NO: 6209 - protein, 693 aa, Chlamydia muridarum
MAFETFSVALDKDKTLIFETGKIARQANGAVLVKMNETWVFSSACAASLSEAVDFLPFRVDYQEKFSSAGKTSGGFLKREGRPSEKEILISRLIDRSLRPSFPNRLMQDIQVLSYVWSYDGKTLPDPLAICGASAALAISEVPQNCIVAGVRVGLVEGKWVVNPTKDELDASKLDLVMAGTASAVLMIEGHCDFLTEEQVLEAIAFGQKYIAKICDAIEAWQKAIGKEKQLSAVLDLPEDVQNVVSNFIREKFEKALSFRDRDALEQVSKELEESVVANLVQEESDFSLLNVKAAFKNAKSNQMRALIRDLGIRVDGRSTTEIRPISIEVSFLPRTHGSCLFTRGETQSVAVCTLGGESMAQRFEDLNGDGAARFYLQYFFPPFSVGEVGRIGSPGRREIGHGKLAEKALSHVLPEASRFPYTVRVESNITESNGSSSMASVCGGCLSLMDAGVPIKAPVAGIAMGLILDQDKAIVLSDISGIEDHLGDMDFKVAGTEEGITAFQMDIKVEGITHEIMEQALAQAKQGRSHILNLMTQVMSSPNDSVSRYAPRIETMQINTSKIATVIGPGGKQIRQIIERSGAQVDINDNGLINISANTQESIDKAKELIEGLTGEVEVGKIYNGRVTSVVAFGAFVEVLPGKEGLCHISELSKQKVDNVADFVKEGDRLAVKLLSINEKGQLKLSHKATLE

SEQ ID NO: 6210 - protein, 72 aa, Xylella fastidiosa
MSKDDCIEFEGTVSETLPNTTFRIKLESGHEVTAHISGRMRKNYIRILTGDRVKIEMTAYDLTKGRIIYRMK

SEQ ID NO: 6211 - protein, 532 aa, Magnaporthe grisea
MEKLKVAVIGTGPTGLSMLKVLRDDGFRVTAFERRSRVAGLWSYSDNTTYTTALSTTEANISKYPCGFADFPIHDKYPPYMKAAHFQEFMEDYAKHFDLLKDIVFDTTVRRVARNEADTKWLVQVEKQGGAVEELEFDKVALCHGYQTLAKMPTYPGQDKFEGVLIHGQAFRNGEAFKDKTVIVAGASASSGDVIPSLIPHARKVYLSHRSGGLPIRRWVKGKPVDLNITWRRRQVGFFLQRYLPTLHKFLSDVGLSLVARLTNGPLDPAWRLQPYPSLTLKLTGIWESVMDGLRAGTVTSLHGIKRFTGPRSVEMDDGTVLDDVDAVICCTGYQADWGIAPFVQTSMPSEYGYAGTPLYRLYMNLFPPEYADSCALLCYSAFGKSNGFTFADLSAQAISNVWRGVEPLPSKAAMDKHIDAHQAWVASRWKQDPSIDTSCVKTWEFQGWLHRAAGTGMENIGWGWKGWKFWWKDPEMYRLMNHGVETAHAFRYFETGKRKAWSGAREAIIEVNKRASIFPLKKEALEDAKKR

SEQ ID NO: 6212 - protein, 469 aa, Brucella melitensis
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEADKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 6213 - protein, 110 aa, Medicago truncatula
MASCGDEFFKSIGINFADVIRSGDAMALSNLSLKFLAPLRSGDKFVVRVRISGISAARLYLDQFIYKLPNHKPVLEAKTTVVRLDKNYRPLRISEDMKSKIFKCIGGDDS

SEQ ID NO: 6214 - protein, 321 aa, Xylella fastidiosa
MSDYPASAKHSRLLILGSGPAGWTAAVYAARANLQPVLITGLQQGGQLMTTTEVDNWPGDAHGLMGPDLMERMQAHAERFETEVIFDQIYKADLSTRPFTLFGDSGIYTCDGLIIATGANAKYLGIPSEEAFKGRGVSACATCDGFFYRDQDVAVIGGGNTAVEEALYLSNIARKVYLIHRRDKLRAEKIMQNKLFSKAATGKIELIWNNAVEEVLGNDAGVTGVRIRSTQDSSTRDIDVQGLFVAIGHHPNTDLFAGQLAMNNGYLQIHSGTAGNVTQTSVEGVFAAGDVADQHYRQAITSAGFGCMAALDAERFLDKGN

SEQ ID NO: 6215 - protein, 209 aa, Unknown
  Nostoc sp. PCC 7120
MQISDYPQLNLSSVPRIASVHRITGETNVQVTVNLDGTGICKAATGIPFLDHMLHQISSHGLIDLDVQAKGDWEIDDHHTNEDVGITLGQALAKALGDRKGIVRFGNFLAPLDEALVQVALDFSGRPHLSYGLQIPTERVGTYDTQLVREFFVALVNHSQMTLHIRQLDGINSHHIIEATFKAFARAARMAIEVDPRRAGTIPSSKGVL

SEQ ID NO: 6216 - protein, 320 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIELLLAGYGGRCVGIQNEQLVHHDIIDAIENMKRPFKGDWLDCAKKLY

SEQ ID NO: 6217 - protein, 109 aa, Medicago truncatula
MLHLFSFPCSNPASTTTFTSPFLLHTTSSHLSGKSPTSPFSRRSFNPPALRSILPASTSSSLQLFDVNESKSMCEFYDVELKVRDYEVDRYGVVNNAVYANYCQHCETS

SEQ ID NO: 6218 - protein, 183 aa, Escherichia coli
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTAVAPEESGFYALMVSKGRAPLYPDDILWNFEKFLVGMDGKVIQRFSPDMTPEDPIVMESIKLALAK

SEQ ID NO: 6219 - protein, 106 aa, Oceanicola granulosus
MATVAVTDDTFDSEVRQSDIPVVVDFWAEWCGPCKQIGPALEEIAAEMDGKVKIVKVNVDENPNSPAQMGIRGIPALFIFKDGEVVSNRAGAAPKAALQGWIQDSI

SEQ ID NO: 6220 - protein, 873 aa, Thiobacillus denitrificans
MKRMLFNATQAEELRVAIVDGQKLVDLDIESASKEQRKGNIYKGVVTRVEPSLEAAFVDYGCERHGFLPFKEIARSCLPNGGRVPENLKEGQELLVQVEKDERGNKGAALTTYVSLAGRYVVLMPTNPRGGGVSRRIEGEERNELRDTLAQLDIPEGMSLIARTAGIGRTAEEFQWDLNYLLSLWKAIDGASTSMSGAFLIYQEGSLVIRAIRDYFSADIGEILIDTEDIYEQAQQFMAHVMPANVNKVKLYRDDVPLFSRFQIEHQIESAFSRQVNLPSGGAIVIDHTEALVSIDVNSARATKGSDVEQTAYNTNLEAADEVARQMRLRDLGGLIVIDFIDMENPKHQREVENRLRDALHHDRARVQTGKISRFGLLEMSRQRLQPSLGETSYNPCPRCHGTGHIRGTESSALHILRILQEEAMKENTGAVHVQLPVDVATFLLNEKRPDIHTVESRLKVNVVLIPNIHMETPHYTITRLRHDELNVAGAAEPSYKMALVPETEAIYQTAQAAAPLRQEAAVKSIPPPQPTVAPRPVVPASEPAPAGLFDRIFGWFKKRGDETHAPEAAPAAEAVPAIVRSERPSERRERERKPGQRRGRGEGREGREGRNGEGRNGEARQGESRQTEPRQPEVREPRAEQAKPPRPPRQPKPRPEAEVAPRAATAPVAEEPAGEEKREPRSRRGRGRRGRGEGRSEAAANGSATPRAVIEIAGYRAVIELARPARPAPAAAAPVAAAAEPAAAPAPSQQALQLDAPTPATKPAPGAVTASPAEILAALAAGEAELQQVETRSAAAAAADGSEPSRPRRRRRPSVKADAEPVSLMQVETSAPIEVPVDAPAPAAGPHPTRRRPRPQPSAPQEPLVQVETQAK

SEQ ID NO: 6221 - protein, 718 aa, Unknown
  Nostoc sp. PCC 7120
MAEFEKSISFDGRDIRLKVGLLAPQAGGSVLIESGDTAVLVTATRSPGREGIDFLPLTVDYEERLYAAGRIPGGIMRREGRPPEKTILTSRLIDRPLRPLFPSWLRDDLQVVALTMSMDEQVPPDVLAVTGASIATLIAKIPFNGPMAAVRVGLVGDDFIINPTYAEIEAGDLDLVVAGSPHGVIMVEAGANQLPERDIIEAIDFGYEAVRDLIKAQLDLVAELGLEIVQEAPPEVDQTLENYIRDRASDEIKKILAQFELTKPERDAALDVVKDNIATAIAELPEEDPIRLAATANSKALGNTFKDITKYFMRRQIVEDNVRVDGRKLDQVRPVSSQVGVLPKRVHGSGLFNRGLTQVLSACTLGTPGDAQNLNDDLQTDQSKRYLHHYNFPPFSVGETKPLRAPGRREIGHGALAERAILPVLPPKEQFPYVIRVVSEVLSSNGSTSMGSVCGSTLALMDAGVPILKPVSGAAMGLIKEGDEVRVLTDIQGIEDFLGDMDFKVAGTDAGITALQMDMKISGLSLEVIAQAIHQAKDARLHILDKMLQTIDQPRTETSPYAPRLLTIKIDPDMIGLVIGPGGKTIKGITEETGAKIDIEDDGTVTISAVDENKAKRARNIVQGMTRKLNEGDVYAGRVTRIIPIGAFVEFLPGKEGMIHISQLADYRVGKVEDEVAVGDEVIVKVREIDNKGRINLTRLGIHPDQAAAAREAAAVNR

SEQ ID NO: 6222 - protein, 148 aa, Sesbania rostrata
MGFTEKQEALVNASYEAFKQNLPGNSVLFYSFILEKAPAAKGMFSFLKDSDGVPQNNPSLQAHAEKVFGLVRDSAAQLRATGVVVLADASLGSVHVQKGVLDPHFVVVKEALLKTLKEAAGATWSDEVSNAWEVAYDGLSAAIKKAMS

SEQ ID NO: 6223 - protein, 1100 aa, Rhodospirillum rubrum
MSDFLWYKDAIVYQLHVKAFFDSNGDGFGDFKGLTEKLDYLSDLGVTAVWILPFYPSPLRDDGYDIADYKAIHRAYGTMGDFRRFVREAHERGLKVITELVINHTSDQHAWFQRAREAKPGSKARDMYVWSDTDQRYLDTRIIFTDTETSNWAWDPLAKAYYWHRFFAHQPDLNWDNPRIFEEITRVMKFWLDCGVDGMRLDAIPYLVERDGTNNENLPETHVVLKRLRAWLDAHYEDRMFLAEANQWPEDVREYFGEAGDECHMAFHFPVMPRIYMAVAQEDRHPITDIMRQTPEIPAACQWAIFLRNHDELTLEMVTDRERDYMNTFYANDSRARINVGIRRRLAPLLDNDRRKIELLNSLLMSMPGTPIIYYGDEIGMGDNIFLGDRDGVRTPMQWSPDRNGGFSRADPASLYLPTIMDAVYGFFAVNVEAQSRSPSSLLNWMRRLIAVRKRHPSFGRGTLRFLYPGNRKILAYLREFEGEVILCVANLSRAPQPAELGLAEFSGRVPVEMLGNSVFPPIGELHYFITLPAYGFYWFRLSKGEGPSWHEPPVEPLPDLSTLVLPRIWDSLGSDGPLRQIQGDILPAFLPKQRWFSGKEHSLRGVEMTDHAVISAPGAASGWMLALWRADYKDGAPGQTFQLPLDIAWESREDDPLSRLLPFTLARVRRVNRVGALYDAMAGPAFPLALVQAMAEGANVTTAKGGGLRFTRTQAFPAGPLPGPEAVARLGREQSNTSIKLGEDMVLKLYRRVEAGIHPEIEIGRFLTDVAGFANAPPLLGALEHIDAKGAISALAVLQGFVRNQGDGWDYMLAYLDRFLDDRAQAPAEVGEGGGPAGSPHGIIHAQADILGQRVAELHHAFATPTEDPAFSAEAVGPEDLASWREQVRTQAAQARQALDTALPGLSAEVAGLVTRLLDCWERIDARVDAPISLAEGLVKTRIHGDLHLGQVVVVRDDFHILDFEGEPVKGLSERRDKHCPLKDVAGMLRSFDYAAWSAALSFRQTHAEVRIDVLPALGVWQEEIREAFLAGYDRAIAGCPSVPALEEGRRDLLSLFMLEKALYEVSYEAANRPDWLRIPIGGVLRLLGEGPSDEIKPR

SEQ ID NO: 6224 - protein, 145 aa, Glycine max
MGAFTEKQEALVSSSFEAFKANIPQYSVVFYTSILEKAPAAKDLFSFLSNGVDPSNPKLTGHAEKLFGLVRDSAGQLKANGTVVADAALGSIHAQKAITDPQFVVVKEALLKTIKEAVGDKWSDELSSAWEVAYDELAAAIKKAF

SEQ ID NO: 6225 - protein, 729 aa, Rhodospirillum rubrum
MPLTRPRVWPGRPYPLGGTWDGRGVNFALFSEHAEKVELCLFDGDDGRELSRVPLPEYTDEIWHGYLPDVRPGQRYGYRVYGPYAPHAGHRFNPNKLVLDPYARSWGGRLQWTDAHFGYRFGAASEDLTFDTRDNSAFMPKCVIVETAFTWDDDRAPRRPWHDSVLYELHVKGFTIRHPEVPRAIRGTFAGMSTQAVVSYLKSLGITAIELLPVQAFVDERHLVKNNLTNYWGYASLGYFAPQPSYLASGKLGEFKTFVQVMHDAGIEVILDVVYNHTAEGNHLGPTFSFKGIDNASYYRLVPGNERFYADSTGCGNALNLRHPRVLQMVMDSLRYWVREMHVDGFRFDLATTLARDHGRFDPHSAFIEALRQDPVLSTVKLIAEPWDVGDGGYRLGGFPPGFAEWNDRYRDTVRRFWKGDRGQVADLATRLTGSSDLFANRGRCPWASINFVTAHDGFTLADLVSYNGKHNEANGENNRDGTDNNNSWNHGIEGPTSDPSIQALRRRQVRNFLATLLLSQGVPMLVAGDEFGRSQRGNNNPYCQDNEISWINWAAIDAEGQSLARMVRWLIRLRRRHIVFHRNRFFHGTTLRGTDVKDITWLEPDGRERSDARDWTDPEERFLAFLIRGEAGEYFVTEMGDPEPDHSFLVALNADSRPVPMLLPVLTAGTRWVLLFDTARPGAERRPAPADGKMYSVEGRSLTVFRREPGLRDGDGDGPWELDGFPEV

SEQ ID NO: 6226 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 6227 - protein, 148 aa, Sesbania rostrata
MGFTEKQEALVNASYEAFKQNLPGNSVLFYSFILEKAPAAKGMFSFLKDFDEVPQNNPSLQAHAEKVFGLVRDSAAQLRATGVVVLADASLGSVHVQKGVLDPHFVVVKEALLKTLKEAGGATWSDEVSNAWEVAYDELSAAIKKAMS

SEQ ID NO: 6228 - protein, 147 aa, Medicago sativa
MGFTADQEALVNSSWESFKQNLPGYSVFFYTTILEKAPAAKGMFSFLKDSAGVQDSPQLQAHAEKVFGMVRDSAVQLRATGEVVLGDATLGSIHIQKGVVDPHFVVVKEALLKTIKEAVGDKWSEELSTSWEVAYDGLASAIKKAMS

SEQ ID NO: 6229 - protein, 402 aa, Bacillus cereus
MPKHRKQSKIKIYRITSYKKDKRSELDSDKFELEQQEIENKQDKHGKQGKQDKHDKQDKQDKQDKQDEQDKQDKQDEQDEQDEQDKQDKQDKQVQTENVVIVPTDSHNLDIWDEISLKEIQAGEHTSLLNEKSNYQNINLVQVSDIRLYLDNQLQFSSVDEQIYHEALVHPIMAKVIDPKRVLILGGGDGLALREVLKYETVLHVDLVDLDEAMINMARNVPEIVSLNKNAFFDNRVNVHVCDAKEFLNSPSSLYDVIIIDFPDPATEVLSTLYTSELFARIATFLTEDGAFVCQSNSPADAPLVYWSIGNTIENAGLIVKSYHIIVPSFGTDWGFHIAANSSHILDQIEQLYVVPTPRTLPSLLFPLFQFKEEYLEQCNHALINSESNLILHQCYKQEMEF

SEQ ID NO: 6230 - protein, 72 aa, Haemophilus ducreyi
MAKEDCIEMQGTILETLPNTMFRVELENGHIVAAHISGKMRKNYIRILTGDKVTVEMTPYDLSKARIIFRAR

SEQ ID NO: 6231 - protein, 489 aa, Saccharomyces castellii
MSADFGLIGLAVMGQNLILNAADHGFTVCAYNRTVSKVEHFLANEAKGKSIVGATSIDDFLSKLKRPRKVMLLVKAGAPVDALINELVPRLEKGDIIIDGGNSHFPDTNRRYEELKQKGILFVGSGVSGGEDGARYGPSLMPGGAEEAWPHIKDIFQSISAKSDGEPCCDWVGPAGAGHYVKMVHNGIEYGDMQLICEAYDIMKRVGHFTDKEIGDVFETWNKGVLDSFLIEITRDILKFNDVDGKPLVEKIMDTAGQKGTGKWTAINALDLGIPVTLIGEAVFSRCLSALKSERIRASKTLLGPEVPKDLIKDKKQFVDDLEQALYASKIMSYAQGFMLIREAGKTYGWKLNNPAIALMWRGGCIIRSVFLGEITKAYREDPELENLLFNKFFSDAVTKAQTGWRKSIALATTYGIPTPAFSTALAFYDGYRSERLPANLLQAQRDYFGAHTFRVLPECASDNLPLDKDIHINWTGHGGNVSSSTYQA

SEQ ID NO: 6232 - protein, 343 aa, Atropa belladonna
MATLVSNWSTNNVSESFVAPLEKRAENDVPLGNDVPIIDLQQDHLVVVQQITKACQDFGLFQVINHGLPEKLMAETMDVCKEFFALPAEEKEKLQPKGEPAKFELPLEQKAKLYVEGEQLSDEAFLYWKDTLAHGCHPLDEELVNSWPEKPATYREVVAKYSVEVRKLTMRILDYICEGLGLKLGYFDNELSQIQMMLTNYYPPCPDPSSTLGSGGHYDGNLITLLQQNLPGLQQLIEDAKWIAVEPIPTAFVVNLGLTLKVITNEKFEGSIHRVVTNPTRDRVSIATLIGPDYSCTIEPAKELLSQDNPPLYKPYSYAEFGEIYLSDKSDYDAGVKPYKINA

SEQ ID NO: 6233 - protein, 145 aa, Psophocarpus tetragonolobus
MGGFTEKQEALVNSSYEAFKANVPQYSVVFYTSILEKAPAAKDLFPFLANGVDPTNPKLIGHAEKLFGLVHDSAAQLRAKGAVVADAALGSLHAQKGVTDPQFVVVKEALLKTVKEAVGDKWSDELSNAWEVAYNELAAALKKAF

SEQ ID NO: 6234 - protein, 358 aa, Saccharomyces cerevisiae
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSPPRGHIHDGTDKDDECNFEGHVHTTWGDCCGIKLPSAIAATEMNKKHHKPIPFD

SEQ ID NO: 6235 - protein, 239 aa, Unknown
  Synechococcus sp. RS9916
MAVVTLAEMMEAGAHFGHQTRRWNPKMSRYIYCARNGVHIIDLVQTAVCMNNAYKWVRSAARSGKRFLFVGTKKQASEVVALEAARCGGSYVNQRWLGGMLTNWTTMKARIDRLKDLERMESSGAIAMRPKKEAAVLRRELDRLQKYLGGLKNMRRLPDVVVLVDQRRETNAVLEARKLDIPLVSMLDTNCDPDLCEVPIPCNDDAVRSVQLVLSRLADAINEGRHGSNDQRGGDDSQG

SEQ ID NO: 6236 - protein, 473 aa, Gluconobacter oxydans
MNTQPHHSSPDSPQDGGWFPISIRLSGARVLLVGGGEIAVNKGRLLLDHGARIDVLAEKLHPAVQGWVENGRVRHVGERADEAVLRRLLPGCRLVYAATDSRDTNRQVAALADELNIPVCAVDDPGPSSFITPAQVRRGMVRVAVSTGGAAPVLARRLREQIETLLPEGTGRLATYMQSRRAFVSGRYPNVQDRKRIWEDFLDGPGAEAARSGDESRADARLEVLLDGERKSGEVWLVGAGPGDPDLLTLKALHLMQNADSVLYDNLVSPALLDMVRRDAELVFVGKQRDRHALPQDEINREMVRRAQGGERVLRLKGGDPFIFGRGGEEIEALVEAGVAFRLVPGISAANGCAAYSGIPLTHRDCAQACLFVTGHAKADGVLDLPWDDMADRRQTVVIYMGISTLPQLAAGLLGKGLPADWPVAIVERGTQPRQRVFTGTLSTIAQQAAEAQVKSPALVIVGQVVRHRVVSP

SEQ ID NO: 6237 - protein, 302 aa, Kluyveromyces lactis
MSTSNCRFYENKFPEVDDVVMVNVQQIAEMGAYVRLLEYDNIEGMVLLSELSRRRIRSIQKLIRVGKNEVVVVLRVDKEKGYIDLSKRRVSAEDVIKCEERYQKSKAVHSILRQCAEKYQVSLEDLYKAYAWPLSRKYGHAYDAYKMSIVDPNVWDGIESISDEIFQELKGQITRRLTPQAVKIRADVEVSCFSYEGIDAIKEALKSAEELSTEQMQIKVKLVAAPLYVITTQSLDKDQGVQLLETAIAKIEEVILKYNGVCNVTMAPKAVTATEDAELQALLESKELEGRSDSEDEDSDYE

SEQ ID NO: 6238 - protein, 383 aa, Aspergillus nidulans
MKFSQALLSLASLALAAALPHASTPVYTPSTTPSPTPTPSASGSFATTSGIQFVIDGEAGYFPGSNAYWIGFLKNNSDVDLVFDHMASSGLRILRVWGFNDVNTAPTDGSVYFQLHQDGKSTINTGKDGLQRLDYVVHSAEKHGIKLIINFVNYWDDYGGMNAYMRAYGGGDKADWFENEGIQAAYQAYVEAVVKRYINSTAVFAWELANEPRCTGCEPSVLHNWIEKTSAFIKGLDEKHLVCIGDGSDGSYPFQYTEGSDFAAALTIDTIDFGTFHLYPDSWGTNNDWGKLWITSHAAACAAAGKPCLFEEYGVTSNHCAIEKQWQNAALNATGIAADLYWQYGDTLSSGPSPDDGNTFYYGSEEFECLVTNHVETIERSAK

SEQ ID NO: 6239 - protein, 495 aa, Mycobacterium tuberculosis
MTGRCPTVAVVGAGMSGMCVAITLLSAGITDVCIYEKADDVGGTWRDNTYPGLTCDVPSRLYQYSFAKNPNWTQMFSRGGEIQDYLRGIAERYGLRHRIRFGATVVSARFDDGRWVLRTDSGTESTVDFLISATGVLHHPRIPPIAGLDDFRGTVFHSARWDHTVPLLGRRIAVIGTGSTGVQLVCGLAGVAGKVTMFQRTAQWVLPWPNPRYSKLARVFHRAFPCLGSLAYKAYSLSFETFAVALSNPGLHRKLVGAVCRASLRRVRDPRLRRALTPDYEPMCKRLVMSGGFYRAIQRDDVELVTAGIDHVEHRGIVTDDGVLHEVDVIVLATGFDSHAFFRPMQLTGRDGIRIDDVWQDGPHAHQTVAIPGFPNFFMMLGPHSPVGNFPLTAVAESQAEHIVQWIKRWRHGEFDTMEPKSAATEAYNTVLRAAMPNTVWTTGCDSWYLNKDGIPEVWPFAPAKHRAMLANLHPEEYDLRRYAAVRATSRPQSA

SEQ ID NO: 6240 - protein, 366 aa, Geobacillus thermocatenulatus
MELFKYMEMYDYEQVLFWQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYHETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDHTIPQLKAKVIAGSVNNQLKEPRHGDMIHEMGIVYAPDYVINAGGVINVADELYGYNRERSMKMIEQIFDNIEKVFAIAKRDNIPTYAADRMAEERIETMRKARSQFLQNGHHILSRRRAR

SEQ ID NO: 6241 - protein, 164 aa, Clostridium tetani
MKGVKFMKEIILAGGCFWGVEEYFSRIYGVVDTKVGYVNGVTKNPSYEEVCNGNTGYAEGCYIKFDESIIGLKRILDKFWDIIDPTILNRQGPDVGHQYRTGIYYYDKEDLDDILKSKDEISKKYDKPIVTEVEKVTYFYLAEEYHQKYLKKNPNGYCHINLDN

SEQ ID NO: 6242 - protein, 180 aa, Vitis vinifera
AWHSAGTFDVKTRTGGPFGTMKRPEELAHGANNGLDIAVRLLEPIKEQFPIISYADFYQLAGVVAVEVTGGPEIPFHPGREDKPEPPPEGRLPDATKGCDHLRQVFVTQMGLSDKDIVALSGAHTLGRCHKERSGFEGPWTSNPLIFDNSYFKELLSGEKEGLLQLPSDKALLSDPAFRP

SEQ ID NO: 6243 - protein, 539 aa, Arabidopsis thaliana
MGSGCSSLSYSSSSTCSATVFSISSPPSSSSSLKLNPSSFLFQNPKTLRNQPPLRCGRSFKMESQKPIFDLEKLDDEFVQKLVYDALVWSSLHGLVVGDKTYQKSGNVPGVGLMHAPIALLPTGFPEAYWKQACDVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDKVIVNEQSGYLMRTKIASSDEGGVAAGFGVLDSIYLN

SEQ ID NO: 6244 - protein, 160 aa, Pseudomonas aeruginosa
MSAFHDLTLQGLDGQDLPLSPFKGKVLLVVNVASKCGLTPQYAGLENLYQTYRERGFAVLGVPCNQFAGQEPGSEADIQSFCSLNYGVSFPMSAKVEVNGSARHPLYRLLAGEGAEFPGDITWNFEKFLLGPDGRVLARFSPRTAPDDPALVQAIEKALG

SEQ ID NO: 6245 - protein, 475 aa, Aspergillus nidulans
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRVAPQPAAAATNPALVYPKMNGEMEPVVYPVGATNGIDPMYGEHVNNVPYTVPPKQDMDDRRQFPENRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQLYFQHGMDDVLPKPFTRKSLLEMLEKHLVHLKTVPQGMEAPPTCDRSHVGTSLN

SEQ ID NO: 6246 - protein, 128 aa, Mycobacterium leprae
MQQSFYDAIGGAETFKAIVSRFYAQVPEDEILRELYPADDLAGAEERLRMFLEQYWGGPRTYSSQRGHPRLRMRHAPFRITAIERDAWLRCMHTAVASIDSHTLDNEHRRELLDYLEMAAHSLVNSAS

SEQ ID NO: 6247 - protein, 210 aa, Mycobacterium leprae
MTNTEVGKTTRRARIERRTSESDIVVELDLDGTGQVHIDTGVSFYDHMLTALGSHASFDLTVCTKGDVEIEAHHTIEDTAIALGQAFGQALGNKKGIRRFGDAFIPMDETLVHAVVDVSGRPYCVHTGEPDHLQHNIISGSSVPYSTVINRHVFESLAANARIALHVRVLYGRDPHHITEAQYKAVARALSEAVKFDPRFSGVPSTKGVL

SEQ ID NO: 6248 - protein, 217 aa, Coprinopsis cinerea
MSRQATIQRKTGETDIDVSIDLDCQPGSNNVQSINVSTGIGFLDHMFTALAKHGGWSLTLKCKGDLWIDDHHTADMSMYRVTLYSTLTPAAQDCAIALGTAFKQALGEVRGIRRYGTGYAPLDEALSRAVIDICSRPYCFTDLKFKREKIGDLSTEMIPHIFYSFAMASGATLHVDVIRGENDHHKSESAFKALAIAIRQAIERTGGTDVPSTKGVL

SEQ ID NO: 6249 - protein, 237 aa, Arabidopsis thaliana
MKQARSLLSRSLCDQSKSLFEASTLRGFASWSNSSTPGRGFPGKDAAKPSGRLFAPYSIFKGKAALSVEPVLPSFTEIDSGNLRIDRRGSLMMTFMPAIGERKYDWEKKQKFALSPTEVGSLISMGSKDSSEFFHDPSMKSSNAGQVRKSLSVKPHADGSGYFISLSVNNSILKTNDYFVVPVTKAEFAVMKTAFSFALPHIMGWNRLTGHVNTEALPSRNVSHLKTEPQLELEWDK

SEQ ID NO: 6250 - protein, 589 aa, Brevibacterium helvolum
MTLVNVGPERFDVWAPDVSSVVLVADGRQYPMQKKETAPGSEGWWTASDAPPNGDVDYGYLLDGNTTPVPEPRSRRLPAGVHNHSRTYNPPPYRWQDSRWRGKELQGTLIYQLHVGTSTPDGTLDAAGEKLSYLVDLGIDFIELLPVNGFNGTHNWGYDGVQWYTVHEGYGGPAAYQRFVDAAHAAGLGVIQDVVYNHLGLRGNYFPKLGPNLKQGDANTLGDSVNLDGAGSDVFREYILDNAALWVGDYHVDGVGFDAVHAVRDERAVHILEDLGALGDAISGETGLPKTLIAESDFNNPRLIYPRDVNGYGLAGQWSDDFHTAVHVSVSGETTGYYSDFESLAVLAKVLKDGFLHDGSYSSFRGRHHGRPINPSLANPAALVVCNQNHDQIGNRATGDRLSQSLSYGQLAVAAVLTLTSPFTPMLFMGEEYGASTPWQFFTSHPEPELGKATAEGRIKEFERMGWDPAVVPDPQDPETFNRSKLDWSEASTGDHARLLELYKSLTALRREHPDLADLGFGQTEVSFDDDAGWLRFRPVSVEVLVNLSDAKVRLDDAAGDLLLATDEGNPLDGGSLALVPWSAAVLKS

SEQ ID NO: 6251 - protein, 155 aa, Zea mays
AARICANKYMVKTAGKEAFHLRVRAHPYHVVRINKMLSCAGADRLQTGMRGAFGKPNGLVARVNIGQIILSCRTRDALRPNVIEALRRSQYKFPGRQKIIVSKNWGFTPLRREEYVAKRQSGQVRVDGAYVQFLSTRGPLEYNMRRFNKAFETEA

SEQ ID NO: 6252 - protein, 154 aa, Alteromonadales bacterium
MEQKTQSLPAKKNIALVAHDGKKAALKLWCDKHKNTLSKHTLYGTGTTGHLIQKSTGLDVVQLLSGPMGGDQQLGAKIAEHEIHVLIFFWDPLASQPHDPDVKALLRLAAVWNIPVACNEVSADMLLSSPLMENELERTLPDYEKYLATRQISL

SEQ ID NO: 6253 - protein, 84 aa, Oryza sativa
  misc_feature (15)..(15): Xaa can be any naturally occurring amino acid
PPVFKGPVNIVLDTXPPTPRGVMGFSLSPPGGPPVYFPPPFFTLEDKGFPPKSKGPLKFSNSGIPPASFCFPSFAKKVFGSKAT

SEQ ID NO: 6254 - protein, 582 aa, Candida albicans
MTIEYTWWKDATIYQIWPASYKDSNGDGIGDIPGIISTLDYLKNLGIDIIWLSPMYKSPMEDMGYDISDYESINPDFGTMEDMQNLIDGCHERGMKIICDLVVNHTSSEHEWFKQSRSSKSNPKRDWYIWKPPRIDAKTGEKLPPNNWGSFFSGSAWEYDELTDEYYLRLFAKGQPDLNWENEECRQAIYNSAMKSWFDKGVDGFRIDVAGLYSKDQSFKDAPIVFPDQIYQPSGELISNGPRIHEFHQEMYRQVTSKYDVMTVGEIGHCDRNEALKYVSAQRKELNMMFLFDLVEVGSNNQDRFRYNGWNLIDFKKAIQNQSDFIKGTDAWSTVFIENHDQPRCISRFGNTKSLDLINKTGKLLAMLQASLTGTLFIYQGQEIGMTNLPRSWSIDEYKDINTINYYKDFKEKYGNEPDFKQREEKLLDVINLVARDHARSPVQWNDDDTASYGGFSTHKPWTRINDNYKQINVANELKDPNSILKFYQSVLKLRKEYKDLFIYGSFDILDFNNEKLFTYVKSHKEGNESPKAYVTLNFSNESIPFKPLIEGEFKLMTTNVQQSDYDESVLSPYEGRIYIVD

SEQ ID NO: 6255 - protein, 619 aa, Pneumocystis carinii
DPTYSAVIKGIKEGRNGLGSIYVFGSGNGGLLDDCNYDGYANSPYTVTIGAIDSEDKNFYFSESCPCILASTYSGGENESIYTTDIGKTNCTTEHSGTSASTAIAAGIIALVLSVNPNLTWHDIQALIVETAVPFNLKYPGWGELPSKRYYNNYFGYGKLDAYRMVERARTFKTLNAQTMFSTQLIRINMQFPGTTKHITSSFYIHSGYPEYYNFKNLEYVGVSFHYQHQRKGRLEFSITSPANVTSKLARVRIRDKEGGTFSWVFTTVKHWGESIVGNWTIDVEDKNMWNEQSSIFSWQLHFFGESINSSKAQPPPYPFAHKQPTTAPPPDPGATPPPDLDANPQPQPDPGSPPSSDPESPPSSEPGYQPPSKPGPQPPSEPQPPSKPDLNPPSDPSSQQDPDTSLSSNPTSTSSSEPSPPSPPPAPAPAPPAPPPPPAPAPAPPAPPPPPAPAPAPPAPPPPPAPAPAPPAPPPPPAPAPAPAPPPPPPPPPPRPELEPEPEPEPEPEPEPQPPQPQPEPPVPPPKPQPPPPPPEQKPTSITSSTSTTSSSKTKISTTRKASSTKTSSTTKTSARPSPTEGTFTGSSASHLSFFEKRHLLLQMILLLFFFLFLGYSF

SEQ ID NO: 6256 - protein, 440 aa, Solanum lycopersicum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRNRWR

SEQ ID NO: 6257 - protein, 555 aa, Arabidopsis thaliana
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 6258 - protein, 515 aa, Shigella flexneri
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 6259 - protein, 438 aa, Solanum lycopersicum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWR

SEQ ID NO: 6260 - protein, 507 aa, Triticum aestivum
MLLRRSEPGNELEELLWDNGPALRRAASPFPPFSCSAAGTMKAQELAKHPASATAMAQGHDDDAVPWLQHYPIIGVDDDGSGGDTAPLPQDYFSTLFPGFSELPAAVASRDAGAPSTSHAAVVVPPLPGATCAPQAAAGRRLDPPGKGVMNFSFFSRPLQRSLPQASTRTSAAGSKSVESTLLQTNRLRSTPLFSEQRTAWLQPPKELPAAVSASRPPAPPVPVRHAAEPAAALPQRLQPEARAAALPPRLQPEVRAAALPQRLQSEARASEMPPPPATATTSSVCSDNGERSQLKRSSHQTLEWSVSQDDEDLDDEAGGLRRSAARSTKRGRTAEVHNMSERRRRDRINEKMRALQELIPNCNKIDKASMLEEAIEYLKTLQLQVQMMSTMGTAGLCMPPMMAMQHMQMPPMAHFHHHHLGAMGFGMGPFDPRLVAAAGAAQFPYPMMPGAPIFGGHAMPPPPPFHQAAVAGAHMAPGPVTNDAATAAQAEHEQTPGDHPQVPRTM

SEQ ID NO: 6261 - protein, 419 aa, Burkholderia xenovorans
MPLNPSPSRTRRRLLGRLAAGGLVASHAAAAAELLKPLEVAPSSRVPGAPILEHPYGVPSPHEANVVRRSARVWPLPGAASSMTPLADLHGALTPNGLVYERHHGGVPDIDPDQHRLAIHGLVRTPKLFTMDDLLRLPSESRIHFLECSGNTGNEWSGPSGQPVQLTHGLLSCCEWTGVRLSTLLEEVGGLSKQIDPARGWLLAEGADAAVMARSLPLERILDRALVVYAQNGERLRPENGYPLRLIVPGFEGNTNVKWLRRLKVVDAPLQTREETSKYTSLLANGTARQFAFEMDAKSVITRPSPGHRLTTHGYYPITGLAWSGRGTVRKVEVSTDGGATWRVARLDGAIRDRALTRFQADWRWDGGPAAILSRATDSTGYVQPTRAELVAARGLNSQYHYNAIQQWRVDTSGEVRNA

SEQ ID NO: 6262 - protein, 539 aa, Arabidopsis thaliana
MGSGCSSLSYSSSSTCSATVFSISSPPSSSSSLKLNPSSFLFQNPKTLRNQPPLRCGRSFKMESQKPIFDLEKLDDEFVQKLVYDALVWSSLHGLVVGDKTYQKSGNVPGVGLMHAPIALLPTGFPEAYWKQACDVTPLFNELIDRVSLDSKFLQDSLSRTKKVDVFTSRLLDIHSKMLERNKKEDIRLGLHRFDYMLGEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNTYGDDVRENLLRLQKEGEEGNAAYILMQRIFPKVSNMFLVREGVYHKHQAMSELGVYGAYLRSKDKVIVNEQSGYLMRTKIASSDEGGVAAGFGVLDSIYLN

SEQ ID NO: 6263 - protein, 162 aa, Pseudomonas syringae
MSAFHDIKLKALGGQELPLANFRKKVVLVVNVASKCGLTPQYAALENLYQQYKDQGLEILGLPCNQFAGQEPGTEQEIAEFCQLNYGVTFTLGEKLDVNGPNRHSLYRLLAGEGAEFPGDITWNFEKFLVGKNGGVSARFSPRTTPDDPAVIQAIEKALAQS

SEQ ID NO: 6264 - protein, 706 aa, Erwinia carotovora
MLNPIVRKFQYGQHTVTLETGMMARQATAAVMVSMDDTAVFVTVVGAKNAKPGQSFFPLTVNYQERTYAAGRFPGGFFRREGRPSEGETLTSRLIDRPIRPLFPEGFLNEVQVIATVVSVNPQVSPDIVAMIGASAALSLSGIPFSGPIGVARVGYLNDQYVLNPTTDELKESRLDLVVAGTQGAVLMVESEAELLSEDQMLGAVVFGHEQQQIVIENINSLVAEAGKPKWEWHAPAVNVSLEQRVQALSEARLGDAYRITEKQERYAQVNVIKTDVVAALQAEDETLNAGEIQEILGNIEKNVVRGRVLAGEPRIDGREKDMIRGLDVRTGVLPRTHGSALFTRGETQALVTATLGTERDAQNIDELTGERTDRFLLHYNFPPYCVGETGMVGSPKRREIGHGRLAKRGVLAVMPKANEFPYTVRVVSEITESNGSSSMASVCGASLALMDAGVPIKSAVAGIAMGLVKEGDNFVVLSDILGDEDHLGDMDFKVAGSREGITALQMDIKIEGITREIMQVALNQAKGARLHILGVMEQAISTPRGDISEFAPRIHTIKISTDKIKDVIGKGGSVIRALTEETGTTIEIEDDGTVRIASTDGEKAKHAIRRIEEITAEIEVGRVYQGKVTRIVDFGAFVAIGGGKEGLVHISQIADKRVEKVTDYLQMGQEVPVKVLEVDRQGRVRLSIKEANPQTQEAAAPSSEE

SEQ ID NO: 6265 - protein, 356 aa, Glycine max
MSLLSDLINLNLSDTTEKVIAEYIWIGGSGMDLRSKARTLPGPVSDPSKLPKWNYDGSSTGQAPGEDSEVIIYPQAIFRDPFRRGNNILVICDTYTPAGEPIPTNKRHDAAKVFSHPDVVAEETWYGIEQEYTLLQKDIQWPLGWPVGGFPGPQGPYYCGVGADKAFGRDIVDAHYKACLYAGINISGINGEVMPGQWEFQVGPSVGISAGDEVWAARYILERITEIAGVVVSFDPKPIQGDWNGAGAHTNYSTKSMRNDGGYEVIKTAIEKLGKRHKEHIAAYGEGNERRLTGRHETADINTFLWGVANRGASVRVGRDTEKAGKGYFEDRRPASNMDPYVVTSMIADTTILWKP

SEQ ID NO: 6266 - protein, 320 aa, Pseudomonas syringae
MSDVRHSRVIILGSGPAGYSAAVYAARANLKPLLITGMQAGGQLTTTTEVDNWPGDPHGLTGPALMERMREHAERFETEIVFDHINSVDLAGKPFSLQGDSATYTCDALIIATGASARYLGLPSEEAFMGKGVSACATCDGFFYRNREVAVVGGGNTAVEEALYLANIASKVTLVHRRETFRAEKILIDKLHARVAEGKIELKLNATLDEVLGDNMGVTGARLKNNDGSSSELKVDGVFIAIGHTPNTSLFDGQLALKDGYMVVQGGREGNATATSVEGVFAAGDVADHVYRQAITSAGAGCMAALDVERYLDGLADVSF

SEQ ID NO: 6267 - protein, 99 aa, Arabidopsis thaliana
  misc_feature (43)..(43): Xaa can be any naturally occurring amino acid
  misc_feature (65)..(65): Xaa can be any naturally occurring amino acid
  misc_feature (76)..(76): Xaa can be any naturally occurring amino acid
RRKRDSSMLYSANMVASPAKATRVAPFKGVRSCAAFQGSREAXNNDITFIKSNGGRVNCMRVWPXIGKKKFETLSXASDLSDSELDREVDYLIETVDSV

SEQ ID NO: 6268 - protein, 72 aa, Neisseria meningitidis
MAKEDTIQMQGEILETLPNATFKVKLENDHIVLGHISGKMRMHYIRISPGDKVTVELTPYDLTRARIVFRAR

SEQ ID NO: 6269 - protein, 316 aa, Pseudomonas aeruginosa
MPDTLRHARVIILGSGPAGYSAAVYAARANLKPLLITGMQAGGQLTTTTEVDNWPGDPHGLTGPALMQRMQEHAERFETEIVFDHIHAVDLAGKPFTLRGDNGTYTCDALIVATGASARYLGLPSEQAFMGKGVSACATCDGFFYRNREVAVIGGGNTAVEEALYLANIASRVTLVHRRETFRAEKILQDKLQARVAEGKIVLKLNAEVDEVLGDTMGVTGVRLKTRDGGSEEIAVDGMFVAIGHTPNTSLFEGQLALKDGYLVVNGGREGNATATNVPGVFAAGDVADHVYRQAITSAGAGCMAALDVERYLDSL

SEQ ID NO: 6270 - protein, 932 aa, Brucella suis
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKPVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQAWGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 6271 - protein, 406 aa, Streptomyces roseochromogenes
MDAELCRQRSTLEMIASENFAPAAVLDAQGSVLTNKYAEGYPGRRYYGGCEHVDVIEQLAMARVKDLFGAEAANVQPHSGAQANAAAMFALLQPGDTILGLDLAHGGHLTHGMRLNYSGKLYDVVPYHVRQSDLRIDMDEVEQLALAHRPRMIVAGWSAYPRQLDFAAFRRIADEVGAYLMVDMAHFAGLVAAGLHPNPVPYADVVTTTTHKTLGGPRGGVILSRAGLAKKINSAVFPGQQGGPLEHVIAAKAVAFKVAASEEFKERQRRTLDGARILAGRLLADDVAEAGITVLTGGTEVHLVLVDLRDSALDGQQAEDRLHRIGITVNRNAVPFDPRPPMVSSGLRIGTPALATRGFGATEFREVADIVAEALKGEQADDELRDRVEKLAGAFPLYPHLNGAAA

SEQ ID NO: 6272 - protein, 481 aa, Streptococcus pneumoniae
MKQEECQMTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 6273 - protein, 388 aa, Clostridium perfringens
MSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDPSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEIIEECAMVK

SEQ ID NO: 6274 - protein, 409 aa, Brucella suis
MDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGIASIEGENGRAIGVTAGDGTFFPADLVVIGTGAVPNVELAAKAGLSIDNGIRVDEHMRTSAPHVYAIGDCASYAHFHAGRHVRLESVQNATDQAKHVARTIVGRETPYREVAWFWSDQGDMKLQTAGLSFDADRHVLSGEPEENAFSVFHFKGDRLVAVDSINRPADHMIARRLLAAGISPSEADIMAGMPRLKELLAVVAR

SEQ ID NO: 6275 - protein, 565 aa, Saccharomyces cerevisiae
MILSVICWFLVHCLFCPPSVQEIEYKKDSLFFFRYFAYWWSMRKKILKAIASWRRANYQKSSSRHFHIESHSLSIMFPRASALAKCMATVHRRGLLTSGAQSLVSKPVSEGDPEMFDILQQERHRQKHSITLIPSENFTSKAVMDLLGSELQNKYSEGYPGERYYGGNEIIDKSESLCQARALELYGLDPAKWGVNVQPLSGAPANLYVYSAIMNVGERLMGLDLPDGGHLSHGYQLKSGTPISFISKYFQSMPYHVDHTTGLIDYDNLQVLAKAFRPKVIVAGTSAYSRLIDYARFKEISQGCGAYLMSDMAHISGLVAANVVPSPFEHSDIVTTTTHKSLRGPRGAMIFFRKGIKSVTKKGKEIPYELEKKINFSVFPGHQGGPHNHTIGAMAVALKQAMSPEFKEYQQKIVDNSKWFAQELTKMGYKLVSGGTDNHLIVIDLSGTQVDGARVETILSALNIAANKNTIPGDKSALFPSGLRIGTPAMTTRGFGREEFSQVAKYIDSAVKLAENLKTLEPTTKLDARSRLNEFKKLCNESSEVAALSGEISKWVGQYPVPGDI

SEQ ID NO: 6276 - protein, 421 aa, Erwinia carotovora
MSDAIITASDTSLDALLNNSDKPILLDLWAPWCQPCKTLAPLLNTIADNTPDNLTVAKLDVEQYPAFMQRFGVRGIPTLLLFKNGQEISRQIGVKTLAQLRGWLESHEIAIQNTAQPLADTHVTWSTFYGDASLHTFLHQRLRQHAADGNIEHAFSPYWQDNKGSVSAVLAHSADIRIFERVTGLPAALGLLLEKLPSTTPEQVDALFAALAPGKTVDGVALQWLHHWLSHEENQWSDWLVDETVDGLRQQWVQAISRLLAGESVAESEWTALHQQAISWEEKAATELGLEKNIATILASLSPPPAASDADSWRSISTTLGFALAQILQIKDGWSREERATPDKRFRWFQAQEEATPSKKLTDEQITALREQWLQENSDFSAKEDAFYQRYPQLSEAQKIPLQETLWELLRRAPAFKSQLD

SEQ ID NO: 6277 - protein, 468 aa, Pisum sativum
MEPFTRDHRGSLEVFNPSSSDNINENPNPNSNSNPIPSNSWNTWTGSRAIETPPTRDSIISDEVPAATSWMALKETAPPPKSGESGSAAEQRAAEWGLVLKTDSETGKPQGVGVRGSGGGSGSRRESNNSVRSSGESSDDGREGGRGIPRVSEDLRDALSAFQQTFVVSDATKPDYPIMYASAGFFNMTGYTSKEVIGRNCRSMQGADTDPNDVAKIREAVAAGTSYCGRLLNYKKDGTTFWNLLTIAPIKDEHGKILKLIGMQVEVSKHTEGTKEKMLRPNGLPESLIRYDARQKEKANSSVTELVEAVSKRPRSLSESANRLPFIKKPTNGSNSHATQVHKTPSNSKSSRRKSESTLPSFRRKSHSGGDNFNSMHPITELPETKIISRRRSFMGFMRKSLSNNERFNDEHVIDGDSSEDDDDRFDSFDDKNITQKREKRKGLDLATTLERIEKNFVITDPRLPDNP

SEQ ID NO: 6278 - protein, 374 aa, Wolbachia endosymbiont
MSKKDYYKLLGVDRNASTDEIKKAYKKLALKYHPDRNPGNKEAEEKFKEITAAYEVLSDSEKRAGYDRYGHEGASGGFDFSQGFGSAGDFSDIFNDFFGGEFGSSSRSKAKRSTTGVPGADLRYDLEITLEDAFKGIQAPIHYVTNVKCDMCQGRGSEGATKPVQCHTCQGSGRIRTQQGFFTIERTCTTCYGEGEIIQNKCKKCNGSGRRRDEVNISVSIPKGIEEGAKVRVSGKGEAGAKGGKSGDLYVYVKITPHKIFTRNKADLHCKVPIRMTLAVLGGEIDVQSIDGAKIKVKVPEGTQTSTKLRCKEKGMPYMNSYARGDLYVQIIVETLNPNNLTKKQIELLKALEEEENASIQQQSEGFFSKVKKK

SEQ ID NO: 6279 - protein, 423 aa, Dechloromonas aromatica
MAAAAITDSAVEIAPGVHWVGALDPHLRSFDIILKTANGTSYNSYVVRGDNGVAIIDTVKENFADDFFRRLESVAEYEEITTIVLNHLEPDHSGALPELLKRAPQAKVYLSSRAQMMLKALLKPTGEKAPEYIPVTTDDEVDLGGRTLRFLHTPYLHWPDTQCTYLVEDGLLFTGDIFGCHFCDNRLFNDTVGDFRFSFEYYYAHIMRPFREYVLDAIALIEPLDIQLIAPAHGPVLRHKPRDYVHRYRELATPRLFNEARSEKTLVVFYLSAYGNTRRMAEALAAGAESLGGVRVSLYDLEGGEAEIFTDLVEEADGLAFGSPTINADAVKPIWDLLSSLTTVNIKGKLGAAFGSYGWSGEAVRLIEDRLRGLKLRVPVDGLRIKLVPDASELEQCRLLGENLARHLTGRIEHREIDMAALA

SEQ ID NO: 6280 - protein, 530 aa, Glycine max
MNAIATAAVLSLPFSFSKSSKLDTKKGLKGRFRVFAVYGEEIDKKNAWSALFDVEDPRSKVPQYKGKFLDVYQALEVARYDIQYCDWRARQDLLTIMLLHEKVVEVLNPLARDYKSIGTMKKELAELQEELAQAHQQVHISEARVSSALDKLAYMEELVNDKLLQERSTTEVSQTSSSPSTSFKPVDIEKRRSPRKSLDISGPVQSYHPHLKNFWYPVAFSTDLKDDTMIPIECFEEPWVIFRGKDGKPGCVQNTCAHRACPLHLGSVNEGRIQCPYHGWEYTTDGKCEKMPSTRLLNVKIKSLPCFETEGMIWVWPGNDPPTATLPSLLPPSGFEVHAEIVMELPIEHGLLLDNLLDLAHAPFTHTSTFAKGWSVPSLVKFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGIRYRLWRNALERGNKQPPFSK

SEQ ID NO: 6281 - protein, 112 aa, Unknown
  Candidatus Desulfococcus oleovorans Hxd3
MKKIEAIIKPFRLDDVKTALNEAGVTGMTITEVKGFGRQRGHTEIYRGAEYQVDFIPKIKLEVITDDEMSEKVVSIILEKASSGKIGDGKIFVLPVEGVVRIRTGEKGSAAV

SEQ ID NO: 6282 - protein, 310 aa, Trichodesmium erythraeum
MNLNKIESKKALLLVNFHARKAKKNLHLALTYLQNFGLEIIYKKVEFPQDFNYFIQSYKNQVNLIIIGGGDGTLNLAIDALVKTGLPLGILPLGTANDLARTLGIPISLFEACRVIATGKKRYIDLGLVNGKYFFNVASIGLSVDITNHLTKEAKLRWGVLAYAIAAIKMILQSHPFTAEISCNGESRIVKTLQVAVGNGRHYGGGMTIAHDATIDNQRLDLYSLEVKYCWQFVGILPSIWQGKYQESFGFRSLSASFINVYTRKPRPINTDGEIVTYTPAYFQIVPLALAVIVPKKLTIEKEKLKPVID

SEQ ID NO: 6283 - protein, 420 aa, Neisseria gonorrhoeae
MSNTQKQLALAKAAKKSVNTADAEEKNRALLAMADSLEAAAEDILAANRLDLKAAAGKIPDSMTDRLLLDGKRICAMADGIRAVAALPDPVGEILETSTLPNGLEIVKKRVAMGVIGIIYESRPNVTSDAAALALKSGSAVVLRSGKDAFQSARAIVAALKTGLAQTRIDPEAVQLIEDTGREGSYEMMRAKDYLDLLIPRGGAGLIRAVVENAVVPVIETGTGIVHIYIDKDADWDKALRIVYNAKTGRPSVCNSMEVLLVHEGIAADFLPKLERLLVRGRIEAGLPPVRFRLDPQAARYIGGEAAGADDFDTEFLDYILAVKTVASVEEAVGHIEARGTHHSDGIVTENRHAADYFTTHIDSAAVYINASTRFTDGGEFGLGCEMGISTQKLHARGPMGLKELTSYKYIVQGTGQVRE

SEQ ID NO: 6284 - protein, 367 aa, Glycine max
LASENNSLNSVVNDATHRSKVTVIGSGNWGSVAAKLIASNTLRLSSFHDEVRMWVYEETLLSGEKLTDVINRTNENVKYLPGIKLGKNVVADPDLESAVKDSNMLVFVTPHQFMEGICKRLVGKIREDAEAISLVKGMEVKMEGPCMISSLISQQLGINCSVLMGANIANEIAVEKFSEATVGYRLNREVAERWVQLFYTHYFIVTAVRDVEGVELCGTLKNVVAIAAGFVDGLEMGNNTKAAIMRLGLREMKAFSKLLFPSVKDSTFFESCGVADLITTCLGGRNRKVAEAYARNGGKRSFDELEAEMLQGQKLQGVSTASEVYEVLSHRGWLELFPLFSTVHEISTGLLPPSAIVEYSEKLPRSF

SEQ ID NO: 6285 - protein, 500 aa, Arabidopsis thaliana
MVNFLLVLCYCRLILIHCKTIQLTQWLSKSFLTDVLVTKVPNCVLWQYFVDADDSVPQKIVVHKDGPRGIHFRRAGPRQKVYFESDEVHACIVTCGGLCPGLNTVIREIVSSLSYMYGVKRILGIDVSFCDCNLLLTKTNTGGYRGFYAKNTVSLDSKVVNDIHKRGGTILGTSRGGHDTTKIVDSIQDRGINQVYIIGGDGTQRGASVIFEEIRRRGLKVAVIGIPKTIDNDIPVIDKSFGFDTAVEEAQRAINAAHVEAESIENGIGVVKLMGRYSGFIAMYATLASRDVDCCLIPESPFYLEGEGGLFEYIEKRLKESGHMVLVIAEGAGQDLMSKSMESMTLKDASGNKLLKDVGLWLSQSIKDHFNQKKMVMNLKYIDPTYMIRAVPSNASDNVYCTLLAQSAVHGAMAGYTGYISGLVNGRQTYIPFYRITEKQNHVVITDRMWARLLSSTNQPSFLGPKDVFDNKEKPMSALLDDGNCNGVVDVPPVTKEITK

SEQ ID NO: 6286 - protein, 87 aa, Saccharomyces douglasii
VDVLMPNVGEITGGSMRIDDMNELMAGFKREGIDTDAYYWFIDQRKYGTCPHGGYGIGTERILAWLCDRFTVRDCSLYPRFSGRCKP

SEQ ID NO: 6287 - protein, 560 aa, Rhodopirellula baltica
MSVEHNAPVRLVIVGGVAGGASAATRARRMNEQAEIILFEKDEDVSFANCGLPYHIGEEIKNRDALVVASADFLRRRFQLDVRTREEVVSINREKRCVTVVRHGATSEKDKTYEQPYDKLILAPGASPIVPALPGVDASNVLTLRNLVDMDRIKARVDSGSVRRAVVVGAGYIGLEMVEQLRRREMDVDLIELREQVLPLLDHEMARPIEDALRRNNVGIHLGVGLESIQLDGDRATSVRLSDGTELSTDLVILGIGVRPNSELAKEAGLEIGSTGGITIDEFSRTSDSDIYAVGDASEPVYGPTGTPMRVPLAGPANRSGRLAGEHAVTGQSAAATPVWGTSVVRVFDVSVGMTGLTRASAKRFGKDATSVTIVAKHHAGYFPGAEVMTLKLAFEPATGKVLGAQCVGGEGIDKRIDVIATAMHFGGTVRDLAGLDLAYAPPFGSAKDPVHMAAFAACNALDEIESFRDSDDSLDEVQVVDVRGAGEIEKTPLREASGAIHIPVDELRERLSELDRSKPTVVSCAVGVRGHIAARILRQNGFDVQNLSGGATVRNRCFE

SEQ ID NO: 6288 - protein, 221 aa, Schizosaccharomyces pombe
MARRPARCYRYCKNKPYPKSRYNRAVPDSKIRIFDLGRKRAGVDEFPLCIHLVSNEYEQITSEALEAARICANKYLVKIGGKDSFHLRVRAHPFHVVRINKMLSCAGADRLQTGMRHAFGKPNGLVARVNIGQILMSVRTKDSSRATAIEALRRCQYKFPGQQRIIVSKKWGFSQYARDEYIEKRSRGEIIPDGCYAKFLNKRGSLQEKLDLFPEASFNLA

SEQ ID NO: 6289 - protein, 215 aa, Brassica napus
MNALAATNRNFRLASRLLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMLGTEALLNEHGKSISGQRLVIQGFG

SEQ ID NO: 6290 - protein, 459 aa, Ralstonia eutropha
MSANSEHLQRGLGERHIRLMALGSAIGVGLFLGSANAIRMAGPAIMLAYLIGGAMIFLIMRALGEMAVHNPVAGSFCRYAQDHMGPLAGYLTGWNYWFLWLVTCVAEITAVAIYMGVWFPDVPRWIWALAALATMGSVNLLTVKAYGEFEFWFAMIKIVTIVLMLFGGGAMIVFGLGNGGIATGISNLWAHGGFMPNGASGVLMSLQMVMFAYLGVEMIGLTAGEAKNPRKSIPDAINSVFWRILIFYVGALFVILSLYPWNEIGAQGSPFVMTFERLGIKTAAGIINFVVLTAALSSCNGGIFSTGRMLYNLAQQGQAPAAFARVDRNGVPRRALLVSIGALLCGVLLNYLVPEKVFVWVTSISTFGAIWTWAIILVTQMQFRKNLSPAERDKLAFRMPFWPYGSWIALAFLALVIALMAYFPDTRIALYVGPAWLVLLTVLYYRLGMQARGPVTYQA

SEQ ID NO: 6291 - protein, 402 aa, Unknown
  Synechococcus sp. PCC 7002
MYGITSTANSTGNQSYANRLFIYEVVGLGGDGRNENSLVRKSGTTFITVPYARMNQEMQRITKLGGKIVSIRPAEDAAQIVSEGQSSAQASAQSPMASSTKIVHPKTTDTSVPVNIYRPKTPFLGKCIENYELVDEGGSGTVRHVTFDISEGDLRYLEGQSIGIIPPGEDKNGKPHKLRLYSIASTRHGDMEDNKTVSLCVRQLEYQDPESGETVYGVCSTYLCNLPVGTDDVKITGPVGKEMLLPDDEDATVVMLATGTGIAPFRAFLWRMFKEQHEDYKFKGKAWLIFGVPYTANILYKDDFEKMAAENPDNFRLTYAISREQKTADGGKVYVQSRVSEYADELFEMIQKPNTHVYMCGLKGMQPPIDETFTAEAEKRGLNWEEMRRSMKKEHRWHVEVY

SEQ ID NO: 6292 - protein, 502 aa, Mycobacterium tuberculosis
MDITIVGKYLSTLPEDDDHPYRTGPWRPQTTEWDADDLTTVTGEVPADLDGIYLRNTENPLHPAFATYHPFDGDGMIHVVGFRDGKAFYRNRFIRTDGFLAENEAGGPLWPGLAEPVQLAKREHGWGARGLMKDASSTDVIVHRGIALTSFYQCGDLYRIDPYSANTLGKESWHGRFPFDWGVSAHPKVDNKTGELLFFNYSKQEPYMRYGVVDQNNELVHYVDVPLPGPRLPHDMAFTENYVILNDFPLFWDPRLLERDVHLPRFYPEIPSRFAVVARRGNDIRWFEADPTFVLHFTNAYEQGDEIVLDGFYEGDPQPLDTGGTKWEKLFRFLALDRLQSRLHRWRLNMVTGAVHEEQLSESITEFGTINADYAASSYRYTYAATGKPSWFLFDGLVKHDLLTGNHECYSFGDGVYGSETAMAPRVGSSAEDDGYLVTLTTDMNDDASYCLVFDAARPGDGPICKLALPERISSGTHSAWVPGAELRRWDHAESPAAAVGL

SEQ ID NO: 6293 - protein, 97 aa, Unknown
  Synechococcus sp. PCC 7002
MATYKVTLITPDGEVSYDAPDDEYILDSAGDAGYDLPASCRAGACSTCAGKIVSGTVDQSEQSFLDDDQIEAGYVLTCIAYPQSDVTIETNKEEELY

SEQ ID NO: 6294 - protein, 110 aa, Brassica napus
MEVKLWNDKRERETYENFSELYAIIKATEKLEKAYIRDLISPSDYDTECQKLIVHFKTLSASLKDLVPSIERFAETYKMDCSAAVYRLVTSGVQATVEHRAAAVASTSSS

SEQ ID NO: 6295 - protein, 364 aa, Pyrus communis
MAPATTLTSIAHEKTLQQKFVRDEDERPKVAYNDFSNEIPIISLAGIDEVEGRRAEICKKIVAACEDWGVFQIVDHGVDAELISEMTGLAREFFALPSEEKLRFDMSGGKKGGFIVSSHLQGEAVQDWREIVTYFSYPIRHRDYSRWPDKPEAWREVTKKYSDELMGLACKLLGVLSEAMGLDTEALTKACVDMDQKVVVNFYPKCPQPDLTLGLKRHTDPGTITLLLQDQVGGLQATRDDGKTWITVQPVEGAFVVNLGDHGHFLSNGRFKNADHQAVVNSNSSRLSIATFQNPAQEATVYPLCVREGEKPILEAPITYTEMYKKKMSKDLELARLKKLAKEQQLQDLETAKVDTKPVDDIFA

SEQ ID NO: 6296 - protein, 742 aa, Oryza sativa
MAAPEAPSCYVGIARQSAAFRLMKQMGWEEGEGLGKDKQGIKGHVRVKNKQDTLGVGVDSPHNKWVYDTTQFDNILKKLKVVLFDNIFGVAEFEDDVSNSPDSTPKEAKPTNNEVTKVTRPQGSLRNTYFRYKKRERGKSVSGYSAKDLEGILVRKSDDNCKVDQEVEPTCCDEPDPIICQDTVSQADDVNWWGHKFGFKSGGFLGAKSRKNKSSATKGTSNVRQTFGEEDQENLYNLVQDKATSGKQGLGIKGLPIKVAGHRWKGNKTSFGDSDEENSTQSNELSELEEDGDEEESANDNELIDANVNTVKEMCVDVKQKHKTKVKKLCKTILRQAPAQSMKLKELKVAVEAHSESMFSNFSCRREALLFLKRKLQGSRKFNIDGKRVQLVSLFVLLMSVRKYGAQYALRYRCANGRTGNQWKQLLPHLRTRFADQCDICECITSAPFDAIDITREAVKDGADAVIAVGGDGTLHEVVNGFFCKGSPVHALDQGPDHSTALGLIPLGTGSDFARTFGWTNDPHEAIDRIVRGSFFDSSFIVCAVSPYSWSHSGHSSPGVKSKLDIGMMEGPDGNPHYFVNVADIHLSAKAGYFSSMYKRFGNLCYVFGALRAFWGHSNRDLRIKVNGGEWKTIRKVTALCIGNAKYFGGGMKITPTADPFGGDLEVVILQDFKWHDFLLKLHRLYGGTHLSVTGVSSIRVQSIEVAEKEVSADIFVQSDGEHFGFLPTKFSVLPGAVDFFC

SEQ ID NO: 6297 - protein, 381 aa, Carboxydothermus hydrogenoformans
MKRDYYEILGVARNATPEEIKKAYRKLARKYHPDVNKDDPNAAEKFKEINEAYEVLSDPEKRARYDQFGHAGVDGNFAGQGGFGGGAGINFEDIFSGFGGFGDLFDMVFGSGRKARQGPVPGDDIEAVLELTLEEAVFGGEKELRVTRTETCGHCHGNGAEPGTPIITCPTCQGRGQIHQEVKTLFGRMVRSQVCSTCRGEGKIPKTPCRECGGSGLVRKTRSITVKIPPGIDHGHRLRIAGGGEAGRFGGPPGDLYVYIKIKPHKLFKREDIHLKLEKEISFVQAALGAKVEIPTIDGGTEILEIPEGTQTGTVFTIKGKGVPVVNGSGRGNLYVTVKVVTPTKLTERQKQLLREFEEISKQKEETFKEKFNKFKNKFAL

SEQ ID NO: 6298 - protein, 486 aa, Crocosphaera watsonii
MVIKTPEWVKNAIFYQIYPDTFARKVPDRQKWLLDVPLEDWEAPPTSQGYKGGNLWGVIDKLDYLQDLGVDALYLTPIFRSACNHRYHTQDYYAIDPLLGDREAFDHLLKTAHDKGFKVVLDGVFNHASRGFFFFNDILENGPNSPWLDWFKIEGWPLSAYDGSRPANYVSWIDYRALPQFNHDNPAVREYIMQVGEYWLQQGIDGWRLDVPNCVEAEGFWEEFRERVKAVNPEAYIVGEIVSDATQWLDGKQFDGVMNYPFARLTACFVIGDRLDKETIPSFYKPYETLDAAEYAKGLEELLARHPWEIQLTQLNLLDSHDTSRFLTMAGGDRTSLQLATLLLFTFPGTPNIFYGDEIGIEGGKDPDGRKGFPTEEKWEQETLTYHKQLIQIRKKYTALRTGEYRVITAQENVYVFARILGEEGLIIAVNNGEDKTEIQIDKFDKVSSILQTKPSQIIYGEGSINWHDNQLKITMHPRSGLVIAP

SEQ ID NO: 6299 - protein, 256 aa, Bruguiera sexangula
MALSSSALRTVSSSVKVVGPARSKSATVPTQTVLPFKFTNPSLLTRSLSFSSKGSSFDSFSVPKRSFSCRSQATPSDDASRPTKVQELCVYEMNERDRGSPAVLRLSQKPVNSLGDLVPFSNKVYSGDLQKRIGVTAGICILIQNKPEKKGDRFEAIYSFYFGGYGHIAVQGAYLTYEDTHLAVTGGSGIFEGVSGQVKLQQLVYPFKLFYTFYLRGIKDLPEELTKKPVEPHPSVEPMPAAKACEPHAVVANFTD

SEQ ID NO: 6300 - protein, 500 aa, Desulfovibrio vulgaris
AGCSDVSTELKTPVYKTKLTAEEIRNSAFKPEFPKQYASYERNDETTVMTEYKGSVPFNKNDNVNPLPEGYRHAQPYLKNLWLGYPFMYEYREARGHTYAIQDFLHIDRINRYAEKGGLPATCWNCKTPKMMEWVKESGDGFWAKDVNEFRDKIDMKDHTIGCATCHDPQTMELRITSVPLTDYLVSQGKDPKKLPRNEMRALVCGQCHVEYYFNGPTMGVNKKPVFPWAEGFDPADMYRYYDKHGDLQVKGFEGKFADWTHPASKTPMIKAQHPEYETWINGTHGAAGVTCADCHMSYTRSDDKKKISSHWWTSPMKDPEMRACRQCHSDKTPDYLKSRVLFTQKRTFDLLLAAQEVSVKAHEAVRLANEYQGAKAAGYDDLMIQAREMVRKGQFFWDYVSAENSVGFHNPAKALDTLAQSQQFSQKAIDLAMEATQYGIGKDLSGDIKTIVPPILKMNRKLQQDPEFMKTHKWFQYLPVLPKADQVWDGQKRLVSAKQ

SEQ ID NO: 6301 - protein, 263 aa, Aspergillus niger
MEQTAQTPGTQQGRQQPVYDTRNGGHYGASAALSAQGYAPVAELYTGTWANVNQGLQGTARDILTTYWQHIINHLESDNHDYKIHQLPLARIKKVMKADPEVKMISAEAPILFAKGCDIFITELTMRAWTHAEDNKRRTLQRSDIAAALSKSDMFDFLIVIVPREEATSHAKRTSQTAGASAGVPGPAGATGQLPPSQHGVPHHMPPPDYSTLGQHGLQDQEYRPPTMYAGAVQSDPAAAYGQHQPQMFEGMYAAYPHLPPQQ

SEQ ID NO: 6302 - protein, 319 aa, Glycine max
  misc_feature (253)..(253): Xaa can be any naturally occurring amino acid
MAIAAAAVVVPLGLLFFASGLLVNLIQAICYVVVRPVSKSLYRRINRVVAELLWLELVWLIDWWAGVKVQIFTDHETFRLMGKEHALVISNHRSDIDWLVGWVSAQRSGCLGSTLAVMKKSSKFLPVIGWSMWFSEYLFLERSWAKDESTLKSGIQRLSDFPLPFWLALFVEGTRFTQAKLLAAQEYATSTGLPVPRNVLIPRTKGFVSAVSHMRSFVPAIYDVTVAIPKSSPAPTMLRLFKGQPSVVHVHIXWACLVVAGSVKFLQWSSLLSSWKGVAFSAFGLAVVTALMQILIQFSQSERSNPAKIVPAKSKNKGS

SEQ ID NO: 6303 - protein, 450 aa, Oryza sativa
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIEGKQIMKYMRNIP

SEQ ID NO: 6304 - protein, 515 aa, Apium graveolens
MENGTKQNKHQQKQPPSTTMQIQAPPTVLPTPTWKLILVAAIAAGVQFGWALQLSLLTPYVQLLGIPHKWAAYIWLCGPISGMLVQPIVGYYSDRCQSSFGRRRPYIASGAACVTISVILIGFAADIGYKAGDDMTKHLKPRAVTVFVIGFWILDVANNMLQGPCRALLADLCISDTRRMRSANAFFSFFMAVGNILGYAAGSYNDLYKIFPFSKTHACDLYCANLKSCFIISIALLISITVVALTLVREKQWTPEEFSSEESPSSGKIPVFGELFGALKDLPRPMLILLLVTCLNWIAWFPFILFDTDWMGREIYGGDANTGKLYDQGVRAGSLGLLLNSVVLGLTSIAVEYLVRGVGGVKVLWGVVNFVLSIGLVMTVVVSKVAEHQRRYGSNGQVLPPSAGVKAGALSLFSVLGIPLSITYSIPFALASIYSSGSGAGQGLSLGVLNLAIVVPQMIVSFLAGPFDSLFGGGNLPAFIVGAVSAAVSGVLAIVMLPKPSKDDATKLTLGGSYH

SEQ ID NO: 6305 - protein, 310 aa, Bacillus licheniformis
MRAVQNIAELIGETPLVKLNRVQPENAAQVYIKLESFNPSGSVKDRAAYQMILDAEEKGLLKPGSTIIEPTSGNTGIGLAMNAAARGYKAILVMPDTMTKERINLLKAYGAEVVLTPGDERMPGSIKKAQELARQIPGSFIPMQFDNEANPEAHRRSTALEIARAIEEIGKPLAAFVATAGTGGTITGTGEKLKALFPGITVHVAEPAGSPVLSGGKPGKHKLVGTSPGFIPNILNENVYDEILKIKDEEAYEMTRRLAREEGILVGPSSGAACFAAVETAKKLPPDKVVVCMTADTGERYLSSDLFQFD

SEQ ID NO: 6306 - protein, 112 aa, Unknown
  Candidatus Desulfococcus oleovorans Hxd3
MKKIEAIIKPFKLDDVKNVLNELGIQGMTVTEVKGYGRQKGHTEIYRGAEYIVDFVPKIKLEVVVAASMADKVVDAIAKAALTGKVGDGKIFVMPVEQAVRVRTGEKGKDAI

SEQ ID NO: 6307 - protein, 287 aa, Arabidopsis thaliana
MASSAFAFPSYIITKGASTDSFKSTSLSSSRSLVTDFHLLFSRPISSGPKYQSAKSAKPESPVAINCLTDAKQVCAVGRRKSMMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVNIKSYANNNELAVMPQDRVARLEWNRRYLAVLGVENDRLYSIRLQTPEKVFLEEEKDLRRVMDSFRVEKI

SEQ ID NO: 6308 - protein, 472 aa, Geobacter sulfurreducens
MRILFVHPHGSNWMGAGNDITAIFNLMPPLGMLSIAAFLEARGMEVEIIDCYGTGRRGRDLVDEIVRRRPDAVGFSCTTSSFLEGYALAEGLKELLPDIPVIFGGAHACSVGVSLLDRFPAIDYLVLGEGEQTLYELAAASFRNVEKIPGVGYRRDGVGTLSAARELIADLDTLPFPAYHRLPDFPRRYTLPLFSYPKAPNTSVISSRGCPYQCSYCDRSVFSRGFRFNSSEYIVEHLAYLNRDFGIRHVFFYDDLFTADRGRVARFCQLKEARRLPVTYNCIARLEHVDAELLALLKRSGCWQVNFGIESGDPEVIKKHRKYYGLDEVQTKLAMVRRAGMRVKGLFMLGLPGESAESIRRTIDYALMLPLDEINVTKFTPFPGAPIYGGIREQGEFDENWPLMNCMNFVFVPTGMSRDQLEELYNEFIRRFYRRTRIHWGYTQMLWKSPDSILRFLRHLPEILAFEMKQKW

SEQ ID NO: 6309 - protein, 167 aa, Burkholderia xenovorans
MSNGIADLFRHLTAGVYVIGVADGDRRNAFTASSIMQISFSPLLLAISISPAHESYALLGGGRVFSINVLGEQQQALARHFGTQSGRTVDKLASIPWRPGKSGAPLLRDALAHFDCRVVSDIEAGDHRLVVGRVIDGTVVSPHGRPLIYAQTGNMDMSASLFPPDFS

SEQ ID NO: 6310 - protein, 184 aa, Triticum aestivum
  misc_feature (170)..(170): Xaa can be any naturally occurring amino acid
MGANGALDDAPAAVAGEQERPRADGEEEEEEGGATVFRGTNYSLPRTIAALALWLGGIHFNVLLILASLFLFPLRLAALVVALQLIFMVIPLNDEDKLGRKIGRFICKYAMGYFPISLHVEDYDAFDSSRAYVFGYEPHSVLPIGVAALANHVGFMPLPKLKVLASSAVXHTPFLRQIWTWIGL

SEQ ID NO: 6311 - protein, 241 aa, Rhodobacter sphaeroides
MTGFVSFVSSGPGDPELLTLKAVDRLGRADAVLFDDLSSGPILAHARPEADLVGVGKRAGRASPKQDHVSRLLVDYARTGGRVVRLKSGDAGLFGRLEEEIEALEAAGIGYEIVPGVPSACAAAAAAGIPLTRRLTARRVQFLTGADVTGGLPQQNLAALADPAATTVVFMGKRTFPTLAAALFAAGLPETTPALLAEGVSTPAQRIWRGTLGTLVEEVARAGEAPALILYGPLADAEEER

SEQ ID NO: 6312 - protein, 510 aa, Unknown
  Paenibacillus sp. KCTC8848P
MLTMFASGAMAEQEMNGHKPPNSVGSGVFYEIYINSFYDSNGDGHGDLKGITQKLDYLNDGNPRSGKDLQVSGLWLMPMNPSPSYHKYDVTDYYQVDPQYGNLNDFRTLTKEAKRKGVKVIIDLVINHSSSEHPWFKEASTNPQSKYHDYYVWANEKTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGKILNSVKNGRDQGIATFAEKTLKLYKSHNKAALDAPFLSNHDQTRVMSELGGDVRKAKLPASILLTLPGQPFLYYGEEIGMKGEKPDEYLREPMRWYKGEGRGQTTWEVPKYNRGEVSVEAQMRDNDSLLQSYRTLIRLREEHEALRSHNLEPIQAGSANVAAYQRSSGKETLYVYHNLSGKPVTLQMKDADKQKRKVVFSSSKGVKIKKNAVTIPAYSSLITK

SEQ ID NO: 6313 - protein, 926 aa, Silicibacter pomeroyi
MADGAHVEMVSFTLNGEEVTVPEGLTIWEAAHGRGLVIPHLCHKPDPGYRPDGNCRACMVEVAGERTLVASCIRPVAAGMVVTTDSARAEGARKMVVELLLADQPEVAHDASSHFHAMAGLNGVSESRFPARDAAHVPLLDASHVAMRVNLDACINCNLCVRACREVQVNDVIGMAGRGAGAQVVFDQNDPMGASTCVACGECVQACPTGALMPATVLDAEQAGDSKDYDREVTSVCPFCGVGCQLSFKVKDNKIKYVTGVDGPANESRLCVKGRFGFDYIDHPHRLTKPLIRRADAPKGLNVDPGNPLSHFREASWEEALDFAARGLADLRAQKGSYVAGFGSAKCSNEEAYLFQKLIRQGFGHNNVDHCTRLCHASSVSALLENVGSGAVTATFNEIENADVAIVIGCNPIENHPVAATYFKQFTKRGGKLIVCDPRGVGMGRFATHRLQFKPGADVSMLNAMMHVIVEEGLYDQAYIDQFTENWEEMKAHLADYSPEKMEPICGIAAGELRDAARTFAAGKAGMIFWGMGVSQHIHGTDNSRCLISLALMTGNVGKPGAGLHPLRGQNNVQGASDAGLIPMFLPDYQSVTDDGVRSAFTSVWNSGDFSNQKGLTVVEIMHAIHDGDIRGMYILGENPAMSDPDVDHARAALAMLEHLVVQDIFLTETANYADVILPASAWAEKTGTVTNTNRQVQMGRPAVAPPGQAKEDWWIEVELARRLGLDWNYSHPSEVFAEMKRNMKSLDNITWARLEGEAVTYPSLSPEDPGQAIVFGDGFPRANKRARFTPAKIVEPDERPDADYPFVLITGRQLEHWHTGSMTRRASVLDAVEPEANCSMHPATLRAMGIEPGDMIRLTTRRGSVQVMVRADRAIAQDNVFLPFAYVEAAANILTNAALDPYGKIPEFKYAAVKVERTDTAASAV

SEQ ID NO: 6314 - protein, 509 aa, Geobacter sulfurreducens
MNRRDFLKTAGLTGIALGLPGCARSLPFGRDVFPDFGDDARPYLGLATSLREEHDYEARVEGTIPAGLRGTLYRNGPALFDRGGMRKRTLLDGDGMVQAFRFGDRGIRYANRFVRTRKFVEEEAAGRFLHPTWSTQAPGGIWTNVWPTERLLSQAGITVFPWRGRLYAFDESSFPYELDPDTLATVGETTFGLPRDLTTYSAHGKFDPVTGEWLHFGIRYGPRTFVHLTTFNADGTLRRHRALELPRAIYMHDWFVTERHVVFHLHPVEIAYWPFLLGIRSMAESLRWRPERGTILMVAERDGEAPPRLVETEACYLWHTFNAWEERGKITADFVGYRNPDHFISDDPVITAVMLGRRGTYSYPGEVMRYRIDPARGTAAREVLHQGSCEWPRIDERLRCRPHRTGYMLRCLPGEFFWSIVMGLDPVTGRTDEYSFGRGVYCTEPVFAPRPDTLAGGPGWLLVELYDSRTRTSSLAILDADRIADGPLALVRLTHHVPFSYHGWWQPAS

SEQ ID NO: 6315 - protein, 221 aa, Oceanicola granulosus
MPNLNNQPLRGLLLSAAVAAGAWLQAGPALAQADSTLTVAGGCFWCVEADFERVTGVTEAVSGYTGGSVENPTYREVTRGGTGHYEAVEIMYDSDVVDRRRLLNLFFRSIDPTDAGGQFCDRGESYRTAVFVASEEERQMAEAAKAAAEAELGQEIVTPILDLAEFYEAEDYHQDYYKGEQIVLTRGGPKSQASAYKFYREGCRRDERIRELWGDDAPFLP

SEQ ID NO: 6316 - protein, 416 aa, Neisseria gonorrhoeae
MFSKSVTLAQYDPDLAAAIAQEDRRQQDHVELIASENYVSCAVMEAQGSQLTNKYAEGYPAKRYYGGCEYVDIVEQLAIDRVKELFGAAYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAVMAEELVKRGLRIVSGRTESHVFLVDLQPMKITGKAAEAALGKAHITVNKNAIPNDPEKPFVTSGIRIGSAAMTTRGFNETDARVLSNLVADVLANPEDEANLAKVRGQVTALCDKYPVYGT

SEQ ID NO: 6317 - protein, 138 aa, Idiomarina loihiensis
MSEFINILRHERRLKAALKELDLNELESVKSKFDSVISQRREEEAEKQRQNEAKQKKIEEFKSAMADAGIELSDILEQELGGEPIVKTTRKKRAPKPPKYEYTDENGEKQTWTGQGRMPKAMKTAVDNGKSLEAFLIK

SEQ ID NO: 6318 - protein, 479 aa, Anabaena variabilis
MSDLVLFWHRRDLRITDNIGLATARQHSSKVVGVFCLDPNILERDDVAPVRVTYMIGSLQELQQRYVQAGSQLLILRGDPVQAIPHLAEALNAKAVFWNWDVEPYSQTRDRAIIATLKDKGIQCLTHNWDQILHSPDEIRSGSNTPYTVYTPFWKNWSSKPKAKPVETLHNVEGLTEAEQELAQKAGVKALPTAKDLGFFWDADLIIAPGEAAAQAKLAEFTAKAITEYQEQRNFPGVNGTSQLSAALKFGVIGIRTVWQTTLEALENSRSEETTTSIRTWQQELAWREFYQHAMYNFPELADGAYRATFKNFPWETNEEHFQAWCEGKTGYPIVDAAMRQMNESGWMHNRCRMIVASFLTKDLLINPQWGEKYFMQKLIDGDLSANNGGWQWSASSGMDPKPLRIFNPASQSQKFDPDAEYIRQWVPELRSMDTEYLVTGKITPLERHAVGYVKPIVDHQKQQQLFKQRYQQQKAIGI

SEQ ID NO: 6319 - protein, 348 aa, Staphylococcus aureus
MTQQQNNKRTLKNKHTYQNEPLPNRKDFVVSFITGALVGSALGLYFKNKVYQKADDLKVKEQELSQKFEERKTQLEETVAFTKERVEGFLNKSKNEQAALKAQQAAIKEEVSANNLSDTSQEAQEIQEAKREAQAETDKSVAVSNEESKAVALKVSKEESQAERLANAAKQKQAKLTPGSKESQLTEALFAEKPVAKNDLKEIPQLVTKKNDVSESETVNIDNKDTVKQKEAKFENGVITRKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKANSKIEKRTFND

SEQ ID NO: 6320 - protein, 150 aa, Silicibacter pomeroyi
MTSALTSIGGEDALRDLVETFYDRMETDPEAWPLHRLHFRGHGLNHTRQAQFEFLSGFLGGRAYYRERFGHMNLREIHAHVPIREADAELWLKTFDAALAECGLRGEVVDKFRATLRRAALMLVNDVPDWREESDGKARAAAGCPADGAA

SEQ ID NO: 6321 - protein, 501 aa, Clarkia modesta
MASPALISETEAWKDLKAHLEDIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFV

SEQ ID NO: 6322 - protein, 332 aa, Pseudomonas syringae
MIKHQLARFNRLDLISAPTALEKLERLSIWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADEQLHALAARLRSSGKKPYLVPIGGSSPVGALGYVRAGLELAEQIKQTGIEFAAVVLASGSAGTHSGLALALAHELPQLPVIGVTVSRSEEAQLPKVQGLAERTAELLGVALPEHFKVELWDEYFAPRYGEPNAGTLSAIKLVASHEGLLLDPVYTGKAMSGLLDGIGRQRFNDGPLIFLHTGGAPALFAYPDAFDQ

SEQ ID NO: 6323 - protein, 112 aa, Methanocaldococcus jannaschii
MKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGKEAL

SEQ ID NO: 6324 - protein, 474 aa, Ralstonia eutropha
MKKTLFLQAPSFDGFDGGAGSRYQAKREIKSFWYPTWLAQPAALVPGSRVLDAPADELTPQQTLDIAVDYDLVIVHTSTPSFPTDAKFAEELKKRKPGVMIGMVGAKPAVDPGGTLGASGAIDFVCREEFDYTCQDVAAGKPLKDILGLSYRLPDGSLEHNGQRPMIENMDELPFVAPVYKRDLKIENYFIGYLKHPYVSIYTGRGCRSRCTFCLWPQTVGGHRYRTRSAESVIAEVKWIKENMPEVKEIMFDDDTFTDFKPRVEEIARGLGKLGVTWSCNAKANVPYSTLKIMKENGLRLLLVGYESGDDQILLNIKKGLRTDIARRFTEDCRKLGIQIHGTFILGLPGETQQTIEKTIAYAKEINPHTIQVSLAAPYPGTTLYQQAVDNGWLEENKVINLVNDKGVQLAAISYPHLSKEEIYHGVERFYKQFYFRPGKIWEIVREMLGSWDMMKRRLREGVEFFRFLRSHEA

SEQ ID NO: 6325 - protein, 569 aa, Clarkia modesta
MATPSLISETEAWKDLKAHLEGIKRTHLRELMGDTERCQSMMVEFDNIFLDYSRQQASPDTINKLYKLADAAHLKQKIDRMYNGDNINSTENRSVLHVALRAPRNSAICSDGKNVVPDVWNVLDKIKDFAERVRNGSWVGATGKELKNVIAIGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGANSIDQYFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 6326 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELDLSHSGMLLRGYRNLFASLLLIPAGLAVTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRKSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 6327 - protein, 437 aa, Sinorhizobium meliloti
MNDSLSRLPREPADRLTKPFMRFLRIEATAGIILLLSTLLALGLANTAWSSSFLAFWEMPAGVRLGDIGIYRSLKHWINDGLMTFFFFVIALELKRELVLGELRNPRMAALPVAAALGGMAAPAGIYLLLVGGGPGASGWGTVMSTDTAFVIGCLALLGSRVPGSLRLFLLSLAIFDDIGAILIVAVGYGEPLNWVALGTGGLGFAFVAGIALLGIRSIPVYFAMGSAIWLAFDASGVHATLVGVILGLMTPARRWVSEIRLHAILDRVIAHPPGDHRSRDTAARSDLHRAGVATREAVSPIERLEIALHPWVAFAIMPLFAVSNAGIPIEDANFDVPLTIAIVVAFVVGKPAGIVLFSFLAVKLRLASRPEQLSWSLLAAGSLLTGIGFTMALFIAELAFEPELLIPVKLGVLGASVISAALGFMALTLLTSPNRR

SEQ ID NO: 6328 - protein, 352 aa, Glycine max
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPNGYYDTEHTKNIRDWKEVFDFQAKDPTFIPVTFDEHDDRVTHWTNHSPQYPPNFRDIIEEYVQEVEKLSFKLLEIIALSLGLEAKRFEEFFIKDQTSFIRLNHYPPCPSPHLALGVGRHKDIGALTILAQDDVGGLEVKRKADQEWIRVKPTPGAYIINVGDLIQVWSNDLYESVEHRAMVNSEKERFSIPFFLFPAHYTEVKPLEELTNDQNPAKYRPYNWGKFLVRRKGSNFKKLNVENIQIYHYKIA

SEQ ID NO: 6329 - protein, 368 aa, Streptococcus pyogenes
MEHKWKLWLFIVGVVLLIGGASVLIQKGQAKAFSQGKPQLPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 6330 - protein, 472 aa, Pseudomonas aeruginosa
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 6331 - protein, 430 aa, Bacillus halodurans
MTILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 6332 - protein, 962 aa, Idiomarina loihiensis
MSSTTLTQLEHHDEFISRHIGPSADEQKAMLAELGVDSLEALTKDTVPGAILREPFLQTGEPQTEREALARLKNIAKKNQICTSYIGMGYYDTVVPNVILRNVLENPGWYTAYTPYQPEIAQGRLEALLNFQQMTMDLTGLDLASASLLDEATAAAEAMAMAKRVSKNKKSNAFFIADNVYTQTIDVVKTRAEYFGFDIIVGPAREASDHDVFGALLQYPDKQGQLHNIEQLIGELQEKKAIVAVASDLMSLLMVKSPGEMGADMVFGNAQRFGVPMGYGGPHAAFFATRDKFKRSLPGRIIGVSKDSRGRPALRMAMQTREQHIRREKANSNICTAQVLLANMASFYAVYHGPDGLRRIANRIHRLTDIVALGMQDKGVKLVNSHWFDTLTFEMKENAADVLARSKALGLNLRVDGEGMFGISLDEAKTRDDVESLFAALFGDNHGLDIDVLDSRVAGGDVESIPADLVRQSQYLQHPVFNEYHSETEMLRYIKKLENKDLALNHSMISLGSCTMKLNATAEMIPVTWPEFGQLHPFCPAEQAQGYYELVSTLSEWLIDVTGYDAMSMQPNSGAQGEYAGLLAIQKYHESRGDGHRNICLIPSSAHGTNPASAQMMNMKVVVVDCDKHGNVDMDDLKAKAEEAGENLSCIMVTYPSTHGVYEEGIKDICDLVHNYGGQVYMDGANMNAQVGVTSPGYIGSDVSHLNLHKTFCIPHGGGGPGMGPIGVKQHLAEFLPNHSIVNIDGPKAGNGAVSAAQFGSASILTISWMYIAMMGGRGLREASETAILNANYLAEKLSKHFKILYRGRNNRVAHECIIDLRPMKDAAGIAEIDVAKRLQDYGFHSPTMSFPVAGTIMVEPTESESKAELDRFIEALVSIKAEAEKVAAGEWPKDNNPLVNAPHTLADITDAEWDRPYDRKTATYPVEAVGYDKFWPTVNRIDDVFGDRNLMCSCPSIEEYR

SEQ ID NO: 6333 - protein, 498 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVKSSD

SEQ ID NO: 6334 - protein, 162 aa, Arabidopsis thaliana
  misc_feature (121)..(121): Xaa can be any naturally occurring amino acid
MVRKQFQQAKTGIEALKSMDANNYLKKVGLGRDDMFFWKQVGKALLCTYTIFGMAWIYNETSPLGWWTLKPRPKEERELAHLYERREFPYPGDTEAMEDFVAKGGMIGTAIGPKGIVESEXEADNYQKEMEKKKFDKEAQKLWLRMRNEVITELQEKGHNLE

SEQ ID NO: 6335 - protein, 505 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 6336 - protein, 161 aa, Aspergillus nidulans
MTIYLLHARLIPKEDRKKIHEYLFREGVLVAKKDFNLPKHGDIDTKNLYVIKAMQSLNSRGYVKTQFSWQYYYYTLTPEGLDYLREWLHLPAEVVPATHIKQQRSHAPPRGMMGGEERERRPRPPREGGYRRREEGKEGAPGEFAPSFRGGIGRGRGAPAS

SEQ ID NO: 6337 - protein, 545 aa, Xanthomonas campestris
MHSIDVVLAMLLAVAASGYLIRILPFSLPLPLVQIALGAVVSGVFDAGHELEPELFFLLFLPPLLFLDGWRIPKQGLFRDKAAILELALGLVVFTVVGAGLLIHWLIPAMPLAVAFALAAIISPTDPVAVSSIASKVQIPKRLMHILEGESLLNDASGLVCFQFAVAAVLTGTFSVATASLTFLWVALAGLGLGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNLFKAQRRGEAHVSPPWRIVVAVSLAGVRGAITLAGVLTLPLVLEDGSPFPARQLAIFLAASVILVSLLVASVALPRLLRGLELPEEEDEQLKEDLAVKAASQAALEAVEKLRQRLVEDSAHAERYNAAANQVSQRYQRKLGAVDMAETDPEEAGAFEQALRQFRHAALVAERNELFKLARRREISDDLSRRLVRNLDLIESRKRA

SEQ ID NO: 6338 - protein, 150 aa, Pediococcus pentosaceus
MSNYINDLRQKVGNAPLILNTATGALFNNAGEVLLQERVDTKDWGFPGGYLEYGETYKKAIMREFQEDTGLSVIPEKLIQNTDDTFYKYPNGDQIQSINQFFLVRYLEGTLLSVKTGETTRLKYFKLDQPPQFFNEQHAEMFKKIQRMRE

SEQ ID NO: 6339 - protein, 389 aa, Arabidopsis thaliana
MAAPEAPVKYVGICKDSAAFKLMKSMGWEEGEGLGKDKQGIKGYVRVTNKQDTSGVGLDKPNPWAFDTTQFDNILKKLKVQAAPTKTSKNDDDKEDESEDDAVKSEPAKLKTVAKVTRPQGRYKRREKGKLVNSYSSKDLEGILVKRTEDPSPAVCDIADSMDIEIISEDQDASIKEQKIEEPSSNWWGFKSGFVSGGLLGAKSGKKKLKASERKMFSENDQENLYNMVQDKATAGKQGLGIKDRPKKIAGVRYEGKKTSFDNSDDDDDDDDDDDEEDEEEDEDESEADDDDKDSVIESSLPAKRKHDEIIEPKIKLKNLCKQIVKKDAGKGGFMKLKQLKSLIDEQAPSVLSEFSSRKDAIAYLKLKLERSGKFVVEGKKISLVSSKK

SEQ ID NO: 6340 - protein, 284 aa, Wolbachia endosymbiont
MNMANLPEVTVRDLARSGVHFGHKISRWNAKMAPYIYGVHQENRIHIIDLRKTLPLLQAAMKVLYNVAFQGGRILFVGTKFQALDIIASEAIRCGQYYVNYRWLGGMLTNWGTISSSIKTLVQYEKVLNAENSILTKKELGNIEKKRQKLDKALGGIREMGAVPDVLFIIDTNKEHIAVKEAEKLEIPVVAILDTNSDPDGITYPIPGNDDSRKSIELYCRLAADSILAGMESSLARSGVKVGDIKDEEFIQEKGDSIIRTKKGRSKVYKEDEKEVVTNEDESR

SEQ ID NO: 6341 - protein, 313 aa, Yarrowia lipolytica
MDEVNTTTCRFYANKYPEVDDLVMVNVKEIADMGAYVKLLEYDDIEGMILLSELSRRRIRSIQKHIKVGKNEIVVVLRVDKDKGYIDLSKRRVSAEDVEKCEEKYTKSKTVHSILRHVAEKHKYSLEKLYEQVGWPLSTKYGHAYDGFKLSITNPDQVFGDLEDPASPAIMEDLKAQIGRRLTPNPVKVRADIDITCFAYEGIEAIKKALAAGETLNSELVPVKVKLVAAPLFVLTSTCLDKQKAIDTLGEAIEKIRESIEASGGSLTVKMEPKAVTETDDAELAKLMEKTEQQNKLVDGDDDDADEEAGDFE

SEQ ID NO: 6342 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 6343 - protein, 391 aa, Rhodopirellula baltica
MATKTCYYEVLKVERTATKQQVDRAYRKLAIKYHPDSNRDDGSATAKFKEATEAYEVLSDANKRARYDQYGHAGVEGATQQYGDVEDIFEAFGDLFGGGFGDFFGGGSRRGGGRRRVRRGADVRCDVTLTLEEAARGCHKDIVFRRRVSCDTCDGSGAAAGSEPVTCTMCGGQGQVIQSAGILRVQTTCPTCKGAGKQIGEPCGKCRGTGTQNEKAEMNVEIPAGVDDGMRVRLQGEGEPSPDGGPNGDCYCFISVKEHNLFKREGQHLILQMPISYAQAALGATINVPTLDGPHELTVPAGTQTGHVFTVRGQGIVDPRSGRTGDLLVQIFIEVPKKLSDKQQKLLRELAELDHDSVLPERTSFLDKLRHFFDPEPEEAGTGSTDTEKDS

SEQ ID NO: 6344 - protein, 613 aa, Arabidopsis thaliana
MESCDCFETHVNQDDLLVKYQYISDALIALAYFSIPLELIYFVQKSAFFPYKWVLMQFGAFIILCGATHFINLWMFFMHSKAVAIVMTIAKVSCAVVSCATALMLVHIIPDLLSVKNRELFLKKKADELDREMGLILTQEETGRHVRMLTHGIRRTLDRHTILRTTLVELGKTLCLEECALWMPSQSGLYLQLSHTLSHKIQVGSSVPINLPIINELFNSAQAMHIPHSCPLAKIGPPVGRYSPPEVVSVRVPLLHLSNFQGSDWSDLSGKGYAIMVLILPTDGARKWRDHELELVENVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPTYAIGDEKRLMQTILNIMGNAVKFTKEGYISIIASIMKPESLQELPSPEFFPVLSDSHFYLCVQVKDTGCGIHTQDIPLLFTKFVQPRTGTQRNHSGGGLGLALCKRFVGLMGGYMWIESEGLEKGCTASFIIRLGICNGPSSSSGSMALHLAAKSQTRPWNW

SEQ ID NO: 6345 - protein, 760 aa, Nicotiana tabacum
MLRWLFLGLLISLVIISVKANDTEFSNCNCDEEGMWSIHNILECQKVSDFLIAVAYFSIPLELLYFISCSNIPFKWVLIQFIAFIVLCGLTHLLNGLTYNSAHPSFQLIMSLTVAKILTALVSCATAITLLTLFPLLLKIKVRELFLTQNVMELDQEVGLMKKQKEVCMQVRMLTREIRKSIDKHNILYTTLVELSKTLNLHNCAVWMPNENRSVMNLTHGLSPGSAVEYHRSLPIDDPDVLEITKDKGVRILRQDSVLAAASSGGPGEPCTVAAIRMPLLRASDFKGGTPVLVDTRYAILVLVLPSGDFDWSSNEMEIVEVVADQVAVALSHATVLEESQLMREKLEIRNGLLQQAKENAVKATQARNSFQKVMNNGMRQPMHSVLGLLSILQDENFTSSNQRIIIDTMMRTSTVLSTLTNDAMDISEKDEGRIPVEMMPFQLHSLIREASCLVKCLCIYKGFGFSTDFPNSLPNLVMGDEMRTFQVLLHMVGHLLNISFGSGSVVFRVGTEDGNDKIWGARRHSIVDEYVTIKFETKINLESSQRNSSMSSIHFGGRRYNSKELKEGLSFRMCKKLVQMMQGNVYMSSNSEGRAQGMTLILRFLKQSSFRKHMFDLGNPLEQAISSSMFKGLQVLLADDDDVNRMVTKKLLEKLGCQVIAVSTGFQCLSAMGHSKTSIQVVILDLHMPEMDGFEVAIRVRKFHSHGWPLIIALSATSEELVWDRCLQVGINGLIRKPVLLQGMAEELQRVLQRAGEGF

SEQ ID NO: 6346 - protein, 292 aa, Helicobacter pylori
MICASVLQHAYCGSRKKTIEHTANLLEQALKKHPKTNLVVLQELNPYSYFCQSENPKFFDLGEYFEEDKAFFSALAQKFQVVLVASLFEKRAKGLYHNSAVVFEKDGSIAGVYRKMHIPDDPGFYEKFYFTPGDLGFEPIVTSVGKLGLMVCWDQWYPEAARIMALKGAEILIYPSAIGFLEEDSNEEKKRQQNAWETIQRGHAIANGLPLIATNRVGVELDPSGAIKGGITFFGSSFVVGALGEFLAKASDKEEILYAEIDLERTEEVRRMWPFLRDRRIDFYNDLLKRYI

SEQ ID NO: 6347 - protein, 921 aa, Oryza sativa
MSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDVEGNSKELVRGGKALVVCGGKKELCVTLPPSAPFGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPLKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 6348 - protein, 76 aa, Brassica napus
  misc_feature (45)..(45): Xaa can be any naturally occurring amino acid
  misc_feature (54)..(54): Xaa can be any naturally occurring amino acid
  misc_feature (56)..(56): Xaa can be any naturally occurring amino acid
  misc_feature (64)..(67): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(74): Xaa can be any naturally occurring amino acid
MNAAVFTSSALSLPISFCKTRSSQLTRKKGVKGEFRVFAVFGEDXGLVEKKSQXGXLFDVLDPXXXXPPXKXKXLV

SEQ ID NO: 6349 - protein, 391 aa, Pseudomonas syringae
MTQVPNRETPRGIAILARFLASESAGGIVLMVAALAALIVANSPLSAGYFSILHSVWLGLSVELWINDGLMAIFFLMVGLEIKREVLAGGLASWGQRALPGFAAAGGMLVPALIYIAINWGNPQTLSGWAIPAATDIAFALGVLSLLGNRVPTSLKVFLAALAILDDLGAVTIIAFFYSAGLNLPMLAAAFVTLAVLIVMNRLNVRRLLPYLLLGALLWFFVLQSGVHATLAGVALALCIPMGKPEEEARSPLLFLEEKMHYWVAFAVVPIFGFANAGVSLAGITLGNLVDPVPLGVALGLFVGKQIGVFLAAVLAIRAGLAVLPEGSNWVQLYGVAMLCGIGFTMSLFIGNLAFPGSQHLIDEVKVGVLIGSGLAAIAGIVLLRSRFSRP

SEQ ID NO: 6350 - protein, 415 aa, Clostridium perfringens [sequence omitted]

SEQ ID NO: 6351 - protein, 431 aa, Silicibacter pomeroyi
MNASHQDTGFFTEALSERDPELFGAITSELGRQRDEIELIASENIVSAAVMQAQGSVMTNKYAEGYPGRRYYGGCQYVDIAENLAIERAKQLFGCGFANVQPNSGSQANQGVFQALIKPGDTILGMSLDAGGHLTHGAAPNQSGKWFNAVQYGVRQQDNLLDYDQVEALAKEHRPKLIIAGGSAIPRQIDFARMREIADMVGAYLHVDMAHFAGLVAAGEHPSPFPHAHVATTTTHKTLRGPRGGMILTNDEDIAKKVNSAIFPGIQGGPLMHVIAAKAVAFGEALRPEFKTYIQQVIANAQALSDQLIKGGLDTVTHGTDTHVVLVDLRPKGVKGNATEKALGRAHITCNKNGVPFDPEKPTVTSGIRLGSPAGTTRGFAETEFRQIADWIIEVVDGLAANGEDANEAVEDKVKAQVAALCAKFPIYPNL

SEQ ID NO: 6352 - protein, 269 aa, Clostridium perfringens
MRKALKDSKRIVVKVGTSTLTYENGSVNLMRIEKLSRVISDICNMGKEVVLVSSGAIGVGVGKLRLEKKPETIREKQAVAAVGQCALMHIYNKFFGEYSHVVAQVLLTRDVLENERMKNNVCNTFDTLLEKGIIPIVNENDAISIDEIQNILNFGDNDNLSAIVSTLVNADTLIILSDIDGFYDSDPRTNEDSKMLKEVYEITPEIEECAGGAGSNRGTGGMVTKLSAAKVATSNGIDMILANGENPEILIDILNGEDIGTMFVAKKGE

SEQ ID NO: 6353 - protein, 957 aa, Erwinia carotovora
MTQTLSQLEHDGAFIERHIGPSVSQQQHMLSVVGATSLDALIRQIVPADIQLPSPPAVGEAVTEHEALAELKAIAGRNQRYKSYIGMGYSAVLMPPVILRNVLENPGWYTAYTPYQPEVSQGRLEALLNFQQVTQDLTGLDLASASLLDEATAAAEAMAMAKRISKLKQAERFFVADDVHPQTLDVVRTRAETFGFEIVVGKAEEALKDDAVFGVLLQQAGTTGELHDYSDLMAALKARKVVSCVASDIMALVLLTAPGKQGADIVFGSAQRFGVPMGYGGPHAAFFACRDEHKRAMPGRIIGVSRDAAGNTAFRMAMQTREQHIRREKANSNICTSQVLLANIAGMYAVFHGPEGLKRIAGRIHRLTDILAAGLTQGGLLLRHRSWFDTLTIEVADKDVVLSRALSFGINLRSDLASAVGITLDEATTREDVLALFAVLLGDDHGLDIEALDASIAQEVATIPAGLLRHDAILSHPVFNRYHSETEMMRYLHRLARKDLALNQAMIPLGSCTMKLNAAAEMLPITWPEFAELHPFCPPEQALGYRQMIEQLSGWLVQLTGYDAVCMQPNSGAQGEYAGLLAIRRYHESRNEAGRHLCLIPSSAHGTNPASAQMAGMEVVVVACDKQGNIDLHDLREKAQAAGEQLSCIMVTYPSTHGVYEETIREVCQIVHQYGGQVYLDGANMNAQVGITTPGYIGADVSHLNLHKTFCIPHGGGGPGMGPIGVKAHLAPFVPGHQVVKIDGVLTEQGAVSAAPFGSASILPISWMYIRMMGAEGLKQASQMAILNANYIATRLQQAYPVLYTGRDGRVAHECILDIRPLKESTGISEMDIAKRLIDYGFHAPTMSFPVAGTLMVEPTESESQVEIDRFIDAMLAIRSEINRVAQGEWPLDDNPLVNAPHTQAELVADWAHPYSRELAVFPAGSEHKYWPSVKRLDDVYGDRNLFCSCVPMSDYA

SEQ ID NO: 6354 - protein, 340 aa, Streptococcus pyogenes
MKKQLRARLIYNPTSGQELMRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDDALVLDQDELEIEEIVKKFAHEVEDLGQELEE

SEQ ID NO: 6355 - protein, 549 aa, Clostridium perfringens
MSMFCFQCQETAGCKGCTVRGVCGKTEDVAKIQDLLIFVTKGLATVANEGRKVGIVDKKVNRMIIDNLFITITNANFDFKAIEKRVKDTLVAREELKERVQAKGGNPIGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNIGVRNNPGILISGHDLKDLEMLLEQTEGTGVDVYTHGEMLPGHYYPKFKKYAHFAGNYGNAWWLQNKEFASFNGPILMTTNCITPVQDSYRGRIFTTGAVGYEGCIHITADENGYKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 6356 - protein, 286 aa, Unknown
  delta proteobacterium MLMS-1
MILSDSQVDTVETSPAGWPRWAICLQFRVVFDDPAANLALVRQRLAELAPAAGSLVVLPELWAAGFAYPSLAWQAARTPELLAALAAEAADRGITVAGSLPEAAVATDGGYLYYNTLYLVEPAGVAGKYRKQRLFAPLGEDRYFRAGTDDHGAGEPRGPLPAAWGPVAALVCFDLRFPELATAQVDRGAELLLVSAQWPRARRQHWRVLLQARAIENQIFVVACNTCGRVGESDFAGTSMIIAPDGEVLAEAGGTPQALGAPLDFSRLAAARRLFRTRSPGPTTCG

SEQ ID NO: 6357 - protein, 146 aa, Idiomarina loihiensis
MQYLHTMVRVHDLEQSLNFYCDLLGLKEVSRKDVEKGRFTLVFLAAPDDIERAKKDQAPMLELTYNWDPQTYRGGRNFGHLAFRVENIYELCQKLMDNGVIINRPPRDGHMAFVRSPDNISIELLQKGDSLPPEEPWTSMENIGEW

SEQ ID NO: 6358 - protein, 334 aa, Crocosphaera watsonii
MRYDDTRGPGKGGVRYHPNVTMDEVQSLAFWMTFKCALLNLPFGGAKGGITLNPKELSKQELERLSRGYIEAIADFIGPDIDILAPDVYTNQMIMGWMMDQYNIIQRKISPGVVTGKPQTMGGSQGRDTATGTGAYYVIQTILPKFELIPEKTTVAVQGFGKAGAVVAELLGKVGYKVVAVSDSKGGIYAEQGLDIVSIRNYKEEHQGIAAIYCQDTVCNIGEHQSITNEELLGLDVDVLIPAALENQITEENADNVRAKFIFEVANGPINSAADTILDEKGIYVFPDILVNAGGVTVSYFEWVQNRSGLYWTKTEVNQRMRDKMMSEAQEVWV

SEQ ID NO: 6359 - protein, 450 aa, Listeria monocytogenes
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLSDNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEDVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 6360 - protein, 590 aa, Kluyveromyces lactis
MTITKFVSEHPQTDPKWWKEAIVYQVYPASFKDSNHDGWGDIKGIDSKLEYIKELGANAIWICPFYDSPQEDMGYDISDYEKVWPRYGTNEDIFNLIDRAHGLGIKIIVDLVINHCSSEHAWFKEARSSLDNPKRDWFIWKAPKGFDSNGKPIPPNNWRSFFGGSAWEYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKEQEITQLFEFEHVSVGRKPGNVGVVNFKLSEFKDGIAAAFQFIDKTDSWSTVYIENHDQPRSVTRFGDDSPEYREISAKLLALLETSLTGTLYVYQGQELGMINFRDWPIEKYEDVEVKGMYKMMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANEKLFAFTKKYGEKVLYVVLNFSKEEIEFSFLEGYNSYDYIFGNYPEAEIDTGSNKLQPWEGRFYYAN

SEQ ID NO: 6361 - protein, 622 aa, Arabidopsis thaliana
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYILMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNDNQYVEREEFSFGNKDDDSKVLATDGGNNISNKTTQAKVMPPTSVMTRLILIMVWRKLIRNPNSYSSLFGITWSLISFKWNIEMPALIAKSISILSDAGLGMAMFSLGLFMALNPRIIACGNRRAAFAAAMRFVVGPAVMLVASYAVGLRGVLLHVAIIQAALPQGIVPFVFAKEYNVHPDILSTAVIFGMLIALPITLLYYILLGL

SEQ ID NO: 6362 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWTPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 6363 - protein, 154 aa, Crocosphaera watsonii
MPLPTSLVTLEGTALPLSELENKVILFVNVASKCGLTPQYSGLVQLDKKYGERGFKVVAVPCNQFGEQEPGTPAEIKEFTSTKYDVEFTLLEKQDVNGSNRSPLYQFLVKDGEDIAWNFGKFLVGRDGEVVARFEPATAPDDAQLEAAIDKALG

SEQ ID NO: 6364 - protein, 117 aa, Listeria monocytogenes
MSTFKVGDVVSGKVAGIQSYGAFVALDNSTQGLVHISEITHGFVKDIHDFLEVGQEVKVKILDIDEEKNKISLSIRATEEAPKEQPTKKKQVSSSENDEGFNTLRDKLEEWIKKADK

SEQ ID NO: 6365 - protein, 140 aa, Triticum aestivum
SRSSSVSSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRGRNSWNCFFNATGIISITDPSLGTCKYA

SEQ ID NO: 6366 - protein, 907 aa, Dechloromonas aromatica
MRTEVKSTCCYCGVGCGVLIETESGVVTGLRGDSEHPANRGRLCTKGATLNQTVNPTYRLQFPEKRLVRGQGGQRLSWELALDEAAERFATTIREYGPDSVAFYISGQLMTEDYYVFNKLAKGLIGTNNVDTNSRLCMSSAVAGYKQTLGADAPPCSYADILRAKLIFISGANPAVAHPIVFRYIEDAKVAYPDLKIIVADPRRSESAEIADLHLPIKPGSDIALFNGMLHVLINEDLVDRAYVEAHTSGFDALAEIVKNYSPDQVAALCGVPAEAIVQAARWFGASDASLSLYCQGLNQSAHGTHNNAGIIHLHLATGQIGKPGAGPFSLTGQPNAMGGREVGGLSNLLSAHRDLANPAHRAEMARFWGVPFVPATPGKSAVDLFKALKTGEVKAVWIACTNPAQSLPNQAAVREALQAAEYVVLQEAYGNTDTADYADLLLPASGWGEKHGTVTNSERCITRVLPAVKAPGEARHDWEIVVDFARRLGKKLDHAGADKLFPYADAEAIFNEHRESTRGRDLDITGLSYALLEAQGPQQWPYPEGASSGKVRLYEDGHFPTADGKARFVPVEHKPTADALSSELPISLLSGRMRDHWHGMSRTGTVPRLFNLEDEPLLAMHPCDMRHRGLESGDLAKVTNGRGEMVVRVTDRPGLVKGRAWMPMHWGNQFMNTPGANALASDATDPYSKQPELKHAAVQIVKMDLPYPLAVVRRCASQSAALELLQRARTVLGDYPYVTLGLYGRKSPLVVFRAATALPIGEQEVLDLDRLFGLDGADGAIVYIDATRKVAKKAIAQEGRLIGVRLVGETLAQAWLKQAMAEDELDASLIRFALAPTAKPPVSMAPRNIVCKCADVSDVQIRKELENGADLPKLQQNLKCGTFCGSCVPDIKRMLAEQTKKTAAAA

SEQ ID NO: 6367 - protein, 413 aa, Zea mays
MEEHLTAALAGSTSSYLASTSEAVDKFRSDLDPCCASQDSIQHHRVEDPSGEEDLQPHAEMVDSFESDPIPLPVVYDRYDEPNHNEILEVLALLEYNEEARITDAIEGLIHEASSSMTAALEPVEHRRRQVLTATGEVEQKPTEGITNEVEAEEACELTGDATDFSDPEDTPTSPPSRPSPTRSSTATSSTTHRSPGRKSSFHARCTSHPTTTARLLHSLQSPNQAEVVKSSEAESARPPVVCNSHVELGLYSFTPSIFSVEQVIEEEVPVDMPTRCSRMDLNCGAYSVLDLLVICIVGGPNSNEYGTNRVLHHTIGLPDFSQELQGFQAITYYQAIINNLDDAQEQMDMAIATTLRKSKQVFVSVSCNMVDLFHSTFNWERSMSYNMVGLSHSTFGLVPLFISTRLINKANL

SEQ ID NO: 6368 - protein, 484 aa, Francisella tularensis
MSQKLKRGLHTRHMSMIALGGCIGTGLFVALGGAIADAGPGGTVLAYVIIAIMVYFLMASLGEMAAHSPVSGTFCEYATRYVDSALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKVGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMDGRTWFSVIIEFLSTYIGFFAFVILYFVYKFIKKTKLIRLEDCDLTRES

SEQ ID NO: 6369 - protein, 814 aa, Dechloromonas aromatica
MSKPRLVLIGNGMAGVRTVEELLKIKPDHYDITIFGAEPHPNYNRILLSPVLAGEMTISEIVLNELEWYKENNIKLHTGKQIKTIDRVKRKVIAEDGTEEEYDRLLIATGSTPFMLPIPGNDLPGVIGYRDIKDTDEMIEAAKLHKHAVVIGGGLLGLEAANGLKLRGMDVTVVHLGPWLLERQLDEVAGKMLQKSLEDKGLKFLLQKQTEMLVQGESGRVAAVRFKDGMTIPADLVVMAAGIRPNYALAESSGIYCNRGIVVNDTMQTYDPKVYAVGECVTHRGIAYGLVAPLFEQAKVAANHLAGYGIGRYTGSVTSTKLKVTGIDLFSAGNYMGGEGTEEIVLNDPYGGVYKKLVLKDNKLVGGVMYGDTADGPWYFQLLKDGRDIHDIRDQLIFGQSLVGDVGHAGNSKAADMPDSAEVCGCNGITKGVIVQAIKAKGLFTLDEVKKHTKAASSCGSCAGLVEQILASTIGGAYTPAASDKKPVCGCTEQSHKAVREAILNQHLITKEAVFAALEWKTPNGCDKCRPAVNYYLISTWPHEAKDDPQSRFINERSHANIQKDGTYSVVPRMWGGLTNPKELRAIADAAEKYNVPTVKVTGGQRIDLLGVKKEDLPAMWADLNAAGMVSGHAYGKSIRTVKTCVGMEHCRFGTQLAMSMGVKLEKMLFDMYAPHKVKLAVSGCPRNCAEAGIKDVGIIGVDSGYEIYIAGNGGIKTEVAQFLCKVSSDEDVMEYSGAFLQLYRLEGWYLERTCHYLERVGMDYIKGRILEDEEGRKALYAALLDSLKDAKDPWATSREPEAIKQFIPIMVEA

SEQ ID NO: 6370 - protein, 956 aa, Rhodobacter sphaeroides
MSFTPTDYNAYDFANRRHIGPSPSEMEEMLRVVGVSSLDQLIEETVPASIRQETPLDWAPLAEHELLARMREVAAKNRVMTSLIGQGYYGTVTPPAIQRNILENPAWYTAYTPYQPEIAQGRLEALLNYQTMVADLTGLPVANASLLDEATAAAEAMTMAERASKSKARAFFVDADCHPQTISVIRTRAEPLGIEVIVGHPAQLVPEDVFGALFQYPGTYGLVRDFTRDIAALHEAKALAVVATDLLALCLLKEPGAMGADIAIGSSQRFGVPMGYGGPHAAFMSCKDDLKRSMPGRLVGVSVDARGNKAYRLALQTREQHIRREKATSNVCTAQALLAVMASFYAVFHGPRGLRAIAERVHLNTVRLATALKEAGARVSPEAFFDTITVEVGVGQAGILAAARHRGINLRKVGRDRVGISLDETTDAGVIARVLDAFGIHEPAPAKVGLGFPEPLLRETGYLSHPVFQMNRAESEMMRYMRRLSDRDLALDRAMIPLGSCTMKLNAAAEMMPITWPEFGTLHPFAPADQAAGYHEAIGDLAQRLCRITGYDAMSMQPNSGAQGEYAGLLTILAYHRARGDAERTICLIPVSAHGTNPASAQMAGMKVVVVKSAPNGDVDLEDFRDKAAAAGDRLAACMITYPSTHGVFEETVREVCRITHEHGGQVYIDGANMNAMVGLVQPGAIGGDVSHLNLHKTFAIPHGGGGPGMGPIGVKAHLAPYLPGHPEVTGPLTGGHDEAADEGPVSAAPYGSASILLISWAYCLMMGGEGLTQATRVAILNANYIAARLRGAYKVLFMGNRGRVAHECILDTRPFAEAGVTVDDIAKRLIDNGFHAPTMSWPVPGTLMVEPTESETKAEIDRFVAALLAIREEIRAVEEGEIAAADSPLRHAPHTVEDLVADWDRKYPREQGCFPPGSFRVDKYWPPVGRVDNAWGDRNLVCTCPPVESYSIAAQ

SEQ ID NO: 6371 - protein, 295 aa, Arabidopsis thaliana
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 6372 - protein, 318 aa, Bacillus anthracis
MSEEKIYDVIIIGAGPAGMTAAVYTSRANLSTLMLERGIPGGQMANTEDVENYPGYESILGPDLSNKMFEHAKKFGAEYAYGDVKEVIDGKEYKTIIAGKKEYKARAIIVASGAEYKKIGVPGETELGGRGVSYCAVCDGAFFKGKELVVIGGGDSAVEEGVFLTRFASKVTIVHRRDTLRAQKILQDRAFQNEKVDFIWNHTIKEINEANGKVGSVTLVDVNSGEEKEVKTDGVFVYIGMLPLSKPFVELGITNENGYLETNERMETKVPGIFAAGDVREKMLRQIVTATGDGSIAAQSAQHYVEELLEELKTVSEK

SEQ ID NO: 6373 - protein, 555 aa, Debaryomyces hansenii
MEPASKKTKLEELSKFGSKYYPYDIDNKTIISKYIKREDLKPINVLEAKLNDTRANRNNIDVGDSIAHLFLRDFRTIDNKGLSIASELATTTKTPLITFHIFCLEEFDAHSVSPFKLEYMLGSLDVLKKDLREMNIPLVSLQVEKRKDVPTKIAEFLEQNNTSHVFCNMEYEVDELRLLSKLVCFLLDKHISFNPVHDSCIVKPGELKTKSKGTQYAVFTPWYKAWCNYLKIEDAPFMEYPRPHANESFSDPNKLFDSEIPQVPESKRLTHDQQKEFDTCWKCGEHEAWLALSVFLESDKFKKYDESRNEISEESVSRMSCPISSGIISTRSIIRYILENKFVKKIDSGEQGTGWIRQIAWRDFYRHILCNWPYVCMFKPFLLEYDDLNWEYNSDHFYKWCQGKTGFPIVDAAMRQLNQTGYLHNRCRMIVASFLSKHLLIDWKYGEYYFMEHLIDGDFASNNGGWGFSSSTGVDPQPYFRIFNPWLQSERFDKKGTYIRTWVPELKDIQDEKGIHNPYEKGYGHIAEKNGYPKPIVDHKYCRERALNRFKDAKY

SEQ ID NO: 6374 - protein, 289 aa, Oryza sativa
MAPMAGGGGVPWGDRARVVGAQIRSRFRVGVAPVDRRWLWRRGDGRVASEAVRQWTERVRSLWQREKSTDQISSSPGTSQVAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRNAGYNACRKTYSKSRQKGDCGCW

SEQ ID NO: 6375 - protein, 981 aa, Chromobacterium violaceum
MKRMLFNATQAEELRVAIVDGQKLVDLDIETVGKEQRKGNIYKGVITRIEPSLEACFVDYGTERHGFLPFKEVSRSYFQGYDGGRPRIQDVLREGMEVVVQVEKDERGNKGAALTTYISLAGRYLVLMPNNPRGGGVSRRIEGEERQELKDLLSQLEVPHGMSLIARTAGIGRNLEELQWDLGYLMQLWRAIEGAAGAQSAPFLILQEGSLVIRAIRDYFHPDIGEVLIDTEEIHDQARQFMSHVMPNMLSRVKLYKDHVPLFSRFQIEHQIETAFSRSVQLPSGGAIVIDHTEALVSIDVNSARATKGADIEETAVKTNLEAAEEIARQLRLRDLGGLVVIDFIDMENPKNQRDVENRLRDVLKHDRARVQMGKLSRFGLLELSRQRLQPSLGETSHEPCPRCHGIGFIRGTESSALHILRIIQEEAMKENTGAVHAQVPVDVATFLLNEKRAEIHSIEERLDVDVVLIPNIHLETPHYKIVRVRHDDVAELGEAPSYTRVEVQEEDVITNFGQEKPKVERQEAAVKGITPQQPAPSASVSAAAKPVEQGGLFAGIAAWFKGLFAEPEKAPVQDAKKKPVQSSSRGNEQRGNRQRPHERRTGGQARREHEQRRNGQQDEGKSRRPDERKDAERAERADRPERKEAPSRDREERNEQPRERGSRRREREGREPREPKEVREQAPREERVSEKAEKQDKPQQEPRRRQAPAAAPAEAVEKPLHEELRLDAEGEQAEQERGERRRRRSRRDRQRDTSKAQQDGAVEGVSESPAEVPVAEAAGAAVAVAVAAVAVEAAVEAKPQAEALLEAEAKPVAPAVEPVRTEVVAEAVAVEPEAPVVVAVVEPQPEAVVVAPAVVVEAEQAPVAAEPAVVAEPVVETLAAQAVVEAAPVAEAPAAVDAPVADEQLAEPVVVQAESKPAAVEAKPLDLGGLVMVATKPATEQAAAASEPELPQGPRRRDVVVAEAAAVEPAQLVQVETRNG

SEQ ID NO: 6376 - protein, 199 aa, Treponema denticola
MAKNKYSEPDYWSKKAFAENYPARSVYKLEEMNKKFNLFSPNDKVLDLGAAPGSWTVYVLRFLNKEGRVTAVDLKPLDSSVYDERLNFFQGDMFDKGIIKSVKELGPYDAVICDAAPATTGNKTVDTARSSGLVELALYYAQEQLKQGGSFVVKIFQGGDQQIHLNNLRKCFKTARAFKPEACRSSSFETYLIGLDFKG

SEQ ID NO: 6377 - protein, 442 aa, Arabidopsis thaliana
MAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGSRLRVRGEGNAGKRGGSPGDLFVVIEVIPDPILKRDDTNILYTCKISYIDAILGTTLKVPTVDGTVDLKVPAGTQPSTTLVMAKKGVPVLNKSNMRGDQLVRVQVEIPKRLSKEEKKLIEELADMSKNRTANSTSR

SEQ ID NO: 6378 - protein, 436 aa, Ostreococcus tauri
MASATPLDGASVAAGGAVRETEEGAPIGTRAGGGRRGTETQETSSGIQGAPSMQRITFHLVRTATGEKLDAFSFRDDFMHLPRNGAVSMRGDTLAVLSMKHQRVVFLKVHAEGRFEEVSSIGEYITEGDKEAVREQESVERAWAASHEESTKIIERANALPRSGRSMLTGLTQRLVTFLYHEARESSNVDALRLLHRNFERYVSLVMLRVRILDANLLLIKFGTPEYALARRGDNVIGPTMYAVFDITKGAFTQTAMSMNASNSVVEEDLNAPPRGETLWARFAGSQGEALAQCNTCTSSIEEEDEDGLNTVAARLFRAQDYPPQFRSLSPYFDKRLFSYDERTITAIDRLQPHVDFGVKFVSQRRGSRRRISFKLMVNDTVANSGRSKRRVQYVFHPVYPFAMSISIAYMQPTLVNFHVRSAPGDEMHEEIVQNP

SEQ ID NO: 6379 - protein, 573 aa, Thiobacillus denitrificans
MSTATASSAPASMESFAALFEESLSHQEMRQGEVITAEIVGIDHNFVTVNAGLKSESLIPLEEFKNDQGEVEAKVGDFVSVAIESIEDGFGATKLSRERAKKLAAWLDLEAAMNEGRVVSGMVQGKVKGGLTVLVGGLRAFLPGSLVDMRPVKDTTPYEYKEMEFKVIKLDRKRNNVVVSRRAVLEETMGADREALMESLKEGSIVKGVVKNITDYGAFVDLGGIDGLLHITDMAWRRVKHPTEVVHVGQELEAKILRYDTEKNRVSLGLKQLGDDPWVGIARRYPQGTRMFGKVANLTDYGAFVEIEEGIEGLVHVSEMDWTNKNVSPSKIVQLGDEVEVMVLDIDEDKRRISLGMKQCKSNPWEDFAMNHKKGDKVSGAIKSITDFGVFIGLPGGIDGLVHLSDLSWSVPGEEAVRNFRKGQDVEAVVLGIDLERERISLGIKQLEGDPLTSYATGHEKGSIVKGTIKTVEAKGATVKLDSDMEGYLRASEVSRDRVEDMRSHYKEGDEIEAMIINVDRKNRVINLSIKAKDMTEQDAAMKKFAAESAAAASGSTNLGALLKAKLDNKNAE

SEQ ID NO: 6380 - protein, 313 aa, Silicibacter pomeroyi
MAETRHTKVLIIGSGPAGYTAGVYASRAMLEPILVQGIEPGGQLTTTTEVENWPGDTEVQGPDLMVRMEAHAKAMGCEIIGDIITSLDTSARPFVAKGDSGTTYTADAVILATGARAKWLGMESEEKFKGFGVSACATCDGFFYRGQEIVVIGGGNTAVEEALFLTNFASKVTLIHRRDELRAEKILQDRLFKNEKIVPLWFNQLEEVYGTDAPLGVEGVKVRNVKTGEITDIPCKGVFVAIGHAPANELVKDVLELHNGGYVSVKPGTTETSIPGIFAAGDLTDHKYRQAVTSAGMGCMAALDAERFLAEQE

SEQ ID NO: 6381 - protein, 410 aa, Clostridium perfringens
MNFDNLEREDEQIAHLVQKEKERQENSIELIASENFVSKAVMEAMGSYLTNKYAEGYPSKRYYGGCHVVDEVEDLARERVKKLFGAEHANVQPHSGSQANMAVYFSILEPGDTVLGMDLSHGGHLTHGSSVNFSGRLFNFVSYGVDKETETINYETVRELALKHKPKLIVAGASAYSRIIDFKTLREIADEVGAYLMVDIAHIAGLVATGLHPSPVPYADFVTSTTHKTLRGPRGGLILCKEKFAKVLDKNIFPGIQGGPLMHIIAAKAVCFKEALEPSFKTYMEQVVKNAHVLAEALEAYGFKLVSNGTDNHLILVDLTNKDITGKDAEILLDSIGITLNKNTVPNETRSPFVTSGVRIGTPAITTRGFKEEEMKEIASIINDAIKEKDGDLEPLKARVKALCAKYPLY

SEQ ID NO: 6382 - protein, 567 aa, Vibrio vulnificus
MTKIVIVGGVAGGASAAARARRLSEDAQIIMFERGPFVSFANCGLPYHIGGDIKERSKLLLQTPESFLARFNVDVRVMNEITAINRHEKTVTVKNLIDGSEYAESYDFLLLSPGAGPVVPPIPGIDNPLTHSLRNIPDMDRIIQTIQTNNVEHATVVGGGFIGLEMMEAFHQLGIKTTLLELADQVMTPVDREMAGFAHAEIRAKGIDLRLGTALTSVEYIANDHVASENAGEDIQHQHISGHLALSLSTGDTLNTDVLIMAIGVRPETKLAQQAGLQIGELGGIYTNDMMQTSDPSIYAVGDAVEEKDFVTGKQTLVPLAGPANRQGRMAADNMLGRSERYQGTQGTAICKIFDLAVASTGKNEKQLKRDGVEYEKVYVHTASHASYYPGAEIVSFKMLFDPKTGKIFGAQAVGKDGVDKRIDVMAVAQRAGMTVEQLQHLELTYAPPYGSAKDVINQAAFVANNLIKGDAKAIHFDEIEHLNDDQLLLDVRNPGELQAGGYLPGAINIPVDQLRQRMDELPKDKEIIIYCQVGLRGNVAYRQLVNNGYKARNLLGGYRTYMFSKC

SEQ ID NO: 6383 - protein, 198 aa, Arabidopsis thaliana
MEQSEEGQQQQQQGVMDYVPPHAYQSGPVNAASHMAFQQAHHFHHHHQQQQQKQLQMFWANQMQEIEHTTDFKNHTLPLARIKKIMKADEDVRMISAEAPVIFAKACEMFILELTLRAWIHTEENKRRTLQKNDIAAAISRTDVDFLVDIIPRDELKEEGLGVTKGTIPSVVGSPPYYYLQQQGMMQHWPQEQHPDES

SEQ ID NO: 6384 - protein, 726 aa, Salmonella enterica
MSTTDDTHNTLSTGKCPFHQGGHDRSAGAGTASRDWWPNQLRVDLLNQHSNRSNPLGEDFDYRKEFSKLDYSALKGDLKALLTDSQPWWPADWGSYVGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAAAASHVGADPEAAPIEAQGLGWASSYGSGVGADAITSGLEVVWTQTPTQWSNYFFENLFKYEWVQTRSPAGAIQFEAVDAPDIIPDPFDPSKKRKPTMLVTDLTLRFDPEFEKISRRFLNDPQAFNEAFARAWFKLTHRDMGPKARYIGPEVPKEDLIWQDPLPQPLYQPTQEDIINLKAAIAASGLSISEMVSVAWASASTFRGGDKRGGANGARLALAPQRDWEVNAVAARVLPVLEALQKTTNKASLADIIVLAGVVGIEQAAAAAGVSISVPFAPGRVDARQDQTDIEMFSLLEPIADGFRNYRARLDVSTTESLLIDKAQQLTLTAPEMTVLVGGMRVLGTNFDGSQNGVFTDRPGVLSTDFFANLLDMRYEWKPTDDANELFEGRDRLTGEVKYTATRADLVFGSNSVLRALAEVYACSDAHEKFVKDFVAAWVKVMNLDRFDLL

SEQ ID NO: 6385 - protein, 157 aa, Clostridium perfringens
MKKIILAGGCFWGVEEFLSRINGVVSTEVGYANGRTENPTYEDICTKNTYFAEVCLVNYDENIISLKELLAKFWTIIDPTSLNKQGNDVGSQYRTGIYYVDSSDLEDILNSKEELQKSYSKKIVTEVKPLENYYKAEEYHQKYLKKNPNGYCHIKLD

SEQ ID NO: 6386 - protein, 451 aa, Schizosaccharomyces pombe
MGEISMKSKVCPLIYHFLQENGYVKTAQTFLKETGDKDLAKGKVKKNLLDLLSQKEFLPYLTTEDVGKHKKTKESLEKSNDDSQKISKKGAPPEKAHSSSEASGSGSSSDESDSSSSESESSSEDNDSSSSSSDSESESSSEDSDSSSSSSDSESESSSEGSDSSSSSSSSESESSSEDNDSSSSSSDSESESSSEDSDSSSSSSDSESESSSEGSDSSSSSSSSESESSSEDNDSSSSSSDSESESSSEDSDSSSSSSDSESESSSKDSDSSSNSSDSEDDSSSDSSDSESESSSEDSDSTSSSSDSDSSSSSEDGNSNTDTTTSGEVSAQSSTNSTSSEESTSVKDEDSSKIHDKSLKRKHEDDESSTSTKSSRTTKTPFTRVGDPSQWDFASPALRDNSFNFEDDYGTLANRDLIVTRGKGFRQEKNKKKRGSYRGGRINTEVRSFKF

SEQ ID NO: 6387 - protein, 125 aa, Arabidopsis thaliana
MANLMMRLPISLRSFSVSASSSNGSPPVIGGSSGGVGPMIVELPLEKIRRPLMRTKSNDQNKVKELMDSIRQIGLQVPIDVIEVDGTYYGFSGCHRYEAHQKLGLPTIRCKIRKGTKETLRHHLR

SEQ ID NO: 6388 - protein, 574 aa, Candida glabrata
MCGIFAAYKHQDVHAFKPKALQLSKRIRHRGPDWSGNVVKNSTIMVHERLAIVGLDSGAQPITSEDGDYTLCVNGEIYNHIQLREQFPDYKFKTLSDCEPIIPAYLEHDIDAPKYLDGMFAWCLYDAKQDRIVAARDPVGITTLYMGRCSSSPKTVFFASELKCLTDDCDEITAFPPGHVYDSKTDQITRYFTPDWIDESRIPTTPVNFKDIRESLEKAVRKRLMAEVPYGVLLSGGLDSSLIASIAARETEKANEENDAADNDASASKQLAGIDNQGHLHTAGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSATEFHIESVKRVKNLHLADCLRANKSTMAWGLEARVPFLDKEFLQLCMNIDPKDKMIDQSAGRIEKYILRKAFDTSDEPDVKPYLPEEILWRQKEQFSDGVGYSWIDGLKDTAERVISDTMFSNPKIEWGEDIPTTKEAYWYRLKFDALFPQKTAASTVMRWIPKADWGCAEDPSGRYAKIHEQHVTA

SEQ ID NO: 6389 - protein, 112 aa, Yersinia pestis
MKLVTVVIKPFKLEDVREALSSVGIQGLTVTEVKGFGRQKGHAELYRGAEYSVNFLPKVKIDIAIADDQLDEVIDVISKAAYTGKIGDGKIFVAELQRVIRIRTGETDEAAL

SEQ ID NO: 6390 - protein, 381 aa, Daucus carota
MATSQSSRPPHNFQHSYEDNNHHSQVVFDASIIQKETTIPKEFIWPDHEKPSLNTQELKVPLIDLGAFLSGDPSAAKESSILIGQACQEHGFFMVVNHGVDTNLISDAHKFMNLFFDLPLYVKQKAQRKLGENFGYASSFTGRFASKLPWKETFSFQYCADERMSSTTVKDYFTNKLGPDFAKLGKVYQDYSHAMSTLSLKIIDLLEISLGVSRSHFKNLFEDHDSIVRLNYYPPCQKPELTLGTGPHSDPTSLTILHQDHVAGLEVLVDDQWRCILPNTSAFVINIGDTLMAMTNGRYKSCLHRAVVNNETARKSIAFFLCPRKDKVVIPPAELVDQKNPRLYPDFTWAELLQFTQMHYRADMNTLDAFSTWLLTKNNRE

SEQ ID NO: 6391 - protein, 383 aa, Daucus carota
MAASTFLYHRHQQPFYPKSLVFDPSIIKNELNIPQEFIWPDHEKPSSHTPQLDVPLVDVGGFLSGDPVAAEKASKLVGQACREHGFFLVTNHGVDGNLISDAHKSMDLFFELPLMEKQKAQRKLGEHCGYASSFTGRFSSKLPWKETLSFEHSTKKTSSTLVEDYFASALGKDYAKLGKVYQDYCNAMSRLSFGIMELLAISLGIDRSHFKNFFEENNSIMRLNYYPTCRRPELTLGTGPHCDPTSLTILHQDDVGGLEVFVDNQWQSIPPNPSSFVVNLGDTFMALSNGKYKSCLHRAVVNKQNPRRSLAFFLCPQKDKVVRPPTELVDQDNPRLYPDFTWSALLEFTQKHYRADMNTLQAFSSWLTTFNNKEHLGEGHVIN

SEQ ID NO: 6392 - protein, 1191 aa, Oryza sativa
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAVGSPENGAEGAARGKGAHNGELLGKREVLAQAVNLLPMRRTVSATHRFTAGCGRDAAAPLARREEGKVGSGLEVMPVDVGGGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 6393 - protein, 420 aa, Arabidopsis thaliana
MITAADFYHVMTAMVPLYVAMILAYGSVKWWKIFTPDQCSGINRFVALFAVPLLSFHFIAANNPYAMNLRFLAADSLQKVIVLSLLFLWCKLSRNGSLDWTITLFSLSTLPNTLVMGIPLLKGMYGNFSGDLMVQIVVLQCIIWYTLMLFLFEYRGAKLLISKQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGAHYPAPNPGMFSPNTGGGGGTAAKGNAPVVGGKRQDGNGRDLHMFVWSSSASPVSDVFGGGGGNHHADYSTATNDHQKDVKISVPQGNSNGIVPL

SEQ ID NO: 6394 - protein, 1079 aa, Ustilago maydis
MAPSLLVRSRVVASRSIRSTPLAATLRLTLGSNARLYTVAAAPAAVRAQRRGLATLSSTENAPELGARHVAKSIFAPLDTFESRHIGPRDHDSAKMLEALGYSEMEQLIADTVSPSVRLAQDASFYDQIKPLSESELAQRAETIAKMNRPFKSLIGMGYQNTLVPPVILRNVLENPAWYTSYTPYQPEISQGRLESLINFQTMVKSLTGLDLANASLLDEGTAAAEAMILAYGQTKSKRKTFLVDRGVLPQTLAVLRQRAKGFGINVVATDLRTPEGHRLPPADQIPRDDIIGALVQYPDVDGRITDWEALANEIKGFGGMVIAATDLLALTMIKPPGEWGADIALGNAARFGVPPGFGGPHAAFFAVRDSIKRKIPGRLVGLSKDARGGPAYRLALQTREQHIRREKATSNICTAQALLANMSAMYAVYHGPDGLRKIAAKTHALTRLLKHELTELGVRVVNRDGAFFDTLTIDLSKAGIGAVRIHEEAKKAEINLRRISDTRIGITLDETVSIEELTDVLNVFAYALKPAKTGEVPYKPADLIEIASRIGLDAASTETLTISTPVKVRPNNATAESSDLPPVPDFARTSKFLQQPVFSAHRSETQMLRYIHSLQAKDLSLVHAMIPLGSCTMKLNSTSSMMLISKPEFSQLHPFAPEDQAQGYDVLIRELERDLCLITGFPAVSLQPNSGAQGEFAGLSVIRAYHESKGQGKRDVCLIPTSAHGTNPASAIMAGMRVVPVKTKPDGSIDLEDLRAKAELHKNELAATMITEPATTGCYFKDIQEAFKVVHDNGGQVYLDGANLQAQVALTNPAIMGADVTHLNLHKTFSIPHGGGGPGVGPICVAEHLAPFLPGHPLASTGGEMAINPISAAPWGSASILTIAWAYIKMLGWGGLKKSTETALLAANYVAHRLKDHYKLKYTGDRGRVAHELLIDVAEFEDVGLKVMDFAKRLIDYGFHPPTCSWPISTGLLIEITESESLQEIDRLIEAFISIRHEVEEIRAGKQPKDNNLLKNAPHTMQAVTEDKWERPYSRERAVFPVNELRQNKFWPPVARIDDAFGDRVLVCECGGVEDYVN

SEQ ID NO: 6395 - protein, 477 aa, Clostridium perfringens
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKIVNKAIMDSEIPDEILIVMIKRDNKVVIPKGFTIIKPNDTLVLTSKNNEIMNSFLDEIR

SEQ ID NO: 6396 - protein, 129 aa, Arabidopsis thaliana
  misc_feature (27)..(27): Xaa can be any naturally occurring amino acid
  misc_feature (95)..(95): Xaa can be any naturally occurring amino acid
  misc_feature (112)..(112): Xaa can be any naturally occurring amino acid
RNIRGDPRVRAQATMVAPFTEHEVFLXFPATPKAGDDITFITSNGGRVSCMKVGTPVVKHKAETLSYLPDLRDVELANEADYLPRNNSPRWVRFXLEHGFVFREHGNTSGYXDGRYWTMWKLPLFGCTD

SEQ ID NO: 6397 - protein, 181 aa, Clostridium tetani
MNWCEGDIKEVLYNEEELRKKIKEMGKKITEDYKGKDLILIGVLKGSVIFMADLMKEINIPCNMDFMAVSSYGNSSETSGVVRILKDLDFEIENRDVLIVEDIVDSGVTLRYLVDYLKGRKPASIEIVCLLNKEERRQSNIDVKYIGFDVPDYFLVGYGLDFAERYRNLPYVAILKEEVYS

SEQ ID NO: 6398 - protein, 318 aa, Gloeobacter violaceus
MAEQTVIITGASSGVGLHAADSLAQSGRWHVVMACRDKAKAQNAAASLGMRPQSYTIVHLDLASLASVRRFVQDFRALGQPLDALVCNAAVYTPTAREPRYTADGFELSVGTNHLGHFLLCNLLLEDLQNSPAAEPRLVILGTVTHNPKELGGSIPPRPDLGDLRGLEQGFKAPHTMIDGKAYNPVKAYKDSKVCNLLTMRELHRRFHTSHKITFSALYPGCVATSGLFRESPRLFQILFPVFQKYVTGGFVSEAEAGGRVAALVDDPAYSRSGVYWSWGNRQKKDGKSFIQDVSTEASDEDKARRLWDLSAGLVGLA

SEQ ID NO: 6399 - protein, 378 aa, Prochlorococcus marinus
MADFYDTLGVNRNADADSLKRAYRRLARQYHPDINKEAGAEERFKEIGRAYEVLGDPEKRARYDQFGEAGLGGSAGMPDMGDMGGFADIFETFFSGFGGPGSSGARTQRRGPQQGDDLRYDLTIDFNQAVFGQEREIKIPHLETCDVCRGTGAKPGTGPTTCSTCGGAGQVRRATRTPFGSFTQVSDCPTCSGSGQVISDSCQSCGGQGVKQVRKKLRINIPAGVDTGTRLRVSGEGNAGPRGGPSGDLYVFLKVKSHARLKRDGLNIHSEVNVSYLQAILGDTIEVDTVDGPTTLQIPSGTQPSAVLILDNKGIPKLGNPVARGNHCISVNIKIPSRLTDDEKILLEKLAIYYSAKGPQNHHHNSGLFSRLFKSNAS

SEQ ID NO: 6400 - protein, 401 aa, Triticum aestivum
LNKFVQKSRLVPVRNSRDIVDPRVRDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWIVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASLASLVRGGVCHEALTVSELGMYGAYLRNKDKVIINDKCGYLMRTKVSSSDEGGVAAGFAVLDSLYLTDK

SEQ ID NO: 6401 - protein, 956 aa, Pseudomonas putida
MNKPRIPLGTDNEFVARHIGPREDDIAAMLALTGHESLDALIDSVIPASIKGSNVLELTPGLGEAEALAALKAVAANNQLYRNHIGQGYYPCHTPTPILRNLLENPAWYTAYTPYQPEISQGRLEALLNFQTLVSDLSGMEIANASLLDEATAAAEAMTFCKRLAKNKALAFFASRHCHPQTLDVLRTRAQPLGIDVVIGDEAALDGQPLDGYFGLLLQYPASTGEIVDHRALIQRAHADGARVSVCADLLALTLLTPPGALGADVVIGSAQRFGVPLGFGGPHAAYFATRDAFKRDMPGRLVGVSIDRFGKPALRLAMQTREQHIRREKATSNICTAQVLLANIASMYAVYHGPQGLSQIARRVHRLTTILVQGLRQLGHRVEQAHFFDTFTVVTAGPVADVLAAAKSARLNLRPIDSVRVGLSLDETCEQDSVEALWQVFAVAGQTLPDYAALAADGTDCLPLALLRATPFLQHPVFNRYHSETELMRYLRRLGDKDLALDRSMIALGSCTMKLNAASEMIPITWPEFAALHPFAPAEQALGYRQLTDELEAMLCAATGYDAMSLQPNAGSQGEYAGLLAIRAYHASRGQAGRDVCLIPSSAHGTNPATAQMAGMRVVVVNCDARGNVDIDDLQRKAEQHTDTLAALMITYPSTHGVFEDGITRICDIIHAHGGQVYLDGANMNAMVGLCAPGKFGGDVSHLNLHKTFCIPHGGGGPGVGPIGVKAHLAPFLPGHGHLQKQQGAVSAAPYGSASILPITWMYIRMMGGAGLKRASQLAILSANYIARRLEEHYPVLYTGDNGLVAHECILDLRPLKDSSGIGVEDVAKRLIDFGFHAPTMSFPVAGTLMVEPTESESKEELDRFCAAMICIREEIRAVENGTLDALDNPLKNAPHTASELAGEWPHRYSRELAVYPLADLRESKYWPPVGRVDNVYGDRNLACACPPLSSYQDA

SEQ ID NO: 6402 - protein, 297 aa, Thiobacillus denitrificans
MSTYKTIEDTVGNTPLVRLKRLPGETSNIVLVKLEGNNPAGSVKDRPALSMIEQAEARGEIRPGDTLIEATSGNTGIALAMAAAMRGYKMVLIMPEHLSIERRQTMRAFGAELRLVSREAGMEGARDLAIELEKQGVGRVLDQFTNPDNPAAHYRSTGPEIWRDTEGRISHFVSSMGTTGTIMGCSRYLKEQNPAIQIVGVQPTEGAQIPGIRKWPAEYVPKICDPSRVDRMIYVGQQDAEETTRRLAREEGIFAGISSGGALWAALQLSKEVENATIVSIVCDRGDRYLSTGVFPA

SEQ ID NO: 6403 - protein, 109 aa, Oryza sativa
MGRRPARCYRYCRSRPYIKSRYCRGVPEGKIRIFDLGRKKAPVDDFPLCVHLVSLEREQLSSESLEAARICANKYITKTAGKDAFHMRVRVHPFNVLRINKMLSCAGAD

SEQ ID NO: 6404 - protein, 131 aa, Vibrio vulnificus
MNRLPVERVSDSPNCGKCKSDLFDGAPIEGTNDNFTHLLQSDQPVVVDFWAPWCNPCVGFAPVFQDVAAERKGKVRFIKINTEIEQQLAAQFQIRSIPTVMVFKNGQRVDVINGALPKSQFDQWLNQALTK

SEQ ID NO: 6405 - protein, 419 aa, Salmonella enterica
MNFRGNRMINNDPLFDLLNKEQQRQQHSLELIASENFASPAVLAAQGSVLTNKYAEGYYQHRYYGGCKFIDEVEMLAITRAQQLFGARYVNVQPHSGSQANQAVYLALLKPGDKILGMSLQCGGHLTHGSPVNQSGKWFNAFHYGVDAHSGLIDMDEVETIAKRERPRLIIAGGSAYPRHYDFARFRRIADAVGAMLLVDMAHFAGLVAGGCFPSPLAYADVITATTHKTLRGPRGGMILTNDARLAKKIDSAIFPGLQGGPLMHVIAAKAVALGEALQPEFKRYAGQVIENAQAMCQQLAQRGLTLLTGGTDCHLGIIDLRPQGLTGAQVEYFLELAGITVNKNTLLGDPQPPSITSGIRIGSAACATRGMKADDFTLIADWISEIIFAIKTPNIADICADIRQKVTKLTTNYPLPYQ

SEQ ID NO: 6406 - protein, 54 aa, Glycine max
FMLCSTEGPPVNFKHPINKLNPEKNGVAKGPTKFYNPEIHAAAFCLPSFVDKVD

SEQ ID NO: 6407 - protein, 539 aa, Methanococcoides burtonii
MFCYQCEETMNGEGCTKNGVCGKKGEVADLQDDLIYVLKSVAFYNQKARKADISEESTDDFMLDALFSTITNTDFRATGIQDRIDRGFEIQGEIKQKLLDNNALDENELPEIATVSPENLKDRNTGILATENEDIRSLRELIIFGIKGIAAYGHHAMVLGHTNKKVNSFIEEGLVATTDDTLTDKKLISLVLKCGEKGFDVMALLDAANTSTFGNPEPTQVNIGTRGNPGILVSGHDLNDLKQLLDQTKGTGVDVYTHGEMLPANSYPEFKKYEHLVGNYGGSWWHQKKEFESFNGPILMTSNCIIPPKDTYLDRIYTTGSVGFDGVVHLTGNDGQKDFSAIIEQAKKCEPPVQLEEGTIMGGFAYNSVLSVADKIVDAVKAGKIKKFIVMAGCDGRRKDRQYYTDFAEALPKDTVILTAGCAKYRYNKLNLGDIDGIPRVLDAGQCNDSFSLVIIAQGLMARLGFTDVNEAPISYNIAWYEQKAIIVLLALLRMGIQDITLGPKLPAFVSPNVLNVLVEKFNITPNTTVEEDMERLLK

SEQ ID NO: 6408 - protein, 306 aa, Helicobacter pylori
MMIITTMQDAIGRTPVFKFTNKDYPIPLNSAIYAKLEHLNPGGSVKDRLGQYLIGEGFKTGKITSKTTIIEPTAGNTGIALALVAIKHHLKTIFVVPEKFSTEKQQIMRALGALVINTPTSEGISGAIKKSKELAESIPDSYLPLQFENPDNPAAYYHTLAPEIVQELGTNLTSFVAGIGSGGTFAGTARYLKERIPAIRLIGVEPEGSILNGGEPGPHEIEGIGVEFIPPFFENLDIDGFETISDEEGFSYTRKLAKKNGLLVGSSSGAAFVAALKEAQRLPEGSQVLTIFPDVADRYLSKGIYL

SEQ ID NO: 6409 - protein, 300 aa, Arabidopsis thaliana
MGTLVGHVAPGFAFFALGLWHLFNNIKLFCLNPNTFTSSPWFPTSKLRHLELYIIMVCSSISIASELFIGPKKHQPFDSDGTIPSNHLHNFEHSSISMSFLVYAIFAVVLDQERRRSNISHGLTMLVASSAFAQQLFLFHLHSADHMGIEGQYHKLLQLIIFVSFLTTLIGITLPKSFLVSFVRSSSITFQGVWFVVMGYMLWTPSLIPKGCFLHEEEGHQVIKCSSDKAIHRAKSLVNIEFSWFFVGITIFVMSLFLILSGLYGENAEYSILVTKDKGEESGEEKQDIESLKKSKPSFG

SEQ ID NO: 6410 - protein, 341 aa, Ostreococcus tauri
MTTADARALVESFARVSLAPTGASPIERAPRLSEALGGAEIFIKRDDVYGTITGGNKTRKLEYLLAEALDANAERVVTQGATQSNHARQTAAACARLGLKCHVLLEDRTKRVDQNYTANGNVLLNSLFGATMEYRPGDQGLNMNDEMLASCESFREKGESVYGIVGGGSCPTGALGYVRAAIEILEQADAMGLEFDYIVHATGSAGTQAGLVTGLHAVGSKTKLLGFGVRAPKDVQETNVHNLAVKTCEKLGISPVDRADVVADTNYVGDGYGFPADSTIEAIREFASLEGILLDPVYSGKGGAGLIDYCRKGLFAPGTKVLFLHTGGSTSLHGYLDSFAQ

SEQ ID NO: 6411 - protein, 410 aa, Pseudomonas putida
MANHVAIIGNGVAGFTTAQALRAEGYEGRISLIGEEQHLPYDRPSLSKAVLDGSFEQPPRLAEADWYSEASIEMLTGSEVTDLDTQKKMISLNDGSTISADAIVIATGSRARMLSLPGSQLPGVVTLRTYGDVQLLRDSWTPNTRLLIVGGGLIGCEVATTARKLGLSVTILEAGDELLVRVLGRRIGAWLRGLLTEQGVQVELKTGVSGFSGEGQLEKVMVNDGRSFIADNALICVGADPADQLARQAGLECDRGVVVDHRGATSAKGIFAVGDVATWPLHSGGKRSLETYMNAQRQATAVAKAILGKEVSAPQLPVSWTEIAGHRMQMAGDIEGPGEYVLRGTLGIGSALLFRLLDGRIQAVVAVDAPRDFALANRLVEAQVIIEPEKLADVSNNMRDIVRANEGNQK

SEQ ID NO: 6412 - protein, 346 aa, Ustilago maydis
MPHSHHSHSGQFCSHAKDTLAQVLSRAQSLGFTHFHVSEHVPRQNPTELYPEEVDAEITPEQLRSTFESYLKEARRLQKEYAGSLHVLVGCETENISSPGTLDYLAQVLGSDDKAKPESIGKGVVDYIVGSLHHTNTIPIDFDRETFDKSVSSFESTSSSTDDAHLRLIDRYLDDQLEVLQRLRPEVIGHFDLFRLFTPQLQLQGTTRIWAKVERNVSFAVEYGALFECNAAAFRKGWNTSYPAKEVLDLIIGMGGRVCLSDDSHGVQAVGLNYMKLRRYLMDAGVQTIWYLEKELPSSNSDDDADSDSDGRPTRFARGTVAKAMGPRWTTHAFWTAFAASLESRS

SEQ ID NO: 6413 - protein, 155 aa, Kluyveromyces lactis
SGDYGSVQTFLDEQRLIQVTASAERCVVHFFVDSFRKCQVMDSKLQVMAESHLSTRFFRISVADCPFLVEKLSLKVLPVVIAYQNGKEQDRLIGFAKLGNNANDFSIDHLEKWLQRSGVVPMRDTKLTIISNRSKQIRSKNKTNSDQEDSGSDWD

SEQ ID NO: 6414 - protein, 253 aa, Zea mays
MIEQSKHLQTVMAAPVGANAIGAGDELLLLGTWSSPWVIRARMAMGLKGLSYEYLEEDLGNKSGLLLRSNPVHKKVPVLIHGGRPVCESLVILQYLDEAWPTAGPPLLPADPYDRATARFWAAYINDTFFPAFRALFRSLTDEQRGEALRNALPAVETLERTLAECSAGKAFFGGDAVGIVDVALGSHLVWIRVVDEVGGTSLLDAAKVPGLAAWAERFLAVDAVKKVMPDATKVLEQYKGFRAKWIAGAGCT

SEQ ID NO: 6415 - protein, 417 aa, Colwellia psychrerythraea
MFYKNDQIAGFDDSIWQAMEQEDKRQQDHVELIASENYTSARVMQAQGSQLTNKYAEGYPGKRYYGGCEHVDVIEQLAIDRAKELFGADYANVQPHSGSQANAAVFMALLKPGETVLGMSLAHGGHLTHGSKVSFSGKIYNAVQYGLNEVTGEIDYDEVARLAKEHQPKMIIAGFSAYSRVVDWQRFRDIADSIGAWLFVDMAHVAGLVAAGLYPNPVPIADVVTTTTHKTLRGPRGGLILAKQNDELAKKLNSAVFPAGQGGPLMHVIAAKAICFKEALGEGYVEYQQQVIDNAREMAKTFQTRGYNVVSGGTDNHLFLLDLIDKGITGKDADAALGRANITVNKNSVPNDPQSPFVTSGLRIGTPAITSRGFGLEEAAALTGWICDVLDDISNEQVIDDVRSKVLDLCEKNPVYR

SEQ ID NO: 6416 - protein, 338 aa, Streptococcus agalactiae
MTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVIMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 6417 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPTPEDPELDQFMEDYCKLLVECKEELSRPLQEAEEFL

SEQ ID NO: 6418 - protein, 492 aa, Arabidopsis thaliana
MSDLQAKNDVVAVDRQSSSSLADLDGPSPLRKMISVASIAAGIQFGWALQLSLLTPYVQLLGVPHKWSSFIWLCGPVSGLLVQPSVGYFSDRCTSRFGRRRPFIATGALLVAVAVVLIGYAADFGHSMGDKIDKPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGIVSLGIEGISKKIGGAKRLWGAVNIILAVCLAMTVLVTKKAEEHRRIAGPMALPTDGIRAGALTLFALLGIPLAITFSIPFALASIISSSSGAGQGLSLGVLNMAIVIPQMIVSFGVGPIDALFGGGNLPRFVVGAIAAAISSVVAFTVLP

SEQ ID NO: 6419 - protein, 947 aa, Unknown
  Sulfitobacter sp. EE-36
MVFKPTEYLPYDFANRRHIGPSPAEMSDMLKTVGAQSLGALIDDTMPAQIRQKEPLDFGKPMSEREVLEYMRVVAGKNKVLTSLIGQGYHGTVTPPAIQRNIFENPAWYTAYTPYQPEISQGRLEALLNFQTMVSDLTGLEVANASLLDEATACAEAMTMAMRLSKSKAKAFFVDRDCHPQNIAVIQTRAAPLDIEVIIGDPDKMDASAVFGALFQYPGTYGHVRDFTDHMAALHEAGALGVVSADPMALTLLKEPGAMGADIAVGSTQRFGVPEGYGGPHAAYMACKDAYKRAMPGRIVGVSIDAHGNRAYRLSLQTREQHIRREKATSNVCTAQALLAVMASMYAVFHGPEGLKAIAQRIHRKAVRLANGLEEAGFKVDPKSFFDTVTVDVGPLQAAVMKSAVDEGINLRRVGETRVGITLDERTVPETIEAVWRAFGIRRSDETFEAQYRFPDDMLRESAYLTHPIFHMNRAETEMMRYMRRLADRDLALDRAMIPLGSCTMKLNSAAEMMPVSWREFSMIHPFVPQDQALGYKHMIDDLSAKLCDITGYDAISMQPNSGAQGEYAGLLAIASYHRANGQGHRNICLIPMSAHGTNPASANMVGWKVVVIKTAANGDIDLDDFRAKAEKHSENLAGCMITYPSTHGVFEETVTEVTKITHDHGGQVYIDGANMNAMVGLARPGDVGGDVSHLNLHKTFCIPHGGGGPGMGPIGVKSHLIPHVPGHPNGGEGAVSAAPYGSPSLLPISWSYCLMMGGDGLTQATRVAILNANYIAKRLEGAFEVLYKGPTGRVAHECIFDVRPFEDSAGVTVDDIAKRLIDAGFHAPTMSFPVAGTLMVEPTESETKAELDRFCDAMLAIRDEIRAIENGDMPRENNALKNAPHTVEDLVGEWDRPYTREQGCFPPGAFRVDKYWPPVNRVDNVHGDRNLICTCPPMEEYAEAAE

SEQ ID NO: 6420 - protein, 402 aa, Pediococcus pentosaceus
MAENDVNQNSDLLNAINSVEEVKVGDVVTGEVLDIDDDRQVIVGIQGAGVEGVVPLRELSTQHIDNISDEVKIGDELELVVISRIGDDKEGGSYLLSRKRLLARKVWKEIEEKAANNEELDVPVTQVVKGGLVVDAGVRGFIPASMIENRFVDDLNAYKGQTLKVKIIEVKPEDNRLILSHKAVLNAEREAKRGEVLASIKEGDVVTGKVARLTNFGAFVDLGGIDGLVHISEISYQRVDKPSDVLKAGEEVQVKVLSVDAEKERVSLSIKQTQPGPWDNIEENAPEGAVLDGKVKRLTDFGAFVEVFPGVEGLVHISQISHKHIATPADVLKEGQDIKVKVLEVHPAEHRLALSIKALEEAPKNEKKTEAPAADFSKDMPEEATGFTLGDIIGKSLDDSEK

SEQ ID NO: 6421 - protein, 417 aa, Pseudomonas putida
MFHKSLTLSDFDPALSEAIRREVQRQEDHIELIASENYTSPQVMQAQGTELTNKYAEGYPGKRYYGGCEHVDVVEQLAIERARQLFGAGYANVQPHSGSQANAAVYLALLQAGDTLLGMSLAHGGHLTHGAKVSASGKLYNAVQYGIDANGLIDYDEVERLAVEHQPKMIVAGFSAYSKTLDFPRFRQIADKVGAYLFVDMAHVAGLVAAGLYPNPLPYADVVTTTTHKTLRGPRGGLILAKADPELEKKLNSAVFPGGQGGPLMHVIAAKAVCFKEALEPGFKDYQRQVVNNAQAMAQVFMQRGFDVVSGGTDNHLFLLSLIRQGITGKDADAALGRAHITVNKNAVPNDPQSPFVTSGLRIGTPAVTTRGFKEAECRALATWICDILDHLGDADVEAHVAGQVGELCKLFPVYPA

SEQ ID NO: 6422 - protein, 821 aa, Unknown
  Acidovorax sp. JS42
MVKQSRLVMVGNGMAGVRALEELLKIAPDLYDITVFGAEPHPNYNRILLSPVLAGEQTLEEIVLNDWSWYADHHITLHAGCTVTHVDRTRRTVHGVAQDGRTVEAPYDRLILATGSNPFMLPIPGRELPGVLAYRDIADTQAMIDAAASYKHAVVIGGGLLGLEAANGLMKRGMQVTVVHAGEWLMERQLDDVAGKLLQQSLAERGMQFLMQAQTQELVAGGDGRVAAVRFKDGSEVPAQLVVMAVGIRPNTALAEQMHLHVNRGIVVSDTLQTVTDPRIYAVGECAAHRGIAYGLVAPLFEQGKVLANHLAEWGIGRYQGSLTSTKLKVTGIDLFSAGDFQGGEGTEEIVLSDPHAEGGGVYKKLVLKDDRLVGACLYGDTVDGSWYFKLLRDGRSVADIRDRLMFGESHLGDAGHQGQNKAAAMADSDEVCGCNGVTKGQICKAIKDKGLFTLDEVRKHTKASASCGSCTGLVEQILMATAGGDYSATPKTKPVCACTDHGHQAVREAIRTHRLLTVDGVFRFLEWKTPNGCATCRPAVNYYLISTWPKEARDDPQSRFINERSHANIQKDGTYSVVPRMWGGETSAAELRRIADVVDKYQIPTVKVTGGQRIDLLGVKKEDLVNVWRDIGMPCGHAYAKALRTVKTCVGSEWCRMGTQDSTQLGKDLEHAFVGMYAPHKVKFAVSGCPRNCAESGIKDVGIIGVDSGWEMYVAGNGGIKTEVAQFFTKLKTAEEVLEYTGAFMQLYRLEGWYLERTVHFVARVGLDYVKRRVLQDAPGRQALWRELQDALAGEPDPWFEFEPAAVDRRQFIPITPIPA

SEQ ID NO: 6423 - protein, 559 aa, Oryza sativa
MAEDAAAAAMAAASLSDDLEPATDRTRIRSILADGAARAGERVVVGGWVKTGREQGKGTFAFLELNDGSCASNLQVLVDAAVHPLAPLTATGTSVLVEGELKKPPEGAKQRVELRVDRVIEVGEVDPAAYPLPKTKLTLENLRDVVHLRSRTNTIGAVARIRHQLACATHRFFDENGFLYVHTPIITTSDCEGAGEMFQVTTLFSHAEKVEKELKENPAPSESDIEAARVVVKEKGDAVAQLKAAKASKQEITAAVAELNKAKENVSRLEERSKLKPGIPYRDDGTVAYENDFFKRQAFLTVSGQLQVETYACALSSVYTFGPTFRAENSHTSRHLAEFWMVEPEIAFANLQDDMNCAERYVQYLCKWLLEHCREDMEFMVKNYDKTAIERLELVSSTPFQRISYTKAVELLKNVTDKKFENKVEWGIDLASEHERYLTEVIFKKPVIVYNYPKEIKAFYMRLNDDQKTVAAMDVLVPKVGELVGGSQREERLDLLKTRIQDAGLPLEPYEWYLDLRRFGSVKHSGFGLGFERMILFATGLENIRDVIPFPRYPGRADL

SEQ ID NO: 6424 - protein, 952 aa, Unknown
  Acidovorax sp. JS42
MQETRSTCPYCGVGCGVIIQSDGDTITGVRGDPHHPANFGRLCTKGSTLHLTASRPITLQTRLLQPQLRPQRGQAAHPIDWDAALDTAAQRFAATIDRHGPDAVGFYLSGQLLTEDYYVFNKLAKGLIGTNNIDTNSRLCMSSAVAGYKATLGADAPPACYDDLGHAQCLFIAGSNTAWAHPIVFRRIEDARAANPAMKIIVADPRRTDTAAMADLFLPLLPGSDVMLFNAMLHVMLREGWVDQGYIARHTSGFADLQAVVQDCTPERAAAVCGLPPQDIATAARWFAGVESMAEGGPRRPTLSLYCQGLNQSTSGTAKNAALIHLHLACGQIGQPGAGPFSLTGQPNAMGGREVGGLANLLPAHRDMANPDHRAEVARLWGLESVPARPGKTAVEMFQAAADGEIKALWIACTNPAQSLPDQTTVRRALQRAEFVVVQEAFATTATAQYADLLLPATTWGEKTGTVTNSERRISRVRAAVAAPGGARHDWQIALALAQRLERHLRPGQPTLFPYTGDTAQACAEAIWNEHRETTRGRDLDITGLTWAALEADGPQQWPYPSGARTGRARLYADGVFPTPDGRARFVPTAWQPLAEPPSARYPFSLTTGRLRDQWHGMSRTGTLGRLFGHASEPALQMHPQDLQRLQLAAGDLAHVTSARGSIIAPVQADDTLAPGQAFMAMHWGGEYLGGRSSTGRPLAGVNALTTPAFCPGSKQPELKHAAVKVLKAELPWTLLAMAWLPEDEALAAREALAALMPELPFAHCVPFSGAAPAAGPARTGVLLRGAAHEAPPPALLARIEHLLHLDGPGTLRYADRRRAQHRAARLQRQADGRTTLDALLLAGNGSAGGWLRTLLQEELPVQTYGRLLLLPTQQPPVAVAARGKRVCVCLNVTDTDITERLGQCQGSPAERLAQLQGALRCGTQCGSCVPELKRMVQAAVAGIGTTAVQAA

SEQ ID NO: 6425 - protein, 900 aa, Xanthomonas campestris
MALICLCTTAGVVTAAEPTNAPRERISLNADWRFRRGDPPGNTVRLEYDVRPEVVRSEDGKVADARPEQAQRIDADARNVLKPWILPTANSLIADPTQRHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQHMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVYAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGEPTPYYSSRSSYSGILDLAGFPKDRYWLYQARWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAE

SEQ ID NO: 6426 - protein, 269 aa, Unknown
  Acidovorax sp. JS42
MTTPSLPAHAGSCTLVGAGPGDPELLTLKAVKAIQAATVLLVDDLVSDAIVALARPGARVVHVGKRGGCKSTPQAFIEKLMLTAVQEGETVVRLKGGDPFIFGRGGEEVEHLRAAGVPVQVVNGITAGLAGMTQLGAPLTHREHAHGVVFITGHNKPGNQGTDWRQLAATARDARLTLVIYMGVTGCAHIQEELLTGLPAHTPAVVIQHVSLPQQRHAVTTLGQLQSTITREGLASPSVIVIGDVVRGIQAVAHGEDAAPVAGTRSRAV

SEQ ID NO: 6427 - protein, 121 aa, Unknown
  Oceanobacter sp. RED65
MPSLYEKLGGDKAVSATVEIFYKKVIADKELSPFFSGINIDRQKRMQSKFLTVAFGGPNNYSGQTMRAAHRRPVELGLNEHHFNLVAGHLKQSLIELQVPPELVHQVMAIAASTKQDVLNQ

SEQ ID NO: 6428 - protein, 564 aa, Glycine max
LKRLKEQSKPKEGIDAVKQRQSQEQARRKKMSRAQDGILKYMLKMMEVCKAQGFVYGIIPEKGKPVTGASDNLREWWKDKVRFDRNGPAAITKYQADNAIPGKNDGCNPIGPTPHTLQELQDTTLGSLLSALMQHCDPPQRRYPLEKGVPPPWWPNGNEEWWPQIGLPKDQGPPPYKKPHDLKKAWKVGVLTAVIKHMSPDIAKIRKLVRQSKCLQDKMTAKESATWLAIINQEEALARELYPDYCPPLAASSGGSGSMVINDCNEYDVEGGDDEPNFDVEDRKPENLHAPNLGMDRMMGRLPSFPIKGEAVTNLDFIRKRKISGDFNMIMDQKIYTCEQPQCPYSEIHHGFADRNSRDNHRLSCPYRGSASTDYGGSNFHVNEAKPVIFPQQSFVQPKPTTTPSVVNLVPSVIDLTGLGVPEDGKKMITDLMSIYDTNVQSNKNLSSSNHVSAENPNLPQPGIQQQHDNFFRSQGISMEGNFFEEANMSNNNHHMFAREEGQFDRFKALNAPPFETNHNNNNFHLMFGSPCDLASFDFKEDMQGGVVGMDALQKQPDISIWYQ

SEQ ID NO: 6429 - protein, 653 aa, Mycobacterium avium
MYDPLGLSIGTTNLVAARNGSPPVSRRCVLTLYPHCAPKIGAPEENPLLAEPGVPMKGFVERIGDSVALVSPDGSAHDPELLTVEALDAMVLAAGADAASSEISIAVPAHWKPGTVQALRDALRTHLGFVRSGMAPRLVSDAIAALTAVKSELGLPDEGVVGLLDFGGSGTSATLVNVAGDFELVSATMRYTALSGDEIDQELQLRAFEELGHGSGLDPASTAGVGQLAALREQCRAAKERLSTDVVTEITAELGGRSCSLTLTQDDLEELMQDRLTGFIYAFDDLLVRYRKSWSDLAAVVTVGGGARIPLVTERLSMHGRTPILTPSQPAFAAAAGALLLASRGGELDMRTRTSIGLLAAADAAGDVVDLGAGDVLVIDDEALTDRELAWSQTEYPGDLRMRFGGETYDEDGPAGWSMRLNVIDPPKPRRPWRRLRFSQLIIGMSAAVAMTAIGGVAYTLTGIENRQAPPAPSVAPLPPVSRVVPPSAVAPPTAVPPPPPPSAQPVPSPAPPPPQPPPPPPSPPPAPPPPVVVTTAPPAPTYTPRHTAPPTAPPALTTTAPTPSPTPTTTPPPPTTTQEPTTTSTTTTVPMTTEWIHVPLLPVPIPVPVPQKQAPATPQYPSNEYPQYPQYPGNEYPQYPGNSQNPYYGPGY

SEQ ID NO: 6430 - protein, 655 aa, Debaryomyces hansenii
MATAATIDMADEVNPPLTYEPVDLDIPASKIYGTLKPNHNGLENKNLYELASKWIDAFNAIVKEIQNDPSEKNLDKLNSVIASHASWKDHLALSWDYRQFHDLDNIKDVAKNSFPSFKLKNFEIDTTADHRFDKAVGLQTIDKADETNSIPIQWVQIIVKFENEFGYGNGLIRLISVDEKDAPGGLKAFTIYTALENIKGNEETLGRSRPQGVNHGQNQGRISWLEKREKDFEWGSEKTPTVLIVGGGQGGLNVAARLKTMGIDCLIIEKNSKIGDNWRNRYKFLVLHDPVWYDHLAYIKFPDVWPVFTPKDKLGDWFEAYSKSMELSYWVNKTVSGADFDPVTGVWSVNIIDNDTGKLTNIKTKHIVMATGHSGEPNIPTFKDQDKFKGTIVHSSQHSTGKSFQGENAVVVGCCNSGHDIAQDFYEQGAKPILVQRSTTCVINSEIGLKVTTKGLYEEGGPKTETADLILQSMPVKLLNLVMQQQYRQTMILEKDLHESLKKSGFKTDSGYGGTGLFGKYYRRGGGYYIDVGCSKLIADDKIKVQQGKNIERFTENGLVFSDGTKIDNLAIVVLATGYSNMRDTARRIFGDKVADKLNPVWGLDDEGEINTMWRDSGHPKFWYMGGNLAVSRYFSKRLALKIIAQERGFDKSNS

SEQ ID NO: 6431 - protein, 387 aa, Clostridium tetani
MSKINEDLTMENMIEEIDKNMKKVKEKDIVKGKVISVSEDEVLINIGYVADGIIKKSDLEDIDFKEEFKKDEEVYVYVVKLNDGEGNVILSKRIADKIRTLDKLEKDFKEGNIFKIKIEEIVKGGVITHINGVRAFIPASHISSKFVQDLNEFLGKEKDVKVIEFNRKDNKLVLSAKEVEDEKLTKKREELWKTLKEGEKINGKVVRLVKFGVFVDIGGIEGLVHLSDLSWKRVNNPSDIVKEGDEVEVFILNVDKKRERLGLALKDIKEDPWKKALDNHKIGTVEHGTVVKLVEFGAFVELKDGLEGLLHISEISEERILKPEEVLKIGDKIKVKILDINKENRKMSLSKKAAEDKSSAEMEKYSDKEEGVSLGEILGDKLKDFKF

SEQ ID NO: 6432 - protein, 648 aa, Listeria monocytogenes
MDDTDKRVHKYIEKHDLIRSDDKLLVAVSGGPDSLALLHFLWNSNLVPKEAISVAHINHHLRENAANEQNVVEAFCESQGIPFYIEEVDVKSRAESLQKGIEETARIVRYDFFEKVMAEKKINKLALAHHADDQIETILMRLVRGSASIGWSGIQPKRELKGGQAIRPFLPITKAEIIDYAQKHELAYEIDESNTSQEYTRNRYRAQLLPFLKQENPAVYSHFERFSEETSEDFQFLEALASDLLKKNLIKNGKRTTLLLTNFKNEANPLQRRAIHLLLRYLYNEDASFITVNHIYQIIQMIQSDNPSSSIDLPNKLVANRAYDKLHFQFGEREAPSEFYHQLELNDRIELDNKASIRLKLKSSVVQTNGLNGMLLDAEEITLPLIVRNRVNGDRMTMKGQAGSKKLKDIFIDAKIPRQERDKLPVITDYTGKILWVPGVKKSAYDREFSRSKKQYIIRYTRNIGGNESMHNDIQKVLISEDELQEKIRELGRELTTEYEGRNPLVVGVLKGATPFMTDLLKRVDTYLEMDFMDVSSYGNGTVSSGEVKIIKDLNASVEGRDVLVIEDIIDSGRTLSYLVDLIKYRKAKSVKLVTLLDKPAGRNVEIEADYVGFVVPNEFVVGYGLDYAERYRNLPYIGILKPEIYSE

SEQ ID NO: 6433 - protein, 301 aa, Acidobacteria bacterium
MANITMKELLEAGVHFGHQTKRWNPKMKEYIFGERNGIYIIDLQKTLKMFKEASKFVSDVAAEGKLVLFVGTKRQAQDAIAEEAKRCGMFYINQRWLGGLLTNWVTVQKSVKRLKELDEMATDGRYELLPKKEVIKLERERKHLQANLAGIKNLNRLPDCLFVIDSNKEQIAVKEARKLGIPVVAVVDTNCDPSEVDYVIPGNDDALRAIRLFASKIADSVAEGSQLADKSMIESTNVSNAAEVIPQSYIGDDEEHGLAQPTEEAAPVEEEINMEEVLGKGVRKQPVSENENVEAAAAEQK

SEQ ID NO: 6434 - protein, 509 aa, Ralstonia eutropha
MTAAAPEDTLLDVLIVGAGLSGIGAARQLQQRCPGKRFAILEARDAIGGTWDLFRYPGIRSDSDMYTLGYRFKPWKGAKAIADGPSILSYIRETADEAGITPRIRFGCKVVSAAWNSHDACWTVTAERVADGSRQQWRARFLYVCAGYYSYAAGHRPAFAGEESFRGRIVHPQFWDASLDYAAKRVVVIGSGATAVTMVPAMAGTAAHVTMLQRSPSYVVTRPGEDAIAAKLRRLLPEGLAYAATRWKNVLLGMFVFQLARRRPERVSERMVGMAAAQLGPDIDVGRHFTPRYKPWDQRVCLVPDGDLFREIREGRASVVTDAIERFTEDGIRLASGQTLPADIVVTATGLKLNMLGDIAISVDGQPRVPAEQMAYKGMMLSDVPNLVLAFGYTNASWTLKADLTAEYVCRLLRYMDRRGYRAAVPRRDAAVKPTPFLDFTSGYVQRAASVLPRQGDRKPWRLYQNYLMDMLTIRHGRIADGVLQFDAPHPATAPREVPVSLSGGEVQP

SEQ ID NO: 6435 - protein, 268 aa, Vicia faba
MEFAHLTVLSLFCLAFVGITATSSGEDYWQSIWPNTPLPKTFSDLLIPSGKTNSLPIKSEELKQYSTLFFEHDLHPGKNFILGNTNSVGSIIRPFTKSRQGVTDSIWLANKEKQSLEDFCYSPTAIAEHKHCVSSLKSMIDQVISHFGSTKIKAISSNFAPYQDQYVVEDVKKVGDNAVMCHRLNFEKVVFNCHQVRDTTAYVVSLVASDGTKTKALTVCHHDTRGMNPELLYEALEVTPGTVPVCHFIGNKAAAWVPNHTADNLCVM

SEQ ID NO: 6436 - protein, 218 aa, Ostreococcus tauri
MSSGPRVAGRPVEDPDVASVVCDAEMIEGALETLAVLIVSQLKDFSVFVPVATGAMTFASDLTRQCYVTQRVVRDDVVRTYARPVIACATCASYGDGTSSEGAKVDVRAPGAEVVRGRKVVILEDIIDSGRTAMALAKVLYEQGAEEVALIALMDKRERRDPEATKYFEEKNMKIACAFLCPDEFVVGYGLDYQGKYRDLPFVGILKPEIFAGEGGEK

SEQ ID NO: 6437 - protein, 340 aa, Capsicum annuum
MGHHCCSKQKVKRGLWSPEEDEKLIKHITTHGHSCWSSVPKLAGLQRCGKSCRLRWINYLRPDLKRGCFSEQEERIIIDVHRILGNKWAQIAKHLPGRTDNEVKNFWNSCIKKKLISQGFDPNTHNLLSRAAAAATPPHRNNKKKTNNNHTTSSVFTIETSLSPSSTKELVSMDMIKASLAALSPFPHTNSSTTVLTMPQFQTSWSHLYESACNYYNHVPIKTNIVYQNHSTSTGTFGIINENCMWGVTGFEPHHEFGPSNNIGHEEMQQGAQVQLQEENCLEEVYKVNDLHEFNKHGRIAENVTFDDSSDFDFEFVDSELIPCGIYTNVNSIDQLAWDC

SEQ ID NO: 6438 - protein, 140 aa, Triticum aestivum
MATSTAAVLSPPTVAGLRLAPSPRAAVSFRAPARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 6439 - protein, 274 aa, Streptomyces avermitilis
MADAPTGKVTFVGAGPGAADLLTFRAARAIAEADVVIWAASLVQAEVLDHARAGADILDSATMSLEDVVAVYRRAHAEGLKVARIHSGDPALWGGTQEQADRCAEIGIETEIVPGVSSFSAVAALAGRELTIPEVAQSVILTRLGGGKTPMPPGEEVREFARHGTTMALFLSAARSGQLVRELLEGGYPTSTPVVVAYQATWPEELIVTCTIETLEETVKEHKLWKHTLFLVGPALGAHGTRSHLYHPGHFHGFRKADPQARAELRAARKGSPS

SEQ ID NO: 6440 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 6441 - protein, 94 aa, Arabidopsis thaliana
MRQMADAAIRQGGGRPLPPLPRGVKQQPPRPKPEPVNREKTCPLLRRVFTRSGGHHTTEHYAVRGIEPHDEVHIYTWQDASLRELTALGKEVSV

SEQ ID NO: 6442 - protein, 336 aa, Mycobacterium avium
MTADTVHDVIIIGSGPAGYTAALYTARAQLAPVVFEGTSFGGALMTTTEVENYPGFRDGITGPELMDQMREQALRFGADLRMEDVESVSLAGPVKSVTTAEGETVRARAVILAMGAAARYLGVPGEQDLLGRGVSSCATCDGFFFKDQDIAVIGGGDSAMEEATFLTRFARSVTLVHRREEFRASRIMLERARANDKITIVTNKAVEAVEGSETVTGLRLRDTVTGETSTLAVTGVFVAIGHDPRSELVRDVLDTDPDGYVLVQGRTTATSIPGVFAAGDLVDRTYRQAVTAAGSGCAAAIDAERWLAEHAESSAAAQGDATEFPGSTDTLIGAPQ

SEQ ID NO: 6443 - protein, 253 aa, Triticum aestivum
  misc_feature (182)..(182): Xaa can be any naturally occurring amino acid
  misc_feature (192)..(192): Xaa can be any naturally occurring amino acid
LKKADKLDRELSLMRSQEETGRHVRMLIHEIRSTLDRHTILKTTLVELGRTLGLQECAFWMPSRSGSSLELTHTMRHHIPTGSSVEINLPVVNQVFSTNRAIIVPHTSPFARIHPVQGRHLPPEVAAVRVPLLHLPNFHPELLAKSYAIMVLMLPSDSARKWLAHELELIEVVADQVAVALXHAAILEESMXARDLLTEQNVALDLALREAEMAIHARDVNRVGVELVGPEDADNLATIDSSASAAKVHNAKP

SEQ ID NO: 6444 - protein, 229 aa, Candida albicans
MVKSNVESAWETMEDTFSEIQNKFHQIYKPIDTGKPDEDDETTKKESLDITDDSTLSVSPITQLLYLARSKFYDLTPLDNQKSPFPFKNLRGKVVLIVNVASRCGFSFQYNGLEQLNKRFANDDFVLLGVPCNQFLWQEPGTNDQIVTKCKKKYDVSFQILDKINVNGEQADPVYKFLKAQKEGLWGTNRVKWNFEKFLIDKNGRVVERYSTFTRPVAIIPKIEQLLES

SEQ ID NO: 6445 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAVFLDCHKVGCPAEAAEEIAAAARVREARQRAAAAASRMPPAPEDPELDQFMEDYCKLLVECKEELSRPLQEAEEFL

SEQ ID NO: 6446 - protein, 302 aa, Mycobacterium tuberculosis
MNTGTAVITGASSGLGLQCARALLRRDASWHVVLAVRDPARGRAAMEELGEPNRCSVLEVDLASVRSVRSFVETVRTTPLPPIRALVCNAGLQVVSGIAFTDDGVEMTFGVNHLGHFALVTGILDWLARPARIVVVSSGTHDPSKHTGMPDPRYTCAADLAHPPTDQNTPAEGRRRYTTSKLCNVLFTYELDRRLDHGEQGVMVNAFDPGLMPGSGLARDYPPILRLAYRLLSPMLRVLPFVHSTRVSGEHLAALAVDPRFAGVTGQYFAGAKAIRSSAESYDRAKALDLWETSERLLAQVT

SEQ ID NO: 6447 - protein, 1711 aa, Anaerocellum thermophilum
GSFNYGEALQKAIMFYEFQMSGKLPNWVRNNWRGDSALKDGQDNGLDLTGGWFDAGDHVKFNLPMSYTGTMLSWAVYEYKDAFVKSGQLEHILNQIEWVNDYFVKCHPSKYVYYYQVGDGSKDHAWWGPAEVMQMERPSFKVTQSSPGSTVVTETAASLAAASIVLKDRNPTKAATYLQHAKELYEFAEVTKSDAGYTAANGYYNSWSGFYDELSWAAVWLYLATNDSTYLTKAESYVQNWPKISGSNTIDYKWAHCWDDVHNGAALLLAKITGKDIYKQIIESHLDYWITGYNGERIKYTPKGLAWLDQWGSLRYATTTAFLAFVYSDWVGCPSTKKEIYRKFGESQIDYALGSAGRSFVVGFGTNPPKRPHHRTAHSSWADSQSIPSYHRHTLYGALVGGPGSDDSYTDDISNYVNNEVACDYNAGFVGALAKMYQLYGGNPIPDFKAIETPTNDEFFVEAGINASGTNFIEIKAIVNNQSGWPAKATDKLKFRYFVDLSELIKAGYSPNQLTLSTNYNQGAKVSGPYVWDASKNIYYILVDFTGTLIYPGGQDKYKKEVQFRIAAPQNVQWDNSNDYSFQDIKGVSSGSVVKTKYIPLYDGDVKVWGDGPGTSGATPTPTATATPTPTPTVTPTPTPTPTSTATPTPTPTPTVTPTPTPTPTATPTSTPTPTSTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPSVVGEYGQRFMWLWNKIHDPANGYFNQDGIPYHSVETLICERPDYGHLTTSEAFSYYVWLEAVYGKLTGDWSKFKTAWDTLEKYMIPSAEDQPMRSYDPNKPATYAGEWETPDKYPSPLEFNVPVGKDPLHNELVSTYGSTLMYGMHWLMDVDNWYGYGKRGDGVSRASFINTFQRGPEESVWETVPHPSWEEFKWGGPNGFLDLFIKDQNYSKQWRYTDAPDADARAIQATYWAKVWAKEQGKFNEISSYVAKAARMGDYLRYAMFDKYFKPLGCQDKNAAGGTGYDSAHYLLSWYYAWGGALDGAWSWKIGSSHVHFGYQNPMAAWALANDSDMKPKSPNGASDWAKSLKRQIEFYRWLQSAEGAIAGGATNSWNGRYEKYPAGTATFYGMAYEPNPVYHDPGSNTWFGFQAWSMQRVVEYYYVTGDKDAGALLEKWVSWVKSVVKLNSDGTFAIPSTLDWKRQPDTWNGAYTGNSNLHVKVVDYGTDLGITASLANALLYYSAGTKKYGVFDEGAKNLAKELLDRMWKLYRDEKGLSAPEKRADYKRFFEQEVYIPAGWIGKMPNGDVIKSGVKFIDIRSKYKQDPDWPKLEAAYKSGQAPEFRYHRFWAQCDIAIANATYEILFGNQ

SEQ ID NO: 6448 - protein, 458 aa, Bacillus halodurans
MTTLVREKQTYDVQYYVQHVYETVKRRNPNEHEFHQAVKEVFDSLLPVLVKHPQYVKQAILERIVEPERVISFRVPWVDDQGNVQVNRGFRVQFNSALGPYKGGLRFHPSVNASIIKFLGFEQIFKNALTGQPIGGGKGGSDFDPKGKSDGEIMRFSQSFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 6449 - protein, 483 aa, Dechloromonas aromatica
MTEEILINFTPQETRVAVMQQGVVQELHIERTASRGLVGNVYLGRVVRILPGMQSAFIDVGLDRTAFLHVADIWQPRETATERPIEKILHDGQSILVQVVKDPIGTKGARLSTQVSIAGRMLVYLPQEKHIGISQRIESEAEREVLREKITRLVPSDEPGGFIVRTMAESASDEEFATDIAYLRKTWADIRDKARTSGPPTLLYQELSLGQRVLRDFVNPETTRIFIDSRENFQKLTGFAEEYTPAVLPLLEHYTGQRPLFDLHGVEEEIQKALARRVDLKSGGYLIIDQTEAMTTIDVNTGGFVGVRNFDDTIFKTNLEAAVTIARQLRLRNLGGIIIVDFIDMENEEHKKAVLDEFNRALAHDHTRLTVNGFTQLGLVEMTRKRTRESLAHVLCHPCPTCTGRGEVKTARTVAYEILRELLREARQFNAREYRILAGPDVVDLFLDEESQALAMLSDFIGKSVSLQSEPSYSPEQYDIVLM

SEQ ID NO: 6450 - protein, 634 aa, Desulfotalea psychrophila
MCGLAGFFNYQFIADNTILHLQSMGKSISHRGPDASGTWYDADTGIGLVHTRLAIVDLSSAGHQPMHSQCDRYVIAFNGEIYNHLMLRQKLEQANQAPAWRGHSDTETLLACFVAWGIEQTLKVTVGMFALALWDKQEQNLTLARDRAGEKPLYWGWQGDTLLFGSELKALKAHPDFKAKVSRDALAVYMRHNYISAPQSIYEGIYKLLPGHYVTLNSVSNIDTATPKAYWTMNQAIESGIAQPFSGTDIEAVDLLEHRLSQSIGGQMLADVPLGAFLSGGVDSSVVVALMQKQAQQSVKTYAIGFDDPRYNEAQYAAAVARHLGTEHTELYVSAQDALELVPQLPSIYCEPFADSSQLPTFLVTKMARQHVTVALSGDGGDELFGGYTPYLFTPRYWNLLKCYPQPLRAALAASMSRLPLPDKFLKLAEVMGASNKESFYRSIMSHWGQPEDVVIGAKEPASVLNSSDLWPETDSFEHWMMAMEAQMYMPDDILVKVDRAAMANSLETRVPLLDHRVIELAWQLPLSMKIRDGKGKWVLREVLYRHVPRELIERPKKGFSIPLANWLRGPLRDWAEALLDEKRLRGEGYFYPAPIREAWQQHVQGKRDNASKLWSVLMFQAWLDEQDANSITL

SEQ ID NO: 6451 - protein, 202 aa, Brassica napus
  misc_feature (136)..(136): Xaa can be any naturally occurring amino acid
MGVYETEKPTKDAAVVETQSPEDFDQPSPLRKIISVASIAAGLQFGWALQLSLLTPYVQLLGIPHKWSSLIWLCGPVSGMIVQPIVGYHSDRCTSRFGRRRPFIAAGAALVAVAVFLIGYAADIGHKMGDKLEQKXRGVRAIGIFAFGFWILDVANNTLQGPCRAFLADLSAGDAKRTRVANGFFSFFMGVGNVLGYAAGLF

SEQ ID NO: 6452 - protein, 49 aa, Agrobacterium tumefaciens
MKLENEHEIIAHTAGRMRKNRIRVLAGDKVLVEMTPYDLTKGRITYRFK

SEQ ID NO: 6453 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 6454 - protein, 554 aa, Erwinia carotovora
MCSIFGVLDLKSDPVELRKKALELSRLMRHRGPDWSGVYASDKAILAHERLSIVDVNTGAQPLYNAERTHILAVNGEIYNHQALRQQYGDRYAFQTGSDCEVILALYQEKGPEFLDELRGMFAFALYDSEKDAYLIGRDHLGIIPLYMGYDEHGNLYVASEMKALVPVCRTIKEFPAGSYLWSKDGEIREYYQRDWFDYDAVKDNETDKVALHDALEEAVKSHLMSDVPYGVLLSGGLDSSVISAITKKYAARRVEDDARSEAWWPQLHSFAVGLEGAPDLKAAQEVAKHLGTVHHEIHFTVQEGLDAIRDVIYHIETYDVTTIRASTPMYLMSRKIKAMGIKMVLSGEGSDEVFGGYLYFHKAPNAKELHEETVRKLLALHQYDCARANKAMSAWGVEARVPFLDKNFLDVAMRINPRDKMCGNGKMEKHILRECFESYLPHSVAWRQKEQFSDGVGYSWIDTLKEVAANQVTDQQLETARFRFPYNTPGSKEAYLYREIFEELFPVSSAAECVPGGPSVACSSAKAIEWDESFKTLDDPSGRAVGVHQSAYK

SEQ ID NO: 6455 - protein, 322 aa, Pediococcus pentosaceus
MKRIGIMTSGGDAPGMNLAIRAVARKALSSGLEAYGINYGFAGLVAGDIHEFKAADLDDMVSQGGTMLYSARYPEFAQEESQLKGIEQLKKFGIDALVVIGGDGSYHGALRLTEHGYNTIGLPGTIDNDIPFTDFTIGFDTALNTAVDAIDKIRDTAKSHQRVFAVQVMGRNAADIALWAGVASGADAVIAPGFDYDVEAIANKLKKNRANGKDYGIIVIAEGDANSDAAPEFIDQLKQYGDFDARATVIGHVQRGGVPSAKDRVLASKMGAYAVELLLEGKGGLAVGILENKVQAHNMLDLFDAKHQADDSLYQLSEDLSF

SEQ ID NO: 6456 - protein, 498 aa, Myxococcus xanthus
MNKTLLYITVIVIATCGLIYELVVGALASYLLGDSITQFSTVIGGYLFAMGIGSYLSRYIERGVAQRFVEVELAVALLGGICAPVLFLTFTLTDLFQVALYGSVIAIGALVGMEIPLLLRILKDQVKFKDLISQVLSLDYVGALAASVAFPLLLVPKLGLVRTSLLFGVLNAAVALWSTWLLAPLLGNPLRLRIKAVGLTVLLLAGFVMGDRLTTFYEDQLYADDVVHASSSPYQRIILTRGKRGFSLFLNGNLQFASLDEYRYHESLVHPAMVRAGKVENVLILGGGDGLAAREVLRYPEVRSVTLVDLDPVITGLATNYGELAKLNRHAMTDPRMRVVNGDAMQFLTEGGAQYDVVVVDFPDPNNFALGKLYTTGFYKLLKKRIAPDGVAVVQSTSPLFARRSFWCVETTLKAAGFWTEPYHALVPSFGEWGYVLIAHEPPARHRPLPEGLLFLDDATMASLTQFPPDMGPLPVEVNRLNNQVLVHYYEAEWQRWN

SEQ ID NO: 6457 - protein, 601 aa, Unknown
  Chrysanthemum x morifolium
MATSSNYTHPFTNNNTRTKFLTSSKDGVFGSSPVSVTVKKQGNQTRQNSIRSALQTPSILQVPKQTPRKTSKTIELPSLSPSPKVPQNWNLLQKLASIALDAIEDRIKDNEKLHPLPKTVDPDVQIAGNFSPVPEQPVRHSLPVAGKIPEHFNGVYLRNGANPLFEPTSGHHLFDGDGMIYAVKFDNGSASYACRHTETHRLVQERAIGKPVFPKAIGELHGHSGIAKLLLFYARGLCGLVDHNNGIGVANAGLVYFNNRLLAMSEDDLPYHVRVTPSGDLKTAGRYNFNGQLESTMIAHPKLDPVSGELFALSYDVIKKPYLKYFWFSPDGKKSDDVEIDLEKPTMVHDFAITENYVVVPDHQVVFKMSEMVTGGSPVVYDKEKVSRFGVLDKYAKNGSGIKWVEVPDCFCFHLWNAWEEPESDEVVVIGSCMTPADSIFNECNEELKSVLSEIRLNLKTGKSTRRAIISPENDVNLEAGMVNKNLLGRKSKYAYLAIAEPWPKVSGFAKVDLSTGETKKFIYGDEKYGGEPLYLPRDNASDEDDGHILAFVHDEKAWKSELQIVNAKTMKLEATVMLPSRVPYGFHGTFIPARDLASQA

SEQ ID NO: 6458 - protein, 694 aa, Rhodobacter sphaeroides
MKRPTRPAPPLKFDMSSAHPNRLGADFDGEGTNFPLFSENATRVELCLFDETGQTQTHCLDLPSYEGGIWYGYLPGIREGQTYGYRVHGPHAPEEGHRFNPNKLLIDPYARELRGDLIWDDALFGYPIGGDDLELDPRDSAPFMPKAVVVDPAFDWEADKALRHRWQDTVIYEAHVKGLTMRHPGVPEEDRGTFKGLASPAVIDHLKAIGVTAIELLPIHGFLNDRHLIEKGLSNYWGYNTLSFFAPYRPYTKSGSMREVKRAIKRFHDAGIEVILDVVYNHTCEGNEKGPTLSFRGIDNASYYLLSPEAKRHSFDTTGTGNTLNVAHPMVLRMVMDSLRYWVEVMHVDGFRFDLASTLGREPEGFERGGTFFAAIRQDPVLSMVKLIAEPWDIGEGGYQVGGFPWPFREWNDKARDDLRAFWRRDPGLIGDVSQRLLGSPVQFSHSHRPATSSVNFIAAHDGFTAWDLVSYDEKHNEANGEDNRDGHSHNLSHNLGAEGPTDDPGILEARLRRVKAMLATLFLSQGVPMILAGDEFGQSQQGNNNAYCQDNEIAWLDWEEARDELIRAVADLAEFRKADGGISRARFAVGPDAVQHDTPVATWLHPAGREMEEGDWNEGELRLFALRLDLPRGRDLLVVLNAGDDGDFALPEGEWRLKIDTSRERIACDEPALGTLPVGWQSVMVLVAAEEAD

SEQ ID NO: 6459 - protein, 541 aa, Unknown
  Rhodococcus sp. RHA1
MTVQDNDFDAVVVGAGISGLYAVYKLRQRGMRVHGFESAEGVGGTWYHNRYPGARCDVESIDYSYSFDEELQQEWTWTERFATQDEILRYLEHVADRHDLRSAYDFLTRVTSATYDEETTRWSITTDTGQNVTARFCVLATGVLSATNKPDIPGRDTFGGATYHTGEWPHEPVDFAGKRVGVIGTGSSGIQSIPVIAEEAAEVFVFQRSPNYSIPAGNRPLTGEYIAEVKANYAERRRLSRMSGGGTPNSAYPKGALEVDAEERRRVYDEWWQRGGYLFAKAFPDQTISQAANDTAREYVEAKIREMVTDPDIADQLVPTDHPIGTKRIVTDNGYFKTFNRGNVTLVNLRRTPITEITEAGVLTTNSFYGLDMLVFATGFDAMTGSLSRIDIRGRAGRNLRDEWSAGPRTYLGLSVAGFPNMFILAGAGSPSVLANMVLMAEQHVDWISNCLDYLDEHNIETIEATDESVDEWVAECNEKAAGTLFPTADSWYMGANIPGKPRVFMPYIGGFGNYNTICAEVAAAGYKGFELGERRVDVDQ

SEQ ID NO: 6460 - protein, 308 aa, Myxococcus xanthus
MKTFLVVNPRSANGQTGKRWAEISAQVGRALGDFGHGFTQGGMDAARITRQALLDGYECIVAVGGDGTLNEVTNGFFEDGKALNPNAALGLIPRGTGGDFRRTFGWDLELASSLERLRSGTTEPFDVGQLEFIDNAGQPATRYFANIASFGVSAVVAQEVNQSSKALGGHLSFVWGTLKGLVKYSERQVRLSVDGGPEEVVSVTAVAVANGRYFGSGMFVAPDAVTHDGLFDVTIWSNYSLSDFVLKSKGVYNGSHVNWKGTRRLRCRTLRAEPVDGGDVFLDVDGETPGRLPCTMTLLPGAIRLKVL

SEQ ID NO: 6461 - protein, 553 aa, Vibrio fischeri
MFCIQCEQTIQTPTTKGCSFAQGMCGKTAEVSDLQDILVYALQGVSFWAEQGRKVNVILDEIDQWAPKAFFATLTNVNFDPERVIEFALQAQDYKQQLEETVRAAATVTNTELDELSPAAKFELPTEADQIIALAPQAAVNRGHETQHEDVIGLRLLCLYGLKGAAAYMEHAHVLGQTDKDVFTEYHQIMAWLGTDPTDLGELLDCSMKIGLMNYRIMEMLDTGETNTFGHPEPSQVNVKTIKGKCILVSGHDLHDLEKILQQTEGKGINVYTNGEMLPAHSYPELKKYPHLVGNYGSAWQNQQKEFANFPGAIVMTSNCLLNPNVGQYADRLFTRSIVGWPGVAHIEGDDFTAVIDCALAQEGFKHNEIEQMITVGFGRNALMAAAPAVVEQVKEGNISHFFLVGGCDGDKSERSYYTDFTAQAPEDSVILTLACGKYRFNKNQFGDINGIPRLLDVGQCNDAYSAIQLALALAKEFDCGINELPLTLVLSWFEQKAIVILLTLFALGVKGIYTGPTAPAFLTDNLLAIIQEKFDMRSIGNVEDDLKAILAA

SEQ ID NO: 6462 - protein, 534 aa, Unknown
  Mycobacterium sp. JLS
MTADNPVKRTDVDKALLGSATYRSLGEQRLTPAEERFEKGRRTVGLFLAPALTVVFLLLPLDLPPQQQTLAAVLLGVIVLWVTEAVPIPIGGLLGVAVVVFLGVAPADDVLAPFGSSTIFTFIGAFILAQAMLKHGLARRFAFRILALPRAGQSTTGVILAFGAITCLLSAFVSNTATVAMLLPTAIGILGVIAKLLQKQGNVADDFDPLRLRVGAALMLMLAYSASVGGLLTPVGSPPNLIGRGLIEEATGERISFGQWMVMAAPICLLMFAILAVVLLLLNKPELKHIDGVADYVAREREEMGRLSRAEKNTLIAFGVTVFLWILPGIIALAFGNDSDIYSSVSDRLDEGTVAVFGAALLFLLPTEWEQREFTLRWRDAAAIDWGTIVLFGTGIIFGSLLADSGLAETIGNSVADALGLSSVVAITIFAVLLAIVVSETTSNTASAAVVVPIVIPVAIAAGVNPFVPALAATFAASFGFMLPVSTPQNAIVYGSGAVPITTMIRSGVTFDVAGAILIILFLPLMIALLGLGA

SEQ ID NO: 6463 - protein, 713 aa, Bacillus thuringiensis
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQEEATTFKVWAPTARLAKVRIYKSDKEYTDHEMHREENGVWAHTLQGDLAGEKYTFLVCINLIWNEAVDPYAKSVTVNGKYGVVIDLEKTNVTKQEQLPPLQAMTDAILYELHIRDATIHEGSGVSKKGTYKGLMEEGTKGQNGTLTGLSHIKDLGVTHVELLPLYCFGGVDEANPSSAYNWGYNPLYYNAPTGFYATNPSDPYNRIVECKELIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLQYIVSGSLLSMKETGLFLEPVQSINYVECHDNMTMWDKLMRSNEESEEILKKRHVLATAMAILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 6464 - protein, 396 aa, Saccharomyces cerevisiae
MTVTIKELTNHNYIDHELSATLDSTDAFEGPEKLLEIWFFPHKKSITTEKTLRNIGMDRWIEILKLVKCEVLSMKKTKELDAFLLSESSLFVFDHKLTMKTCGTTTTLFCLEKLFQIVEQELSWAFRTTQGGKYKPFKVFYSRRCFLFPCKQAAIHQNWADEVDYLNKFFDNGKSYSVGRNDKSNHWNLYVTETDRSTPKGKEYIEDDDETFEVLMTELDPECASKFVCGPEASTTALVEPNEDKGHNLGYQMTKNTRLDEIYVNSAQDSDLSFHHDAFAFTPCGYSSNMILAEKYYYTLHVTPEKGWSYASFESNIPVFDISQGKQDNLDVLLHILNVFQPREFSMTFFTKNYQNQSFQKLLSINESLPDYIKLDKIVYDLDDYHLFYMKLQKKI

SEQ ID NO: 6465 - protein, 174 aa, Clostridium perfringens
MEDKNRNILLSEEQIKEQIAIVGKKLTEDYKDKNLYVLSLLRGSFIFAADLVRAIDTKAQIGFMTTSSYGHGEESTGIVKVVNDIPDNIEGLDVLIVDDIIDSGITMDFVINHVKSLGAKSVKTCTLLDKPSRRKVDLKPDYCCFEIEDLFVVGYGLNYGDHYRNIPYIFNWEK

SEQ ID NO: 6466 - protein, 492 aa, Arabidopsis thaliana
MDHDLEIFPLLSYVLHHSDPASHAPPSLAIQQSLANRYPLLTNPYVISSLIESIPSTITQTLFVFGSLGPRPDPLAVSSARSKIREIKENDSLSPEDAAKEEQVYAAVVSLEEVHEGYEKQLRDLEEEIGRVYASAVESLSGGDEVNEEVLAVIKDAEDGGVVERIDLSDHELKLLPDALGKIVGLVSLNVSRNNLRFLPDTISGLEKLEELDLSSNRLVFLPDSIGLLLNLRILNVTGNKLTLLPESIAQCRFCAFTFVHLSFQLSLLPNSEERYVLVIRSLVELDASFNNLTSLPANFGYGLLNLERLSIQLNKIRFFPNSICEMRSLRYLDAHMNEIHGLPIAIGRLTNLEVMNLSSNFSDLIELPDTISDLANLRELDLSNNQIRVLPDSFFRLEKLEKLNLDQNPLEYPPQEMVNQSAEAVREFMRKRWEEMVEEEQLRSVIEAEKQQGGATGWLSWGSSIVTSLFSGGTHGGAAKKPKNSFLDEQL

SEQ ID NO: 6467 - protein, 491 aa, Saccharomyces cerevisiae
MAHYPPSKDQLNELIQEVNQWAITNGLSMYPPKFEENPSNASVSPVTIYPTPIPRKCFDEAVQIQPVFNELYARITQDMAQPDSYLHKTTEALALSDSEFTGKLWSLYLATLKSAQYKKQNFRLGIFRSDYLIDKKKGTEQIKQVEFNTVSVSFAGLSEKVDRLHSYLNRANKYDPKGPIYNDQNMVISDSGYLLSKALAKAVESYKSQQSSSTTSDPIVAFIVQRNERNVFDQKVLELNLLEKFGTKSVRLTFDDVNDKLFIDDKTGKLFIRDTEQEIAVVYYRTGYTTTDYTSEKDWEARLFLEKSFAIKAPDLLTQLSGSKKIQQLLTDEGVLGKYISDAEKKSSLLKTFVKIYPLDDTKLGREGKRLALSEPSKYVLKPQREGGGNNVYKENIPNFLKGIEERHWDAYILMELIEPELNENNIILRDNKSYNEPIISELGIYGCVLFNDEQVLSNEFSGSLLRSKFNTSNEGGVAAGFGCLDSIILY

SEQ ID NO: 6468 - protein, 240 aa, Cistanche tubulosa
MTIRYWNINLEEMLEAGVHFGHGIRKWNPKIAPYISAKRKGIHITNLTRTARFLFEACNLVFDAASRGKQFLIVGTKNKAADSVAWAAIKARCHFVNKKWLGGMLTNWSTTETRLHRFRDLRMEQKMGRLNRLPRRDSAVVKRQLYRLQTYLGGIKYMTRLPDIVIIVDQHEEYTALRECITLGIPTICLIDTNCDPDLADISIPANDDAISSIRLILNKLVFAICEGRFSYSSSYIKNP

SEQ ID NO: 6469 - protein, 741 aa, Francisella tularensis
MLKKIVTALGMSGMLLASSNAIAEDTTTKNDNLSPQSVDLSPLRNLNKLDSPMDKDYNYHQAFKKLDTEQLKKDMQDLLTQSQDWWPADFGNYGPFFIRLSWHDAGTYRIYDGRGGANRGQQRFSPLNSWPDNVNLDKARQLLWPIKQKYGDAVSWSDLIVLAGTVSLESMGMKPIGFAFGREDDWQGDDTNWGLSPEEIMSSNVRDGKLAPAYAATQMGLIYVNPEGPDGKPDIKGAASEIRQAFRAMGMTDKETVALIAGGHTFGKTHGAVPEDKVKQAIGPAPDKAPIEQQGLGWHNSYGTGNGDDTMGSGLEGSWTSTPTFWNHDFLHNLYNLDWKKTLSPAGAHQWTPTNAKPENMVPDAHKPGVKHKPIMFTTDLALKEDDGFNKYTQEFYNNPEEFKEEFAKAWFKLTHRDMGPKSRYIGPWIPEQNFIWQDPVPAADYKQVSTQDIAQLEQDIINSGLTNQQLIKTAWDSASTYRKTDYRGGSNGARIALAPEKDWQMNEPAKLEVVLTKLKEIQTNFNNSKTDGTKVSLADLIVLGGNVGVEQAAKQAGYNIQMPFVPGRTDATQAQTDIESFNYLKTKSDGFINYTDGSVSADKLPQTLVEKASMLDLNIPEMTVLVGGMRALDVNYDNSQEGVLTTTPGQLNNSFFVNLLDMSTQWKKSDKKDGEYIGIDRKTGKQKWTASPVDLIFGSNSELKAVAQVYAENGNEQKFVNDFAKAWHKVMMLGRFDVQQ

SEQ ID NO: 6470 - protein, 240 aa, Cistanche tubulosa
MTIRYWNINLEEMLEAGVHFGHGIRKWNPKIAPYISAKRKGIHITNLTRTARFLFEACNLVFDAASRGKQFLIVGTKNKAANLVAWAAIKARCHFVNKKWLGGMLTNWSTTETRLHRFRDLRMEQKMGRLNRLPRRDSAVVKRQLYRLQTYLGGIKYMTRLPDIVIIVDQHEEYTALRECITLGIPTICLIDTNCDPDLADISIPANDDAISSIRLILNKLVFAICEGRFSYSSSYIKNP

SEQ ID NO: 6471 - protein, 628 aa, Francisella tularensis
MCGVVGFYSFNKEEGFDSIINQSLLSIKHRGSDDSGYWCDNQVTLGHTRLSIHDITNAGHQPMLSNSGNTAIVFNGEIYNYLSIKNQLLSEYSNLKFKSNSDTEVLVNAIELWGIDKTLEKCIGMFAFGVYSRKTSCLILARDRFGEKPLYFGIQNGILGFASELKALKPLKECGWRFDIDRDALATYMRYAYVPTPYSIYKNISKLNVGSYIKFDAKGNSKEYKYWDSKKVLDSEKYKDSYDQAILDLEIKLKSTLSIQMQSDVPLGAFLSGGIDSTTVVALMQSMSKDKINTFSIGFNQKEYNEAEHARAVAKHIGTNHTDMYVTERDALDVIPKLAGIYDEPFADSSQIPTYLVSKIAKSKVTVALSGDAGDELFGGYNRYFLAPNIAKKIKFAKLLKYAPDAWIKKAEILNFGKFALLADKLLKLKRVLEKAKTNKELYVLLCSQINDTSFVLGAKEYDILRDKNIYDIPQLSFQEWMMFVDSNTYMIDDILVKVDRAAMANSLETRVPFLDHNIYEFAYSLPIDYKIQRGNGKRILKDLLYKYVPESLVNRSKMGFGIPLAKWLREDLREWADNLLDYSKIDKQGYLSPEVVQKYWQEHLSGKRNWQAILWNILIFQEWLDNE

SEQ ID NO: 6472 - protein, 305 aa, Candida albicans
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGF

SEQ ID NO: 6473 - protein, 578 aa, Kluyveromyces lactis
METKTLIHSGAAKEMSYTERYNVAPLIPLPEYLFHRLFQLNCRTVFGVANYSTAKLYQAIAVSGIHGIQTINQLNTSFAVDAYGRAIGVSCYVTSESAELGHVNGFFGSFCEYVPILQVVVLEQSHDLERLIGDVSIFHDVVDDPSEIDSCVRTLFWGKRPVYMGLRSKDATKLVPSSSLNGNIADKMGIKNTFFQTDTIKRVIDKIIAEVYASSRPLIVVDALIDRYNYNSTIQNFLTETGIPFVTTLMSKGSIDESLPNFVGTFLGTMSQPIVREYMNNADCTLILGCMIENFKNSYCRFNYKSKNQILLWNDRVKIENNIIPDILLHELLPQLIASLDTTKIVNSRPVTIPNMIPRVEPQPVTFLRQEYLWFKMSTWLKQGDVIISESGTSAIGLLQQKFPDNTRLVSQAIWNSSGYSIGACLGILAAYRDMGTLDKHRIILMVGDGSLQFTFQELSTILTHGFKPYIFVINNQGYTVDRTLNREKTHLNATYFDIQPWELLKLPSLFYSQEYFKRRCMSVGELNSLLSDKEFNKSDQLKIVELILPSMDVPVLLDPRDDSSDDESSPQHKRPRT

SEQ ID NO: 6474 - protein, 189 aa, Leptospira interrogans
MKEGASFMYSKYFIWFMTLGIFLPLAGIFAKGSFYDFKVKDIKGNEVSLSKYKGKVVMVVNVASKCGYTYQYEHLEKVYKKYKDQGFAVVGFPANNFGGQEPGTDQEIETFCRIQKGASFDMMSKISVKGKDIHPLYSYLIQNSPNPGEVEWNFEKILISKNGTIEARYRSSVEPDSSAVTQKIETLLK

SEQ ID NO: 6475 - protein, 121 aa, Carboxydothermus hydrogenoformans
MMKVALIAHDDKKDDLLAFVKTHREFFARHELFATGTTGKIISENTGLTVHRFLSGPLGGDQQIGAMVAAGEIKLVIFFRDPLTAQPHEPDITALLRVCDVHNVPIATNWSSAELFLRALN

SEQ ID NO: 6476 - protein, 166 aa, Arabidopsis thaliana
  misc_feature (124)..(124): Xaa can be any naturally occurring amino acid
NVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAXGVTVSYFEWVQNIQGFMWEEEKVNLELQKYMTRVFFFFCEIH

SEQ ID NO: 6477 - protein, 1252 aa, Streptococcus agalactiae
MKRKDLFGDKQTQYTIRKLSVGVASVATGVCIFLHSPQVFAEEVSVSPATTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGIHTYQPLKEGYVRINYLSSSGNYDHLSAWLFKDVANPSTTWPDGSNFVNQGLYGRYIDVPLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVTTRQSWEFKDQLYAYSGNLGAVLNQDGSKVEASLWSPSADSVTMIIYDKDNQNRVVATTPLVKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTTDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTNEFKVDGFRFDMMGDHDAAAIELAYKEAKAINSNMIMIGEGWRTFQGDQGKPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEDLQADYPKTQSFKESKTVEKVNRIANKTSITPVVSKKADSYLTNEANLPKTGDKSSKILSVVGISILASLLALVGLSLKRNRHLK

SEQ ID NO: 6478 - protein, 692 aa, Clostridium perfringens
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWIDQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPSKPTLDYEQIIKGINKGEIKGLWVICTNPRHSFSNNEEFKKAMKNLDFFVVQDIYEDTDSSKECDLYLPSVPAIKKEGFLINTERRLSAMVPVLEKEEDELSDYEIFLGIGEALGMGSLLDKWRTPKDAFNLLRECSKGMPCDITGVTYERLRGSKGIQWPCREGEELEADERRLFEDGKYYTPSGKAKFIFEDVTENPNATNEEFPFNLNTGRGTVGQWHTHTRTREIQAVINIVPQKAYVDINRKDAERLDIKENDEVLIHSSNGHTSKFIARLTDNLKEKDLYAPIHYIETNLLTPSVFDPYSKEPSYKTVQVNIEKVRK

SEQ ID NO: 6479 - protein, 904 aa, Nicotiana tomentosiformis
MAASVENRQFSHIEAGLSRSFKPRSDSPVRGCNFPSPNSTNFQKKPNSTIFLDYSSSEDDDDDDEKNEYLQMIKKGNSELEPSVHDSRDEGTADNWIERNFSLIRLTGKHPFNSEPPLNRLMHHGFITPVPLHYVRNHGPVPKGTWDDWTVEVTGLVKRPMKFTMDQLVNEFPSRELPVTLVCAGNRRKEQNMVKQTIGFNWGAAAVSTTVWRGVPLRALLKRYGVFSKNKGALNVCFEGADVLPGGGGSKYGTSIKKEFAMDPARDIIIAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVCTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPPTLKKSISTPFMNTASKMYSMSEVRKHSSADSAWIIVHGHIYDATRFLKDHPGGSDSILINAGTDCTEEFDAIHSDKAKKLLEEFRIGELLTTGYTSDSPGNSVHGSSSFSSFLAPIKELVPAQRSVALIPREKIPCKLIDKQSISPDVRKFRFALPSEDQVLGLPVGKHIFLCAVIDDKLCMRAYTPTSTIDEVGYFELVVKIYFKGIHPKFPNGGQMSQYLDSLQLGSFLDVKGPLGHIEYQGKGNFLVHGKQKFAKKLAMIAGGTGITPVYQVMQAILKDPEDDTEMYVVYANRTEDDILLKEELDSWAEKIPERVKVWYVVQDSIKEGWKYSLGFISEAILREHIPEPSHTTLALACGPPPMIQFAVNPNLEKMGYDIKDSLLVF

SEQ ID NO: 6480 - protein, 535 aa, Streptococcus agalactiae
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKASGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQGHQAGFTNGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 6481 - protein, 266 aa, Methanocaldococcus jannaschii
MFIMRREFPEEGDIVIGTVKDVKPYGAFVELLEYPGKEGMIHISEVTSGWVKNIRDHVKVGQRVVAKVLRVDERKGHIDLSLKRVTEQQKRAKVQEWKRFQRASKMLERAAEKLGKSLEEAWEEVGYLLEDEFGELYNAFETMVIEGKEVLDDLEISEEWKNVLYEVAKESIELTNVEVEGVIEMKSYAPDGIKQIKKALTTALKANPYEDVEVKITYIGAPKYRVVVIAPDYKSGEEVFKKVCEKAVATIKKLGGEGTYYRESKK

SEQ ID NO: 6482 - protein, 904 aa, Nicotiana sylvestris
MAASVENRQFSHLEAGLSRSFKPRSDSPVRGCNFPPPNSTNFQKKPNSTIYLDYSSSEDDDDDDEKNEYLQMIKKGNSELEPSVHDTRDEGTADNWIERNFSMIRLTGKHPFNSEPPLNRLMHHGFITPVPLHYVRNHGPVPKGTWDDWTVEVTGLVKRPMKFTMDQLVNEFPCRELPVTLVCAGNRRKEQNMVKQTIGFNWGAAAVSTTIWRGVPLRALLKRCGVFSKNKGALNVCFEGADVLPGGGGSKYGTSIKKEFAMDPARDIIVAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVSTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPQTLKKSISTPFMNTASKMYSMSEVRKHSSADSAWIIVHGHIYDATRFLKDHPGGTDSILINAGTDCTEEFDAIHSDKAKKLLEDFRIGELITTGYTSDSPGNSVHGSSSFSSFLAPIKELVPAQRSVALIPREKIPCKLIDKQSISHDVRKFRFALPSEDQVLGLPVGKHIFLCAVIDDKLCMRAYTPTSTIDEVGYFELVVKIYFKGIHPKFPNGGQMSQYLDSMPLGSFLDVKGPLGHIEYQGKGNFLVHGKQKFAKKLAMIAGGTGITPVYQVMQAILKDPEDDTEMYVVYANRTEDDILLKEELDSWAEKIPERVKVWYVVQDSIKEGWKYSIGFITEAILREHIPEPSHTTLALACGPPPMIQFAVNPNLEKMGYDIKDSLLVF

SEQ ID NO: 6483 - protein, 409 aa, Rhodobacter sphaeroides
MRDAQRPDLSTTFTVLLAGGRGSRLHELTSRECKPALPFAGPRRIVDFTLANAARSGLTRMIVATQYRPETLAHHLESRWASRFAGGSLRLREGTAVTGSPQGYGGTAAAVAANLAELQSEGVRELVVLAADHVYEMDYADMVAAHRASGASATVAVDTVPTDRASEFGVVRTSEGGRIESFLEKPAVVPADPAIPGRAQVSMGIYVFDLDWLASVLRIIPGATQDFGHDILPLAVALGEAHAYRVPGDNFYWRDVGTLDAYRLAQLEFQTGEAPCALPPRIAASEHEMKAATGELIQFAFRMQTGGIALHSPRLGGDLPGRWTMLDESVLLPGARVAPGVRLTRTIVAPGTSVPAGLVIGEDPDEDARWFRRTEEGTVLVTTPMLARRAADRGRLVAPFADSRMGRSA

SEQ ID NO: 6484 - protein, 294 aa, Zea mays
SARARVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLDSTELLVHDCDVLVPCALGGVLNKDNAPDVKAKFVIEAANHPTDPDADEILAKKGVVVLPDIYANSGGVVVSYFEWVQNIQGFMWDEEKVNDELEKYMSSAFQHLKAMCKSLDCDLRMGAFTLGVNRVARATLLRGWEA

SEQ ID NO: 6485 - protein, 289 aa, Oryza sativa
MPPPSPPLFLSLPSPPPPPPPLPHLLPSHRTAAALTLAPALSSRRVSSVCPVASQRHSDYFDPRAPPPPPPRDGYGGPAYSPPAAQGGQQNGRVFSTYSIYKGKAAMSLDPRPPQFVPLDVGRGGAAACELRDCESGAYKVVKEGFVLLQFAPAVATRQYDWTRKQVFSLSVWEMGSLLTLGPTDSCEFFHDPFKGRSDEGKVRKVLKVEPTPDGNSRFFNLSVQNRLLNIDENIYIPITKGEFAVIVSTFNYIIPHLMGWSTFTNSIKPEDSRAYTRPQSGPEYEWRR

SEQ ID NO: 6486 - protein, 392 aa, Oryza sativa
MSDKCGNCDCADKSQKKGTSYGVVIVEAEKSHLEEVAAGEVMGGLPMDQAFVQAPEHRAKPSVAEADGIPVIDLSPLFAADGVDVDALAAEVGRASQDWGFFVVVRHGVPEEVVARAAEAQRAFFALPPARRAAVARSEAAQMGYYASDHTQNVRDWKEAFDLVPTRHSLLPPPSAVVLDNKWPDDLPGFREAMEEYGEAVEELAFKLLELIARSLGLRPDRLHGFFEDHQTTFIRLNHYPPCPSPDLALGLGHHKDAGALTVLYQDAVGGLDVRRRCDGEWVRVRPIPQSFIINIGDIIQVWSNDRYESVEHRVVVNVEKERFSIPFFFYPASYTMVEPLEEVMSEESPARYNPYSWGEFFSARKNGNFKKLDVDYVQITHFRKNTPVHVQ

SEQ ID NO: 6487 - protein, 87 aa, Wolbachia endosymbiont
MVKDEKSKTLFEVEGAVTALLPAAEFRVKLDNEHEIICHVSGKVRRSKIRIIIGDRVLVEMSIYDRNAKKGRIIRRLKGTSDRTISK

SEQ ID NO: 6488 - protein, 221 aa, Gloeobacter violaceus
MGLFNKQVQMPTTAQALPGRAQRMPVSVPHHVNGRPLQPPFPQGTEQAMFGMGCFWGAERVFWQAEGVYTTAVGYAAGLTPNPTYREVCSGMTGHNEVVLVVFDPRVISYERLLQIFWENHDPTQGMRQGNDAGTQYRSGIYCSTPEQKQIAEASRAAYQQRLTAAGLGRITTEVLDAPEFYYAEDYHQQYLSKNPGGYCGLGGTGVACPVGALESRPTAP

SEQ ID NO: 6489 - protein, 1121 aa, Rubrobacter xylanophilus
MTQTARRGAARREEAYREDPLWYKDAIIYQLHVKAFFDSDNDGIGDFRGLTQRLEYIKDLGVNAIWLMPFYPSPMRDDGYDISEYKNVHPEYGTRRDFRNFVRRAHALGLKVITELVINHTSDAHPWFQRARKAPRNSVWRNFYVWSDTDKKYADARIIFTDTETSNWTWDPVAQQYYWHRFFSHQPDLNHDNPRVFDAIMRVMRFWLDAGVDGLRLDAIPYLIEREGTDCENLPETHEILRRMRAELDARYQNRIFLAEANQWPEDVLPYFGKGDECHMAFHFPLMPRIYMAVAQEDRHPIVEIMQQTPEIPEVCQWAIFLRNHDELTLEMVTDRERDYMYQTYAADPRARINLGIRRRLAPLMENDRARIELLNSLLMSMPGTPIIYYGDEIGMGDNVFLGDRNAVRTPMQWTSDRNAGFSRADPHSLYLPPIMDPVYGYEALNVEAQSRSPGSLLNWMKRIIAVRKAHKAFGRGTLEFLHPGNRKVLAYLREYGDETILCVANLSRSAQPVELDLSRFSGRVPVEMIGGSSFPPIGSLPYFLTLPGHSFYWFNLTTEAEAPSWHQESPRFFEPPVVVLPAGRQTARDIRRLPLRLQHRQVAQLEQEALPAFLSVRRWFAAKGSEIERVSLLARAEFGPDRLLALLRVGAGGAEHTYFLPLAAAWEDEDGERVSGLMPHALAKIRRRYRVGVLFDALADEGFCREVVAAMAGGRELEMGEGRVRFYATGALEELLAGEPVGELAVRRASVEQSNTSVILGERLVLKAYRRLQPGVNPELEIGRYLTEVRRFPNTPPLAGAVEYEDPRSGTVSLALLQGFVPSQGDGWSYVLGYLDRYLERRLLSASWSPEEEGPAEPPGQEGQEADEGFFMELMRTLGVRTGELHAALAAPTDDPSFSPEPAPPAEVSRWVEAVLDDLRLTLSLLERRRSGLPEEVRPEVDRLLRMEARAFDRLEAISARGIRAVKTRHHGDYHLGQVLVAGNDFQIIDFEGEPARTLEERRRKHSPLRDVAGMLRSFDYAAQTALMNLGADRAVGEDPEPVVRRWERSVREAFLGGYAEGVRGAGVLPGEGEEAAALVELFALEKALYEIRYELDNRPDWIGIPVRGVLDLLTREESP

SEQ ID NO: 6490 - protein, 663 aa, Unknown
  Rhodococcus sp. RHA1
MTETIAAGLAVPSDRDAQLYNAIAESDPAPLLMALVHATGDTGLLDEFGARLTIEEPGNHYRTGIRPTAPPGIYPEDVAEDIRIRAREILTPDVVAELGVPDDELFVRMATVCTSQRVDAEFAPILLEQAGFTKNRRHVPVTVAPPADFDVIVIGAGIVGINAGIKLGEAGFRYTIIEEREDVGGTWYRNTYPGAAVDTPSHYYSYSFELNPNWSKYYPTGPEYQNYLLDVVEKYRLREHIRFRTRVLSARWLDDEHRWEVVTEDGEGSVVRHRARAVITAMGMLNAANIPEVDGLDSFAGRVVHTAEWDSDLDLSGKRVVVLGTGCTSVQVVANIVDQVEALDVVVRSPHWLVPEKAVSGDVTEGEKWALANLPFYDRWFRLRSYWFASDNLYPLPRIDKEWAATHLSASPANDMVLRTAQEYLQTSFTDRPDLIAKLTPDFRPYAKRIVKDPGFFAALNREHVSLHRASFEKVTPEGVYTTEGAFIPADVIILATGFKLQFTTSIEIEGRDGRTLSEVWNGGDDPRAYLGVQVAGFPNLFITAGPNSAPNHGAGHNILSEEHVHYIVECLQYLLENGHDAMDVRQDVLDTYNRKVDAALDDTVWVHPGAEVNGYYRNSSGRAIVPCPWRLVDYWTMLREPNPDDLTFIGRRAEGRREASAR

SEQ ID NO: 6491 - protein, 614 aa, Prochlorococcus marinus
MFNNSKNQFTQSSNGKDVVQLPIEDGFISIRCLSPKKLRFEIEYSLGKGTTSNAFLFSKNNGSHIISPAVLVNPPGANFQEVFLPTLKTLINKTKELHIIIGHVNPNRISLLRALATEFKNIKIICSNPGGKLLKELWYQKKPSKEKLNEEKGLIIPSLPEIRLIKQEESISIFNDYELRLIPAPTARWPGGLIALEEKTGLLMSDKLFGTHICTAEWAESNRSSTEEERRHYFDCLMTPMVSQINRIIEKIELLNITSIAPGHGPAIDTSWRSLLNDYQRWGGQQSKASIKIILLFASAYGNTASIADSLAKGISSTGVQVTSLNCEFTPANELLNEIQKADAYLIGSPTLGGHAPTPIVSALGTLLAEGDRNKPVGIFGSYGWSGEALDLLENKLRNGGFEFAFDPIKIKFSPNAEVIKTLEETGTMLGRKLIKKERQEQRRLSGGINATKSDPALLALGKVVGSLSILAAQKHEEENSISSAMVASWISQASFSPPGITIAVAKDRAVEALLHKQDLFTLNILNENNYQNSLKQFLQPFLPGEDRLSGLNLLRSPGEQPILPEAIAWIEGCVKQRMECGDHWLIYAEILHGKVLDPNGVTAVHHRHTGANY

SEQ ID NO: 6492 - protein, 590 aa, Prochlorococcus marinus
MSTNSRAVIEQKITSPRLSLQCEPIASNTTAIRSLDWDRSRFDIEFGLRNGTTYNSFIIQGEKTALIDSSHVKFRSTWVDALTKCIDPKTIDFLIVSHTEPDHSGLISDILDLNNDIEIVGSKVAIQFLENQIHRPFKSTAIKTGGELDLGINPSNGIHHKLDFISAPNLHWPDTIFSFDHATSILYTCDAFGLHYCTDELFDLDPDAILPDFRYYYDCLMGPNARSVLQALKRIKNLPTIQTIAVGHGPLLRHNLDLWLNNYQEWSGQRSQGEDYAAVCYISQYGFCDRLSQAIALGINKADAQVQLVDIRASDAQELSALIGDAKAVVVPTWPNKPDAELQSSIGTLLAALKPKQWVAVYEGYGKNDEPIDVVANQLRSLGQKEAFSPLRVKQSPDANTFQQFDEAGTDLGQLLNRKKNIATIKSFDGDLMKAMGRISGGLYVVTASQGDDSNKRRGAMVASWVSQASFNPPGLTVAVAKDRAIEALMQVGDRFVLNVLEENNYQHLFRQFLKRFPPGANRFEGITVMEDVAKGGPVLGDALAYLDCFVKQRLETTDHWIIYALVEHGNISNTETKTAVHHRKVGTSY

SEQ ID NO: 6493 - protein, 715 aa, Rubrobacter xylanophilus
MSEQRSVVWPGEPYPLGATWDGEGVNFALFSENAERVELCLFDPSGRREVERIELREQTDQIWHCYLPYGRLGQLYGYRVYGPYDPENGHRFNPNKLLLDPYAKSIAGSLDWRHPHFGYRPGEDDLSFDERDNAAGALKCRVVDTAFTWGDDRPPRTPWHDTIIYELHVKGFTRLHPEIPPHLRGTYAGLASAPAIEHLKRLGVTAVELMPVHFFVDDKHLLDRGLRNYWGYNSIGFFAPDARYSATGSINEFKTMVKRLHSAGLEVILDVVYNHTAEGNHLGPTLSFRGIDNAAYYRLVPDDRRYYMDYTGTGNTLNMMHPRVLQLIMDSLRYWILEMHVDGFRFDLASALARELHDVDKLSAFFDIIRQDPVISQVKLIAEPWDVGEGGYQVGNFPVGWTEWNGKYRDAVRSYWKGDGGLVDELAYRLTGSSDLYERDGRRPYASINFVTAHDGFTLQDLVSYNEKHNEANGEDNRDGHDDNRSWNCGVEGPTGDRGIRRLRARQKRNLMATLLLSQGVPMILHGDEMGRTQNGNNNAYCQDNETSWVSWNLAPADRNFLAFVRRMIRLRREHPIFRRRSFFQGRRLRGAGVKDITWLTPDGDEMTDEEWASSFARSLGLQMSGILEGEVDAQGRQIQDDDFLLLLNAHHEDLSFVLPPVPEDARWEAVVDTAHAAGLKPAGFYKPGDAYPLKARSMAVLANARREAPEEEEE

SEQ ID NO: 6494 - protein, 160 aa, Klebsiella aerogenes
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGP

SEQ ID NO: 6495 - protein, 434 aa, Oryza sativa
MLMRPVWWVLGLITADKNATRIHYLPNPETPPPPPPPAARRSPTMAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSK

SEQ ID NO: 6496 - protein, 546 aa, Solanum lycopersicum
MGSGCSSPSISLTTIATSHFQSQESLSNSLNFYSPTRFLEPHLLKSSKIFIPKSPLKCAKVPEMQTQLEDSAKPIVDPHDIDSKLVQKLANDALVWCPLRGLLVGDRNSERSGTIPGVDMVHAPVALIPMSFPESHWKQACEVAPIFNELVDRVSQDGEFLQQSLSRTRKADPFTSRLLEIHSKMLEINKLEEIRLGLHRSDYMLDEQTKLLLQIELNTISSSFPGLSCLVSELHRSLLQQYREDIASDPNRIPANNAVNQFAEALAKAWNEYGDPRAVIIFVVQAEERNMYDQHWLSASLRERHQVTTIRKTLAEIDALGELQQDGTLVVDGQAVAVIYFRAGYAPSDYHSESEWKARLLMEQSRAVKCPSISYHLAGSKKIQQELAKPNVLERFLENKDDIAKLRKCFAGLWSLDESDIVKDAIERPELYVMKPQREGGGNNIYGEDVRGALLKLQKEGTGSDAAYILMQRIFPKISHSILMREGISHKEETISELGIYGTYLRNKTEVLINQQAGYLMRTKVSSSDEGGVAAGFAVLDSIYLV

SEQ ID NO: 6497 - protein, 186 aa, Arabidopsis thaliana
  misc_feature (104)..(104): Xaa can be any naturally occurring amino acid
  misc_feature (151)..(151): Xaa can be any naturally occurring amino acid
  misc_feature (155)..(155): Xaa can be any naturally occurring amino acid
  misc_feature (157)..(157): Xaa can be any naturally occurring amino acid
  misc_feature (165)..(165): Xaa can be any naturally occurring amino acid
  misc_feature (170)..(171): Xaa can be any naturally occurring amino acid
  misc_feature (176)..(176): Xaa can be any naturally occurring amino acid
  misc_feature (180)..(180): Xaa can be any naturally occurring amino acid
  misc_feature (182)..(182): Xaa can be any naturally occurring amino acid
DAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEXNGFLDDLIYVLQTKGVTLYGGPRASAKLNIPETKSFHQEYSSKACTXEIVXDXYGAIDHIXQHGSXXTDCIXTEDXEXAEIF

SEQ ID NO: 6498 - protein, 378 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 6499 - protein, 259 aa, Arabidopsis thaliana
MELLSSSPAQLLRPNLSSRALLPPRTSIASSHPPPPRFLVMNSQSQHRPSISCASPPPGDNARIGEVKRETKETNVSVKINLDGHGVSDSSTGIPFLDHMLDQLASHGLFDVHVRATGDTHIDDHHTNEDVALAIGTALLKALGERKGINRFGDFTAPLDEALIHVSLDLSGRPYLGYNLEIPTQRVGTYDTQLVEHFFQSLVNTSGMTLHIRQLAGKNSHHIIEATFKAFARALRQATESDPRRGGTIPSSKGVLSRS

SEQ ID NO: 6500 - protein, 319 aa, Oceanicola granulosus
MIAVAGGGAFGTALAAALAANGPVTLWMRDAEEAARNEQTRENRHRLAGVPIPAPVRVSADLETVFAAEIVLLAIPAQQLRPFLAQHGARLAGKPLVACSKGIDVETGEGPSAIIEAAVPDATAAVLTGPSFAADIARSLPTALTLACRNSAAAVALQDRLSTPVLRLYRTADVTGAELGGALKNVMAIACGTCIGAGFGESARAALITRGFAEMQRLAVGMGAEAETLAGLSGFGDLTLTCTSDQSRNYRHGLAIGRGERGDTGSTVEGVATARAIGRIARVRGLDLPVCAVVEALVEETITAQDALARLLSRPLKEE

SEQ ID NO: 6501 - protein, 218 aa, Glycine max
FSIERSCTPPASMEVSQQKHYKEEHSQGVVHPRNGSHGSVPAQHAYPYYISGVVNHVMMPSSAQLYQKNIQDLQIHAGSSMIAQYNHLPQCPPHANGMTNFPYYPMNICLQPGQISTNSWPSLGSSSSCEVQISKVDRREAALMKFRQKRKERCFDKKIRYVNRKRLAERRPRVRGQFVRKLNGINVDLNGQPASTDYDEDDEEEDNHRARDSSPEVA

SEQ ID NO: 6502 - protein, 563 aa, Salmonella enterica
MMPLSIIKNIANRERMEIFFTILIMTLVVSLSGVFTRVLPFQLPLPLMQIAVGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSCWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 6503 - protein, 107 aa, Oryza sativa
VDGSSYLGQPLPFSISTLIWIEVLVIGYIEFQRNAELDPEKRLYPGGSYFDPLGLASDPEKKERLQLAEIKHARLAMVAFLGFAVQAATHLSDPLHTTIFDTFSSSS

SEQ ID NO: 6504 - protein, 549 aa, Rhodococcus rhodochrous
MNGQHPRSVVTAPDATTGTTSYDVVVVGAGIAGLYAIHRFRSQGLTVRAFEAASGVGGVWYWNRYPGARCDVESIDYSYSFSPELEQEWNWSEKYATQPEILAYLEHVADRFDLRRDIRFDTRVTSAVLDEEGLRWTVRTDRGDEVSARFLVVAAGPLSNANTPAFDGLDRFTGDIVHTARWPHDGVDFTGKRVGVIGTGSSGIQSIPIIAEQAEQLFVFQRSANYSIPAGNVPLDDATRAEQKANYAERRRLSRESGGGSPHRPHPKSALEVSEEERRAVYEERWKLGGVLFSKAFPDQLTDPAANDTARAFWEEKIRAVVDDPAVAELLTPKDHAIGAKRIVTDSGYYETYNRDNVELVDLRSTPIVGMDETGIVTTGAHYDLDMIVLATGFDAMTGSLDKLEIVGRGGRTLKETWAAGPRTYLGLGIDGFPNFFNLTGPGSPSVLANMVLHSELHVDWVADAIAYLDARGAAGIEGTPEAVADWVEECRNRAEASLLNSANSWYLGANIPGRPRVFMPFLGGFGVYREIITEVAESGYKGFAILEG

SEQ ID NO: 6505 - protein, 145 aa, Triticum aestivum
  misc_feature (128)..(128): Xaa can be any naturally occurring amino acid
MDTHIGSVDGPSPAAVNGAVGCPASAPGCPIMSSHPVVSPGEASLGRHLARRLVQVGVSDVFAVPGDFNLTLLDHLVDEPGLRLVGCCNELNAGYAADGYARARGVGACAGTFTGGGLSGLNAIAGAXRENWPGICLAGGAKSQD

SEQ ID NO: 6506 - protein, 242 aa, Saccharomyces cerevisiae
MQKHNIKLNQNQDISQLFHDEVPLFDNSITSKDKEVIETLSEIYSIVITLDHVEKAYLKDSIDDTQYTNTVDKLLKQFKVYLNSQNKEEINKHFQSIEAFCDTYNITASNAITRLERGIPITAEHAISTTTSAPSGDNKQSSSSDKKFNAKYVAEATGNFITVMDALKLNYNAKDQLHPLLAELLISINRVTRDDFENRSKLIDWIVRINKLSIGDTLTETQIRELLFDLELAYKSFYALLD

SEQ ID NO: 6507 - protein, 857 aa, Coccidioides immitis
MRGRWSFVCFDIDFSVLNVLILLFLLPLLVAENGDFQGRRHQPQPGGDVWSMDHGYAASCPVRDFVDVQAEYVRYPVCLGSRRASSSAPDGMTESASVATERTSEAPTASSAETVSTPKVESELDTESPLDNEKFLSFEEWKKKNLAKIGQSVDNVRGNRQAVGSTEMRKRSRPGEISNALDSLGEEGEIELGFGGFGPGDSDIPPVETKDAKSTSSSVNGEKHVTKGTEGESQSDGVPRRGIARRKDAGVTCKERFNYASFDCAATVLKTNRECTGSSSILIENKDSYMLNECRAKDKFIILELCDDILVDTVVLANYEFFSSIFRTFRVSVADRYPAKPDKWKELGTYEAANTREIQAFAVENPLIWARYLKIEFFSHYGNEFYCPLSLVRVHGTTMMEEYKNYGDSARAEEEAVEAVVQAQQNPGSVPTMKNSNQTQSEIRDQNVNISITQTGSGTLPDEEALGASCFPQINEIERLLLGMSSDNMSSIYDMALDPDYQSEAHESAESETWASNATGSTSLEDTSVSDTPPTMVGGSDHQRATPGSRMVSTSGSSRSENETTADNQRTPVVSQPPPPNPATQESFFKSVHKRLQMLETNSTLSLLYIEEQSRILRDAFNKVEKRQLAKTSSFLENLNSTVLHELREFRQQYDHIWHSVVIEFEQQRQQYHHELFAVTSQLAILADEVVFQKRVSIIQSVFVLLSFGLVLFSRSAVGSYLEFPKMQSMVSRSHSFRSASPPYETPSPSPNSPMQSPPYQEGSLHRRNPSDGQTDCEICNHTFPYSPPPSSDTLSPSEEEEKGLHDVHLEYSRSTASNLVPEENPAGIKRQRSSPADLCGHDEGDSAEFKLPQAPS

SEQ ID NO: 6508 - protein, 121 aa, Prochlorococcus marinus
MNKSHKIIVHNKQINRTISIEVPHGEYILRYFESQGEDLPFSCRNGCCTTCAVKVLSGDLDQSLGIGLSKEMQDKGYALLCIAKAIGPLEVETQDEDEVYEKQFGKFLSDMGTKAGNPFDI

SEQ ID NO: 6509 - protein, 187 aa, Bifidobacterium longum
MRIADVEEDIDHELVSKEQIDAKIHEMAALASEDYRDKNPLLVAVLKGAVNTLVAFTEAMSIPVQIDFMSLSSYGSGTVSSGEVTVRQDLSADVRGRHILIVEDIVDSGRTLAWLVAELKRRGAASVEVFALLSKPSRREVDVDVKYAGYEIPDEFVVGFGLDFDERYRNLDSIAVLKPSVYQGVQA

SEQ ID NO: 6510 - protein, 233 aa, Unknown
  Synechocystis sp. PCC 6803
MSDNLTELSQQLHDASEKKQLTAIAALAEMGEGGQGILLDYLAKNVPLEKPVLAVGNVYQTLRNLEQETITTQLQRNYPTGIFPLQSAQGIDYLPLQEALGSQDFETADEITRDKLCELAGPGASQRQWLYFTEVEKFPALDLHTINALWWLHSNGNFGFSVQRRLWLASGKEFTKLWPKIGWKSGNVWTRWPKGFTWDLSAPQGHLPLLNQLRGVRVAESLYRHPVWSQYGW

SEQ ID NO: 6511 - protein, 364 aa, Aquifex aeolicus
MSQAVKDYYEILGVNRDATKEEIKKAYRKLVRIYHPDINPDPSAQEKFKEINEAYHVLIDDERRSEYDAILSRNDVGKFRDFLEYIQEFVESIIQGEKGKKRRPRKGQDIKMKLPLTLEEAGLGCEKEIIYSRWMDCPVCEGMGVKGEAETVVCHACNGEGRRVSGIFNFPRPCSVCKGKGFIVKNPCPTCYGRGRVSAQHKIKVHIPPGTEEGEVLKVPEKGHLGYFGGKPGDLYLKVVLKEHPIFKKVGKDLHMEKVVSFPLAVLGGTVKVPTLEGEEIDVFIQPGTECGATKVVKEKGYPYENGRGDLIIHIRIGVPKNLSKSERKLLEKLAESIKEEGEEVYREGGSLVEKLSSLFKKNA

SEQ ID NO: 6512 - protein, 333 aa, Cryptomeria japonica
MENAEVKTPEKDAEAEGSPEIVSVELPAPPGWKKQFFPKKWGIVFTAPTGEEIKNKRQLSQYLKSHPGGPANSVFDWGTGDTPRRSTRLSEKPKTTETPESDSKKTPKRSRKSEGTSDERKGKKKKMAEDPSEVEADKDEEMKDADDVEDSVKEKADTAEEADDKKTEDGKEEEPDNKPEEEQENGKEKQEAESEVKVDPSKAEEIKEVAVDKVEDVPVVENEVNVDEEMRNDQVGEKKMEEKKEETKLEETPIVVPEISPIAVPEISPIVVPDEPLDTKEGSTENSKHEEPAKQTEAPNESNIKHTSQETAQQFEINSLHCEQTPAPPSVSC

SEQ ID NO: 6513 - protein, 451 aa, Zea mays
MAERLAASLLPAASPSPSARRATVAAAAAASFPSPCSARAGLRLRSRPPLFSQKAAGRGCGLRVVRCMAASDAAQLKAAREDIKELLKSTYCHPIMVRLGWHDSGTYDKDIKDWPQRGGANGSLRFDAELSHGANAGLINALKLIQPIKDKYPGITYADLFQLASATAIEEAGGPKLPMKYGRVDVTAAEQCPPEGRLPDAGPRDPAEHLREVFYRMGLDDKEIVALSGAHTLGRARPDRSGWGKLETKYTKDGPGEPGGQSWTVEWLKFDNSYFKDMKFLSQLPWKEQKEQDLLVLPTDAALFEDPSFKVYAEKYADDQEAFFKDYGEAHAKLSDLGAKFDPPEGFSLDDDTSSSPSDEKTEEPTLVAVGAAVATATADDNNGAAPQPEPFVAAKYSYGKRELSDAMKQKIRAEYEGFGGSPDKPMQSNYFLNIMILIAGLAFLTSLLGN

SEQ ID NO: 6514 - protein, 327 aa, Chlamydomonas reinhardtii
MQSARVSRTARHTRPSCRPQRAVAVRVSAKVNVEQLKALKAELYNYINSRGCNPISVRLGWHDSGTYDKNIAEFPARGGANGSIRFKPEIDHGANKGLAIALAILNPIKKKYPDVSYADLFQMASATAIEASGGPKIPMRYGRKDAKGPEECSPDGRLPGAAHPFADGSGSPAEHLRRVFYRMGLNDQDIVVLSGGHTLGRARPERSGFGAEKTKYTDVGPGTSTASPSGATDRPVTPKPVGQQGTSWTVNWLEFDNSYFKEIKAKRDSDLLVLPTDACIFEDDQFRPYAEKYAADQAAFFADYCVSHQKLSELGVEWEEGAPVTLD

SEQ ID NO: 6515 - protein, 544 aa, Zea mays
MGNQCPNGTLGSDYYNRPASRFADGCLEDDRYSDLKKFDKPWPEVNSFKPTAVGILKRGLDPTSITVLERKTADVREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAADLIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATDQALDPGVLSRLKQFSAMNKLKKLALRVIAERLSEEEIAGLRQMFKAVDVQNRGVITFGELRQGLKRYGSELENREISDIMEVADNDNNVTINYEEFIAATVPLNKIEREEHLMAAFTYFDKDGSGYITVDKLQRACGEHDMDDTFLEEIILEVDQNNDGQIDYAEFVAMMQGSKAGLGWQQMETTLNVTLRDAPQVHCH

SEQ ID NO: 6516 - protein, 271 aa, Rubrobacter xylanophilus
MEAGNTKTALVTGSTDGLGRGVARELARRGYAVILHGRSEARCEEAAAELPGGAAGYLVADLSSLGEVRKMAREVLAGRERLDLLVNNAGVISRERRESREGFELTFAVNYLSHFLLTLLLLPLLRRSAPARVVNVASAAQSPIDFEDPMMERSYSPMEAYARSKLAQVMFSFALAGRLSGTGVCVNALHPASLMDTKMVRESFGRPMSSVEEGVRAVVRLAASSELEGVSGRYFEGTREARAHPQAYDPAARERLWELSEGLCGALDAGR

SEQ ID NO: 6517 - protein, 167 aa, Citrus sinensis
MASQSKTSVHDFTVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 6518 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDAIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDGLKAHAAKHVTEKMMLNAGNIYPHNTPKTKEAYYYRMIFERFFPQNSARLTVPGGASVACSTAKAVEWDAAWSNNLDPSGRAALGVHISAYENQNNKGVEIEKIIPMDAAPLGVAIQG

SEQ ID NO: 6519 - protein, 264 aa, Aquilegia formosa
RPKVAYNNFSNDVPVISVAGIDDEEKRSEICKKIVNACEDWGIFQVVDHGVDTSLITEMSRLAKEFFALPPEDKLRFDMSGGKKGGFIVSSHLQGEAVQDWREIVTYFSYPVQNRDYSRWPDKPEGWKTVTQTYSEKLMELACKLLQVLSEAMDLDKDALTKACVDMDQKVVVNFYPKCPQPDLTLGLKRHTDPGTITLLLQDQVGGLQATRDDGKTWITVQPIEGAFVVNLGDHGHYLSNGRFKNADHQAVVNSSYSRLSIAT

SEQ ID NO: 6520 - protein, 411 aa, Magnetospirillum magnetotacticum
MMPEAKYLLVGSSHAALEALRAIRLVDPDGSMAMLTRDERLPYSPTILPYVVSGRSGSDKVLLRDPAFFAANNCAYVPNARAVSLDPKAKAVTLESGEVWRYQSLLVASGAAPAIPPVKGLDGVKYHVLRSLADAEGLRAAMGSAKSAVVLGAGLVGLHAAENLAEAGLAVTVVEMQDHVLPGYFDAKASTRIEEAFAKHGVDLKLGHRVTEASAGKLTLSDGTTIAADLLLVATGVRPVTDWLEGSGVLVDKGVVVDEAMRTNLDGVWAAGDVAQATDFATGGKALIGIIPTAVEQGKIAGQGMAGDSYRKDYAGGLPVNTYRFFGRVALSIGRAAATEGVEAVESEAGAYRRVVMEGNRLVGYASVDEPFDVGIMGELIRRRIDLTECKDAFLAHPVETGRRLMSEQWR

SEQ ID NO: 6521 - protein, 530 aa, Brassica juncea
MVGGCSSLSYSSSSTFIATTTLSSSLKLNPQSFIFHLNLRKRPPLRCLSSLTMESPKPILDFEKFDDGFVQKLVYDALVWSSLHGLVVGDKTHQRSGTVPGVGMMHAPIALLPTPFPESYWNQACEVAPIFNELVDRISLDGKFIQDSLSRTRKADVFTSRLLEIHSKMLESNKREEIRLGLHRSDYMLDEETKSLLQIEMNTISCSFPGFGRLVTELHQSLLRSHGDHLGLDSKRVPRNGSTSQFADAMAKAWLEYNNPRAVVMVVVQPDERNMYDQHWLSSVLREKHNIVTIRKSLAEVETEGRVHEDGTLTVGGQAVSVVYYRSGYTPRDYPSESEWNARLLIEQSSAVKCPSIAYHLAGTKKIQQELAKPGVLERFMDNKDDIAKLRKCFAGLWSLDDPEIIKKAIEKPELFVMKPQREGGGNNIYGDDVRENLLRLQREGEEENAAYILMQRIFPKVSNVFLLRDGVYHKDQAISELGVYGAYLRNKERVIINEHSGYLMRTKVSSSDEGGVAAGYAVLDSIYLN

SEQ ID NO: 6522 - protein, 171 aa, Spinacia oleracea
MASDSSAQPKSVHEFVVRDARGNDVDLSIYKGKVLLIVNVASQCGLTNSNYTEMTELYEKYRELGLEILAFPCNQFGNQEPGSNEEVLEFACTRFKAEYPIFDKVDVNGSNAAPIYKFLKSSKGGLFGDGLKWNFTKFLVDKDGNVVDRYAPTTSPKSIEKDVKKLLGIQK

SEQ ID NO: 6523 - protein, 394 aa, Crocosphaera watsonii
MQDEITIIGAGIGGLTLAAALEKKHIPFQLYEQANSFEALGYGIQVSPNIVRVLWALGLEKELENISHRCLGFELRSFNSDNILAKWQIDNKIPYYQCRRADLHQLLFDSIEDKNRIHFSQRLESFQQKDHKISLHWQNSQPTTTTALVAADGVRSQVRRSLFPGNKAQYAGYAAYRAILPFKDKYRPLWGKATVWMGENHHVVVYPNGNQENSTPWLNLVLVVKDANWNEQGWSIPADKQAVAQDFVNQSEELKEILEDMIASPEPCFKWGLFIHQPLPYWSQGKVTLLGDAAHPMLPFQAQGAAMAIEDAYVLAEYLGKEKEIEKAFIKYQQTRLKRATKVQQVSRNNADIFHASGVKALIRNFGLGLVSATVPNLLNQKTAWIYDYDILSN

SEQ ID NO: 6524 - protein, 195 aa, Rhodobacter sphaeroides
MRKAEISRKTAETDISVTVDLDGTGRYDIRTGVGFFDHMMDQLARHALIDITLRCEGDLHIDDHHTVEDCGIALGQALTRALGDKRGIRRYGSFHLAMDDALVRAALDLSGRPFLVWNLPFPTEKIGSFDTELVREFFQALATHGGITLHVDLIHGVNSHHIAEAAFKAVARSLREAVEPDPRRADAIPSTKGML

SEQ ID NO: 6525 - protein, 497 aa, Erwinia carotovora
MTTHVVTHHAVTHVVWLRNDLRITDNLALYAACQDPSATVLAVFIATPAQWEKHDMAPRQAAFLLENLTLVQHVLAEKGIPLHYHECADFAASVDWLMQFCAEQQATDLFYNHQYEINERLRDKQVKDRLADSVVCHGYHDSLLLPPGSVLTGNGEMYKVFTPFRQAFIKRLLEADTTCVPAPDARGEPINNTAELVPFSYPQCEVDSEDFPCGERAALQQLRRFCREQVQDYDQQRDFPALPGTSKLSPYLALGIVSPRQCFNRLRAECPDMLERREGGAFTWFNELVWREFYRHLIVSWPQLCKHRPFTAWTQWVKWRESPEDLTAWQQGKTGYPIVDAAMHQLNETGWMHNRLRMICASFLVKDLLIDWREGERYFMSQLLDGDLAANNGGWQWAASTGTDAAPYFRIFNPTTQGERFDPDGRFIRHWLPELAAVPDKDIHQPHRWADKQHVKLNYPLPIVDHKTARLDTLAAFEAAKNIGMANNDREEKSKYA

SEQ ID NO: 6526 - protein, 388 aa, Shigella flexneri
MKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLVLKIFLMALAIIDDLGAIIIIALFYTNDLSMASLGVAAVAIAVLAVLNLCGVRRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 6527 - protein, 134 aa, Triticum aestivum
PFPGNPAQLSAQEQLMYEQSQEYQLQLQQQCQRQLQQFWAEQRSEIEQATDIKNHPLPPTRIRKIMKADEDVRMISAEAPALFAKACEMFTLEMTMRSWMVAKEDKRRILQRSDIAAAVARTGIYDFLLDLFTS

SEQ ID NO: 6528 - protein, 168 aa, Nicotiana benthamiana
ANGKNYLHKRNPPIVHRDLKSPNLVVDKKCTVKVCDFGLSHFKANTFLSSKTAAGTPEWMAPEVLRDEPSNEKSDVYSFGVILWELATLQQPWSDLNAPQVVAASGFRGKRLDIPSGLNPQVATIIEACWANEPWKRPSFSTIMDMLRPNLKSPLTPQSGHTDMQLLS

SEQ ID NO: 6529 - protein, 156 aa, Francisella tularensis
MSIYDFKLTANDGSEYHLPKNKVLLIVNVASKCGFTKQYRGLQHLHKIYPDLEIVAFPCNSFGGQEPGSDEEIKNFCETNYNVTFPIMKKTKVNGKDAEPLFEYLKERAKGVLGTEAIKWNFTKFLVSKDGETIVRYAPKTIPEDLIPDIDNFLKD

SEQ ID NO: 6530 - protein, 478 aa, Salmonella enterica
MARKTLRARRFFSLIFPFFFITSVYAEQTPVSAKTVTVEAKNETFAPQHPDQYQSWKATSEQSAREDALAEDPRLVILWAGYPFSRDYNKPRGHAYAVTDVRETLRTGAPKTAEDGPLPMACWSCKSPDVALLIQQEGEDGYFHGKWARGGPEIVNDLGCADCHNTASDDFAQGKPALTLSRPYAERAMEAISKPFDKAGRFDQQSMVCGQCHVEYYFDGKNKAVKFPWDEGMKVENMEQYYDAIAFSDWTNSLSKTPMLKAQHPEYETWSAGIHGKNNVTCIDCHMPKVQNAEGKLYTDHKIGNPFDNFAQTCANCHTQDKASLQKVVAERKQAIHDLKIKVEDQLVHAHFEAKAAWDAGATDAEMKPILNDIRHAQWRWDLAIASHGIHMHAPEEGLRMLGSAMDKAADARTKLARLLATKGITHEIPLPDISTKEKAQKAIGLNMQQINAEKQDFLKTVVPQWEDQARKNSLLSQ

SEQ ID NO: 6531 - protein, 320 aa, Salmonella enterica
MIKKIGVLTSGGDAPGMNAAIRGVVRAALTEGLEVMGIYDGYLGLYEDRMVQLDRYSVSDMINRGGTFLGSARFPEFRDENIRAVAIENLKKRGIDALVVIGGDGSYMGAKRLTEMGFPCIGLPGTIDNDIKGTDYTIGYFTALGTVVEAIDRLRDTSSSHQRISIVEVMGRYCGDLTLAAAIAGGCEFIVVPEVEFNREDLVAEIKAGIAKGKKHAIVAITEHMCDVDELAHFIEKETGRETRATVLGHIQRGGSPVPYDRILASRMGAYAIDLLLEGHGGRCVGIQNEQLVHHDIIDAIENMKRPFKSDWMECAKKLY

SEQ ID NO: 6532 - protein, 170 aa, Gossypium hirsutum
MASQSSKPQSIYDFTVKDAKGNDVDLSIYKGKVLIIVNVASQCGLTNSNYTDLTEIYKKYKDQGLEILAFPCNQFGGQEPGSIEESIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 6533 - protein, 315 aa, Clostridium tetani
MNKEEKILDLVIIGSGPAGLTAAIYASRMKLDFIVLENELVGGQIRSTYSIENYPGFRSISGEELVNKIYDHAVDLGAKIDEFDEIQYIKLTEEEKLIETYEYIYKPKAVIIAAGAKYRPLPIPEEKKYHGNGIHHCELCDGEFYQNKSIMVVGGGNSALEGAIFLSRYAKNITMVHQLDYFQGEKSLQDEVFNNSKIKILWNTDIKNAFGENKLEEVLVEDLKTKEQYKINVDGIFVYIGMVPNTDLYKDYINLNERGYIIADESTKTNIEGVFAAGDVRAKQFRQLVTANADGAVAALSAEKYISKKRRENND

SEQ ID NO: 6534 - protein, 312 aa, Vitis vinifera
MAATRKDADRIKGPWSPEEDDALQKLVQKHGPRNWSLISKSIPGRSGKSCRLRWCNQLSPQVEHRAFTSEEDDTIMRAHARFGNKWATIARLLSGRTDNAIKNHWNSTLKRKCSAITEDGSFGGDYPPHPLKRSVSAGAAAPVSGLYLSPSSPCGSDVSDSSLPVVSSSHVYRPVARTGGIIPPETTSSSNDPPTSLSLSLPGVDSCEVSNRAPEPNHAPPANPIQMIPTMAPLQQIPMHQHNQPATVPATVLSQGEKPFIPFSAELLAVMQEMIRKEVRNYTAGLEQNGVCLQADGIRNAAVKRIGISKIE

SEQ ID NO: 6535 - protein, 317 aa, Oryza sativa
MAYDAGYECVRSHDQIVSGIDWSRSSNKIVTVSHDRNSYVWTQEGHDWVPTLVILKLNRAALCVQWSPKENKFAVGSGAKSVCICYYEQDNNWWISKVVRKKHESSVTSVAWHPNNILLATTSTDGKCRVLSTFIKGVDTRGSHASTSTDWKFGEQIAQLDLSSMWAFGVRWSPSGKTLAYAGHNSMIYFIDDVETSPAAQNLALRDLPLRDILFLSERTVIGVGFDCNPMIFSADETGLWSFVRYLDERKVTTSTSRASQLSEAFGKLYGQSKQVASSDTVEPSKPRGGVHENCITYYPLLPFCSSKADSYQLHID

SEQ ID NO: 6536 - protein, 148 aa, Glycine max
MAPKAEKKPAEKKPAEEKKSTVGDKAPAEKKPKAGKKLPKEGGAGGEGKKKKRNKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 6537 - protein, 148 aa, Bacillus cereus
MGYIEDMRNLVGNHPLILIGSHAIILNEKDEVLLQLRTDFNRWGIIGGALEYNETLEDALKREVFEETGLIIKNPELFRTYSGPDFFQIYPNGDQVHGVLVVYICREFHGELVCDHTESKELRFFSLDELPNNLPPVIEKIITDYLKK

SEQ ID NO: 6538 - protein, 213 aa, Ostreococcus tauri
MTTRLIRGTLSAACVCCGTVGGAVVGAIAGAASSRGVVRGAVCGAYAGALTLLETMDLEGDYEGSSEGEVGREANAETGGEWYAVREDASDGSMRIVAMPFTHAMNFTQVLRMLANGEADRGASAVKVAELPSRTFRRSEGGVDAIDGMCAVCLDVFLDGEMVKTLPSCAHEFHEACIDRWLLRRDCCPICRRRASIDVDREQNVDGDSDSSA

SEQ ID NO: 6539 - protein, 331 aa, Unknown
  marine gamma proteobacterium HTCC2080
MSLAQLPTPLEFLPRASTAWGCGKRLWIKRDDLTGSTLTGNKVRKLEFIAGFAETHGFNTLITCGGLQSNHARATANVCAKLGWHCELVLRGRDPVGEGNTLLDQLFGAQVTAVEPRRYTEHLDSLLEQRAEHHRSQGRHPLIIPTGGSNGLGIWGYVSGAEELVADMAAADITNATIVTATGSGGTQAGLTLGMALFQPDCSVWGFAVCDDEQYFTDKVSADICEAQGMWSALACENIQINTNDAHVGPGYGRATEPVYERIAALASLEGIILDPVYTGKAFHGLCEELAQGAFPEATDIIFVHTGGIYGIFPHGQQLAAAASHPASWVN

SEQ ID NO: 6540 - protein, 632 aa, Kluyveromyces lactis
MERLVFEDVQQQLRQSSTDLSRWKLFQSSKWSAEALMGMRPTDSEDSLSADMSLATDGDDESPLKKRQILSSRCVLLDFCDNENQSETLPDVIPLMGKELDLYLLASSMFDCKEYDRCAFFLKDTSHDGLEFLYLYSRYLLWDKKVTESTEDVMIKDPEIFSADLSESLQAAEYGNDAEGKCRSGISLSNRDVDVGNGEKINLPKLHHEITDFLEKNKSLSKLGTALLMYLLGIIQKKQGVPSGAMSYFLKSLKLYPYNWTCWCELLSCISRTDESILLLKYLNDNFSIVKENGIIHEHLMLRFFKLAVFKEFGGDFDKYIEELGEIMKVFPNFSFLRAQHALINYKYMDYANAEIVFDELVTMDPYRLDDLDTYSNVLYVLQKPYKLAYLAQYAANVDIYRPETCCIIANYFSSKQQHEKSILYFRRALMLDKSYTHAWILMGHEFIEMKNSHAAIECYRRASDVNPRDFQAWYGLGQAYEVLDKHSFALYYFQKACALKPLDKRMWFASASCYEKLDKTVQAIKCFQRSSQLSGEQDISILYRLAKLHEKNNDVSSCKHYMAKCVELDEVKKAQQIDEIGKAKLWLAKHEFKHRNYSDAYNYANGVIHGTSQEIEEARAILAECRKRIDI

SEQ ID NO: 6541 - protein, 880 aa, Ostreococcus tauri
  misc_feature (880)..(880): Xaa can be any naturally occurring amino acid
MLARARGGANAMSARNVSAASLKPLDTFERRHNSGTEEEVAEMCKVVGFENIDALIDATVPTNIRLPKLMDMGKYTEPLTESEFLAKMKDIAGKNKVYKTYIGAGYHGTHVPPVILRNILENPGWYTQYTPYQAEASQGRLESLMNFQTMITDLTGMPLSNSSLLDEGTAAAEAMTMCSALNRGKKPKFYVSDKCHPQTISVVKTRAEGLGLEAIVGDENSFDYTAKDVCGVLVQYPATNGAVIDYKPIVAKAHASGIRVVAAADLLSLTVLQPPGEWGADIVVGSSQRFGVPMGFGGPHAAFLATNHDDKRLMPGRIIGESIDSEGNPALRMAMQTREQHIRRDKATSNICTAQALLANMAAMYGVYHGPQGLKDIATRAHNFAGVFAAGAEKLGFKNVTPEFFDTITLKCPSGADAVVKACESAGINIRKMDADHVSLAFDEVTTIQDVDDLFKAFAGGATAPTVEQIAPSVNTSIPMERTSSYMTHPIFNQYHSEHEMVRYLKRLEEKDLSLVHSMIALGSCTMKLNATSEMIPITWPELANIHPFAPKDQSLGYQEMFRDLEMQLCEITGFDAMSLQPNSGASGEYAGLMAIRAYHQSRGDDHRDVCIIPVSAHGTNPASAAMCGMKIVVIGTDSKGNINVEELKAAAEKHSANLAALMVTYPSTHGVYEDSIKEVCDTIHKHGGQVYMDGANMNAQVGLTSPGFIGADVCHLNLHKTFCIPHGGGGPGMGPIGVKAHLAPFMPDHPTMKDGAIAVGGDKPFGTVSAAPYGSALILPISYAYISMMGSEGLTNASKRAILNANYMSKRLEDYYPVLFTGKNNTCAHEFILDMRPIKDATGVEVADIAKRLMDYGFHSPTMSWPVAGTLMIEPTESX

SEQ ID NO: 6542 - protein, 135 aa, Haemophilus influenzae
MQILHTMLRVGDLDRSIKFYQDVLGMRLLRTSENPEYKYTLAFLGYENGESAAEIELTYNWGVDKYEHGTAYGHIAIGVDDIYATCEAVRTSGGNVTREAGPVKGGSTVIAFVEDPDGYKIEFIENKSTKSGLGD

SEQ ID NO: 6543 - protein, 466 aa, Escherichia coli
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 6544 - protein, 226 aa, Glycine max
MVDFPEGLRRLAALLLKCCDLDIPNRPKGLEDPERLARETVFSVNEIEALYELFKKISSAVVDDGVINKEEFQLALFKTNRKDSMFADRVFDLFDTKHNGILEFEEFVRALSVFHPNAPVDDKIDFAFKLYDLKQQGFIEKQEVKQMVVATLAESGMNLSDEVIEGIIDKTFEEADTKHDGKIDKEEWRNLVLRHPSLLKNMTLPYLRDITTTFPSFVFNSQVEDA

SEQ ID NO: 6545 - protein, 409 aa, Leptospira interrogans
MGGVMNHRRPAALGFIFVTILIDVIGFGIIIPVLPKLIQELTHGTLSQAAWYGGLLMFAYSFVQFVCAPFVGGLSDRYGRRPVLLASLFGFTLDYLFLAFAPSIFWLFVGRILAGIMGASFTTGYAYIADISPPEKRAQNFGILGAAFGFGFIIGPVIGGVLGQYGSRAPFLAAAALTLINWLFGFFILPESLTPENRRKFEWQKANPIGSLINLKRYPMIIGLVVAFFLMNVAAHSVQGTWNYYTMEKFQWNEAMVGYSLGVVGLVYAITQGGLIRIILPALGQNKSIYLGLALSGLGYALFALATQSWMMFVFLIPYCLGGIAMPPLQGIMSSQVPSNEQGELQGALTSLMSVTAILGPILMTGLFSYFTAKGTPVYSPEAPLWMGTILTAASLWITVGSLRKHHSE

SEQ ID NO: 6546 - protein, 920 aa, Roseovarius nubinhibens
MSDTITFTLDGEQVTAEKGMTIWEVANGRGLVIPHLCHKPAPGYRPDGNCRACMVEIEGERTLAASCIREPADGMVVKTDTARAETARKMVVEMLVADQPPRDAAHDKSSHLWDMAEMQGVSQSRFPKLEEGRIPLLDDSHVAMSVNLDACIQCGLCVRACREVQVNDVIGMAGRGHDAYPTFDMADPMGASTCVACGECVQACPTGALMPSSVVNEAQVGDSADYDSEVESVCAFCGVGCQISIKVKDNRVKYVEGINGPANEGRLCVKGRFGYDYIHHQHRVTKPLIRRDDAPEKGLNVNPDNWQEFFREASWDEALDLAADGLKGRGREVAGFGSAKCTNEEAYLFQKFIRQGFGHNNVDHCTRLCHASSVFALIENVGSGGVTATFNEIENADVAIVIGANPIENHPVAATYFKQFTKRGGKLIVMDPRGVGLRRFATHMLQFRPGADVAMLNAIMHTIVEEGLYDQQYIDAYTENWEAEKAHLKDFAPEKMEDLCGIPAETLRAVARDFATAKSGMIFWGMGVSQHIHGTDNSRCLISLALMCGHVGRPGTGLHPLRGQNNVQGASDAGLIPMFLPDYQSVTDDGVRSAFTEVWKSEDFSNEKGLTVTEIMDAVHDGDIKAMYILGENPAMSDPDVEHARDALAKLDHLVVQDIFITETANYADVILPASALYEKTGTVSNTNRQVQMVRPAVTPPGEAREDWWIEVELAKRCGLDWRYTHPREVFAEMAINMASLNNITWERLEKTAVTYPSLSPEDPGQAVVFGDGFPRPEGRAKFTPASVIAPDDTPDAEFPMILTTGRQLEHWHTGSMTRRARVLDAVEPEANCSLHPSTLRKLGIEPGGMIRLTTKRGSIVTMARADRAVSPDMVFLPFAYVEAAANILTNAAIDPYGKIPEFKFSAVRVEPVSEQVAAE

SEQ ID NO: 6547 - protein, 149 aa, Zea mays
MAPKAGKKPAEKKPAAAAEKPAEEVAEKAPAEKKPKAGKKLPKEAGAIDKKKKRNKKSIETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 6548 - protein, 409 aa, Brassica napus
  misc_feature (13)..(13): Xaa can be any naturally occurring amino acid
MAEANPGRGGGRXRGGGPMDDDKLVFETTEGIEPITNFNDMGIKEDVLRGVYEYGFEKPSAIQQRAVMPILQGRDVIAQAQSGTGKTSMIALSVCQIVDTSSREVQALILSPTRELASQTEKTIQAIGLHANIQAHACIGGKSVGEDIRKLENGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDWLSEKMRTNNFTVSSMHGDMPQKERDEIMNQFRSGDSRVLITTDVWARGIDVQPVSLVIHYDLPNNRELYIHRIGRSGRFGRKGVAINFVKSDDIKILRDIEQYYSTQIDEMPMNVADLI

SEQ ID NO: 6549 - protein, 92 aa, Zea mays
  misc_feature (31)..(31): Xaa can be any naturally occurring amino acid
  misc_feature (58)..(58): Xaa can be any naturally occurring amino acid
GRVGGLVGGRVGADAYLFGGPIFNDYSCVGXSLLLKREKAGIEQPDRMEVGDGQQIGXIHMPEFLRALAKRLMRNSTEYDNYRRIIVLDREP

SEQ ID NO: 6550 - protein, 451 aa, Streptococcus agalactiae
MNVVLKQRIPLKIKRMGINGEGIGFYKKTLIFVPGALKGEEVFCQISSVRRNFAEAKLLKINKKSKNRVDPACSIYKECGGCQIMHLQYDKQLEFKTDVIRQALMKFKPEGYENYEIRKTIGMPEPEHYRAKLQFQVRSFGGNVKAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKDDDDLIDAYCGVGTIGLAFAGKVKSVRGMDIIPEAIQDAKENALHMGFTNTHYEAGKAEDIIPRWYSEGFRANALIVDPPRTGLDDKLLNTILKMPPEKMVYVSCNTSTLARDLVTLTKVYHVHYIQSVDMFPHTARTEAVVKLQRKV

SEQ ID NO: 6551 - protein, 235 aa, Unknown
  Platanus x acerifolia
PLTHVVLGMLMHPVFYMASTWCFGFERYGYLGPFSGEPPSYLTGEFPGDYGWDTAGLSADPETFAKNRELEVIHCRWAMLGALGCVFPELLSRNGVKFGEAVWFKAGAQIFSEGGLDYLGNPSLVHAQSILAIWATQVILMGAVEGYRVAGGPLGKVTGPLYPGGSFDPLGLADDPEAFAELKVKEIKNGRLAMFSMFGFFVQAIVTGKGPLENLADHLADPVNNNAWAYATNFV

SEQ ID NO: 6552 - protein, 84 aa, Unknown
  Platanus x acerifolia
RGCPDDVYVLELAEECGIDIPFSCRSGSCSSCAGKMVQGKVDQADGSFLDDDQVEAGWVLTCIAYPLSDVVIETHKEEDLVADS

SEQ ID NO: 6553 - protein, 62 aa, Gentiana lutea
GEVMLGQWEFQVGPSVGISAGDELWVARYILERITEIAGVVVSFDPKPIEGDWNGAGAHTNY

SEQ ID NO: 6554 - protein, 249 aa, Brassica napus
  misc_feature (199)..(199): Xaa can be any naturally occurring amino acid
MSCVQSNYGSEESPPEKKRRNEKASPWWSSLPDAVALSIVARLTRLDQAALSLVSKRHRSLVASPELCRTRSLIGCTEASLYVCLNIMPDPNPSWFVLTRNRQLRQIPSNPYQPLRPSSSFVVVDWGIYVIGGIVNGNPTRDVWFLDCYSRTWHPVPSMKMARASASANVIDGKIYVFGGCRDEEAEVFDPKTQTWRNXISPIGIQQSVVVQGKKIYAVDEEDQSFCSLPSQCPSWTSGKRDCKPRNRK

SEQ ID NO: 6555 - protein, 68 aa, Alstonia scholaris
GEVMPGQWEFQVGPSVGIEAGDHIWCARYILERITEQTGVVLSLDPKPIEGDWNGAGCHTNYSTKSMR

SEQ ID NO: 6556 - protein, 327 aa, Unknown
  Rhodococcus sp. RHA1
MRQIIIIGSGPAGYTAAVYAGRANMRPLLIASSVEAGGELMNTTEVENFPGFPDGIMGPDLMSNMQAQAEKFGTDIIYEDVTGVDLSGPVKKVTLGSGAVHEALSVIFAAGSAYRKLGLADEDRLSGRGVSWCATCDGFFFRDRTIAVIGGGDSALEEALFLTRFADKVYLVHRRGSLRASKIMQDRAFANDKIEFVWNSEVVSINGEDQVESITVRDTETGVQQNLDVRGLFIAVGNDPRVHLVHGQLELTPGGTIAVEGRSSRTAVPGVFAAGDVTDPTYRQAITAAASGAVAALDAEHYLVTLSPDLLGSIAVDPASSLETTTA

SEQ ID NO: 6557 - protein, 501 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 6558 - protein, 197 aa, Pseudomonas syringae
MAERKAYVERNTLETQIKASINLDGTGKARFDIGVPFLEHMLDQIARHGLIDLDIECKGDLAIDDHHTVEDVGITVGQAFSQAIGDKKGIRRYGHAYVPLDEALSRVVIDFSGRPGLQMHVPYTRATVGGFDVDLFQEFFQGFVNHANVTLHIDNLRGTNTHHQIETVFKAFGRALRMAVELDERMAGQMPSTKGVL

SEQ ID NO: 6559 - protein, 167 aa, Unknown
  Platanus x acerifolia
MASTALRSCGVAAVFPSLLSSSKSKFATAVALPGACSNASTRFTMSADWMPGQPRPPYLDGSAPGDFGFDPLLLGAVPENLERFKESELIHCRWAMLAVPGILVPEALGLGNWVKAQEWAAVPGGQATYLGNPVPWGYLPTILVIEFLAIAFVEHQSEHGERPEKKK

SEQ ID NO: 6560 - protein, 250 aa, Methanococcoides burtonii
MAQQYGKVYLVGSGPGDPELMTLKARRLLDTADVIIFDQLPGEKILASMPEAAEKIDAGKHAGDHTLTQSEINDAIVEKAKEGKIVVRLKGGDPYMFGRGGEEAEELVKAGIEFEIVPGITSALAATAYAGIPVTHRDHASMVTFITGHEDPTKEETALDWKTLAAFGGTIVIFMGVKMLERNMGELMRYGKNPKTPVAMVERGTRPDQRVTIGTVETIAKISKDAGVKAPALTVIGDVVKLHEILGSQI

SEQ ID NO: 6561 - protein, 276 aa, Auxenochlorella protothecoides
CFAYSFSSILVEIQDTLRQPPKAAKTMSKATNVSVTASFAFYFVVAIGGYASLGNDVPSYILGGLQGPEWVIFVANLCVLLHMWSAYQIYAHPMFDTLESHVKAFKLRQAKAKGDAELPAKVEELKRMSLAARQGSAAGTKTMDDTAPAAPPAANPLCRLSRVSAMAGEKLQRLSQNAAMYRVSTGFADTSVPSNDDHFVLPWWQRLITRRMYVVRTTLIAAIMPFFGAMAGLVGALAFFPLTSSSPSAAGAPCTSPLGGSITCCTSSSSAWRWCA

SEQ ID NO: 6562 - protein, 715 aa, Salmonella enterica
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVEGYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQDIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 6563 - protein, 165 aa, Zea mays
  misc_feature (30)..(30): Xaa can be any naturally occurring amino acid
  misc_feature (49)..(49): Xaa can be any naturally occurring amino acid
  misc_feature (111)..(111): Xaa can be any naturally occurring amino acid
LSRSIALSPVSCRAVERVQSVLRGRTFRVXATGDRFGVDLGGALKAFVXCIADMAVALGMGVCTKSMVISGALSEMARLAVPRGSAPMSFLGLVGGGALFVSCSSPACRSXLVAFALGLVVGVDGAVARFVSVAGRVCSLLVFLCWKKAVGAFLPSARGFARRSL

SEQ ID NO: 6564 - protein, 74 aa, Unknown
  Platanus x acerifolia
VRETFAWMHYYWYLTNDGIEFLRTYLNLPSEIVPATLKKSVKPAGRPMGGPPGDRPRGPPRFEGDRPRFGDRDG

SEQ ID NO: 6565 - protein, 413 aa, Pyrococcus abyssi
MKAVILAGGFGTRLRPISSTRPKPMVPVLGKPNLQYILEALEKVKEIDEVILSVHYMRGEIREFIQEKMRDYPKDIRFVNDPMPLETGGALKNVEEYVSDDFLVIYGDVFTNFDYSELIEAHKKNDGLVTVALTKVYDPERFGVVITDEEGKIVEFEEKPRKPKTNLVDAGIYMVNKDVLKEIPKNKEVYFEREILPKFVSQGLVYGYKMPKHYYWVDLGTPEDFFYAHQIALDEMARENGYMILGENVEIPEDVEVQGPVYIDDNAKIGHGVKIKAYTYIGPNTMIEDKAYIKRAILLGNDIIKERAELKDTILGEGVVVGKNVIIKENAVIGDYAKIYDNLVIYGAKVLPWKKVEEYEAYIRIKLDPAKVRPELTPDRCPLGLPECIYKKFKAIAGEKPPCDECIENQWLF

SEQ ID NO: 6566 - protein, 373 aa, Unknown
  Synechococcus sp. WH 5701
MAEYYDLLGVSRDADADTLKRAYRRLARQYHPDINKEPGAEDRFKEIGRAYEVLSDPQTRARYDQFGEAGVSGAGAPDMGDMGGFADLFETFFSGFGGAAAGGGAGGGPRRRGPRQGDDLRLDLSISFNEAVFGQEKEVQIRHLETCATCQGSGAKSGSGPTTCGTCAGQGQVRRATRTPFGSFTQVAPCPTCEGSGQVIADPCGACGGQGVQQVRKKLRITIPAGVDSGTRLRVAGEGNAGQRGGPAGDLYVYLFVQAHDKLRRDGIHIHSDVTVNYLQAILGDTIEVDTVDGAATLEIPAGTQPGTTLTLTGKGIPKLGNPVARGNHLFNVKVQVPTKLSSHERELLEELAGHHSTKDHPHKSGLFGGLFG

SEQ ID NO: 6567 - protein, 124 aa, Unknown
  Nocardioides sp. JS614
MSTFYEEIGGFETIRRIVARFYEGVAADPVLRPMYPEEDLGPAEERFLLFLVQYWGGPTTYSDSRGHPRLRARHAPFAVTPEAKEHWLRHFRAGLDEVALTPEQDAQFWDYITHAAQFMVNSLE

SEQ ID NO: 6568 - protein, 449 aa, Zea mays
DQLLDFASLSMPWDSEPFPGVSMMLENAMSAPPQPVGDGMSEEKAVPEGTTGGEEACMDASEGEELPRFFMEWLTSNRENISAEDLRGIRLRRSTIEAAAARLGGGRQGTMQLLKLILTWVQNHHLQRKRPRDVMEEEAGLHVQLPSPVANPPGYEFPAGGQDMAAGGGTSWMPHQQAFTPPAAYGGDAVYPSAAGQQYSFHQGPSTSSVVVNSQPFSPPPVGDMHGANMAWPQQYVPFPPPGASTGSYPMPQPFSPGFGGQYAGAGAGHLSVAPQRMAGVEASATKEARKKRMARQRRLSCLQQQRSQQLSLGQIQTSVHLQEPSPRSTHSGPVTPSAGGWGFWSPSSQQQVQNPLSKSNSSRAPPSSLEAAAAAPQTKPAPAGARQDDIHHRLAAASDKRQGAKADKNLRFLLQKVLKQSDVGSLGRIVLPKVRHVRIDKSLEQISL

SEQ ID NO: 6569 - protein, 221 aa, Staphylococcus aureus
  misc_feature (30)..(30): Xaa can be any naturally occurring amino acid
  misc_feature (66)..(66): Xaa can be any naturally occurring amino acid
  misc_feature (108)..(108): Xaa can be any naturally occurring amino acid
  misc_feature (121)..(121): Xaa can be any naturally occurring amino acid
  misc_feature (125)..(125): Xaa can be any naturally occurring amino acid
HHHHHHSSGVDLGTENLYFQSNIGSGSNAXIYQKQRNTAETQLNISISDDQSPSHINTGVGFLNHXLTLFTFHSGLSLNIEAQGDIDVDDHHVTEDIGIVIGQLLLEXIKDKKHFVRYGTXYIPXDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 6570 - protein, 498 aa, Oryza sativa
MDVLDHAPPSPLSSDILPHFPPSLADAGAGALDLSFTSTASASTSSFTTATTFSARSSLSLPSFSSSTSLSPRPHSSSSSPHWALLAAARAATPDGVLRLAHLHLIRELGHGHLARVFLCRLKSSPPASPLFALKVVDLRDDDPSRVTHVLAESRVLSSLDHPFVPTLYARLDAGRYACFLMDYCSGGDLHAVLRRRPGGRLPVAAARFYAAEVLLALEYLHALGFVYRDLKPENVLLRGDGHVVLSDFDLALPASVEPAVRRRQVRKLSRRKNRIVPSCFSANGGSGDDGDEVNAKEQFEFVAEPTTANSKDCVGTHEYLAPELVSGSGHGNGVDWWAFGVFLYELVYGRTPFKGHAKDATLKNILAKQVTYPQLDGEADAAQLRDLIGRLLERDPRRRMGSARGAAEIKRHPFFAGVDWALIRCVAPPVVPDKDSAAAGAGDKKAKLGSWNSMGGKKRSSFGRKSNYEERQGVFRKLMSWSQDSRSKKAKTNKVKL

SEQ ID NO: 6571 - protein, 377 aa, Candida albicans
MSTTEQSLQSKTAVLCSFYTKIGSCRHGEECSKKHLKPTITKTILLPNLYQNPRFDLVEYLSRNRKQHRVKKRKTGDKNSDDIAEINLETKDDVKDNEEKANVDGENKEHDETKEIESEDVISKDKEEVIVDRSGIAQQDKQKESNKKGKQEGESEKEEPNKESTEEELPPQGVTQEVPNHNQEESPIKQEQTAAKQEKHGLDENHPVLTDEQIQKDFDLFYQDIFVHVAKLGQINDMAVCENENHLSGHVYIKFNDYNDAIAANLQLNQEWYNGKPVYSELSPVNILADAHCKSWDHGHCDRGAKCNYLHVKQPTQGIKKSLWDSQTKTYTLKKLEMLKKEVPEEIMSGASSDNVNKVNTKDIEIRSTMALLESMF

SEQ ID NO: 6572 - protein, 491 aa, Sphingomonas paucimobilis
MSFPATPDYTGLNKPVGQEVSIKGLKASEGTIPADVRGAFFRAVPDPQFPPFFHPDTALSDDGMISRVLFNADGTVDYDIRYVQTPRWKAERAAGKRLFGRYRNPYTNDPSAFDLEGTVSNTTPVWHAGKLIMTKEDGPGHQVDPHTLETIGAYDFGGVLRSKTMTAHVRVDPETKEMFVYGYEADGLCSKTMAYWWTDRDGKLVKEQWFEAPFCSLVHDFVITENYAIFPLQPTTADLERVKGKGAHWVHQQDLDYHVGIMPRYGDVSQIRWFKGPKGMSSFHMMNAFETDDGKVHMDHHVTDTIAFPHIQADSGINVPPQMLGGGFQRWIMDMKGDGESVAVTPLGPPGDMPRIADADQGRPYRRGWYCSMNPQPMGPPVMGGVVGVMFSALLRKDFETGEIVGYNLPPAHGMSETVHVPASEPGHEGWLIAVVDHQLGPDTFEHALWIWNAGDLPAGPVAKVPVPTRMRPQVHGWWVPMADYEAARAA

SEQ ID NO: 6573 - protein, 407 aa, Flaveria trinervia
MESRVLSSGATAISGVPRLTKPAGRITTTTVAVAFPARLNATGGNVVWGRQLRPSLLNLDHSSPVSLVTKPVKRDVLKPCSATASDSAGDAAPVGFLAKYPFLVTGFFFFMWYFLNVIFNILNKKIYNYFPYPYFVSVIHLAVGVVYCLGSWTVGLPKRAPVDSNILKLLIPVGFCHALGHVTSNVSFAAVAVSFTHTIKALEPFFNAAASQFVLGQSIPISLWLSLAPVVIGVSMASLTELSFNWLGFISAMISNISFTYRSIYSKKAMTDMDSTNLYAYISIIALLFCIPPAVLFEGPQLLKHGFNDAIAKVGMIKFISDLFWVGMFYHLYNQIATNTLERVAPLTHAVGNVLKRVFVIGFSIIVFGNKISTQTAIGTSIAIAGVAIYSLIKARIEEEKRRMKSA

SEQ ID NO: 6574 - protein, 616 aa, Zea mays
MASISGAAAAPSSAACRLRLRRHLLLRPSHLRLRAPHSIADLSRSSSSSNSAPTRAQPLGSRPENGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDIEMIYKIVQHMAANDRAIIAEGSCGSPRSVKVYLGECNVDEDLQAA

SEQ ID NO: 6575 - protein, 249 aa, Oryza sativa
MAIAAITGGGRRPPCRRGPAAVAPPARFSCRCGTHPVPRRNVLSTMLSTSTVILFGSKQITLAEITGATFREYIDTFDGYSFLYPKSWIQVRGAGADIFFRDPFVLDENMSVEISSPSSSKYVTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEQVFKEEEGDLRRVMDSFRVNKTV

SEQ ID NO: 6576 - protein, 903 aa, Kineococcus radiotolerans
MGELGGARDGLHGADLVVGPHQGDQRDVVGVAQGGLERVGVQAPGPVHGQPGDQCALVGLQPPHAVQDGVVLGGGEQDPPARGVGGPAGAQQPLEGEVVALGAPGGPDDLPGARAEGRGEGLAALLHRDAGPAAGGVQRGRVAGAAGGSGHEGLQRFRTQGRRRGVVQVRAHTGQSKDWHTAPVPVPTHRESPTGSRTSRAHPLGVTLRGDGADVAVLAAHADAVEVCVFDDAGRETRTRLPDVELGVWHGHVPGLVAGSRYGLRVHGRWDPERGLRHNPAKLLLDPYAQGVEGEVALTPEIFGHVVDEDLEGDLAVADPRDSAPHVPRGVVLAPLPADLRVGEDERPRTPWADTVVYEAHVRGLTRRFPGVPEAERGTYAALAHPAVLEHLTSLGITALELLPVHTSTSEIALRRRGLSNYWGYNTLAFNAPHPGYATAAARAAGAEAVRAEFRRAVAALHGAGIEVVLDVVYNHTCEEGPDGPHLSLRGLDDATYYLRDAGGRPLDVTGCGNSLDFTDRRVVRFALDSLRHWVTEYGVDGFRFDLMTTLARGHDGYSPDHPFLVALGADPVLAGTKLIAEPWDVGPFGWRTGQFPPPLHEWNDRFRDGARRFWLSDAREIACGRSAPVAPGRGLPELATRFAGSADTFDVQRGRLTSVNFVTAHDGFTLADLTAYDRKHNEANGEGNRDGSDSDTSWNHGVEGGTTDPGVLAARRRSVRNLFATLVLSTGVPMITAGDEFGRSQGGNNNAYCQDNEVGWIDWDLQDWQRELLDDVRELLALRRRYPVLREAGVRRGSPVREQRSDLLWFSEDGEPMSVERWHEADRRVLQLLVDGRDRGETSVLVVLNGGPRRLDVVLPAVEGLAAFSPRWASTPGRAAGSCAAGAALPVDPWSVRVLATD

SEQ ID NO: 6577 - protein, 461 aa, Xanthomonas campestris
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 6578 - protein, 345 aa, Xanthomonas oryzae
MIAPMSDSTHKIAVIGAGSWGTALAALLARHGHPTVLWGRDAAMVDTIDRTHENARYLPGIALPDSLRATTDLQAAVADAAWILVVVPSHAFTETIRLIAPLRPACPGVAWATKGFEPGSGRFLHEVARDILGPSVPLAVVTGPSFAKEVTLGLPTAITVHGDDATFAQAVADAMHGPTFRAYTGDDMVGAELGGAMKNVLAVATGVADGMQLGLNARAGLITRGLNEMLRLAAAIGARPETLMGLAGLGDLVLTCTGDLSRNRRLGLALGRGQSLNDAIRQIGQVVESVQMADEVMRQAEHHGIELPISNAVRAVLHGEITPEAGLKELLARERKPEYPQTLFT

SEQ ID NO: 6579 - protein, 112 aa, Haemophilus influenzae
MKKIEAMIKPFKLDDVRESLSDIGISGMTITEVRGFGRQKGHTELYRGAEYMVDFLPKVKLEVVVPDELVDQCIEAIIETAQTGKIGDGKIFVYNVERAIRIRTGEENEDAI

SEQ ID NO: 6580 - protein, 668 aa, Oryza sativa
MMEVNKEEDIRLGLHRSDYMLDSGTNSLLQIELNTISSSFPGLSSLVSELHRTLLNRHGKVLGLDSKRIPQNWAATQFAEALSMAWTEFNNKRDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGESPAVHADEVTTPMAIGAGGDRLSALPDDLLLRVLHFANAVEAASTSLLSRRFGALWRSSGAVNLAARVPGAGGRDAFVRAADAALAAAGRVVTRLTLHVDDGDHSGYCTSMYNLLRDHDVVDAVVSHPAARRVEELRVAVAVHPFGHDKINTMISSGSVRIYDIKLASLPSKTLRVLDLTNCRNLTPASAAAAATAFPSSPPPYNVSIFCNELLTSNCNDKFRWGISPPLGRSSTTRLRFPAATALTLINCLTNGGMSGSVIDAPRLRSLTYKGAARSQFELTSPAPDMKMVHLHFNHYFHQRDYLRFIHNFTKVKLDGGFNRWSKTAKAAAIASMLHCCPVLCDLNLNLISTVSPDYFKNSKQVQHFFQRKSQLDFDRSIDDFMRNSISKRGDHRHNGDEVSGFIPGLTACSFTCLQNNLRRVSLQFRLDENSENFGVRLVKFFAENAMVLEELRVLTVETET

SEQ ID NO: 6581 - protein, 68 aa, Gelsemium sempervirens
GEVMPGQWEYQVGPSVGIEAGDHIWCSRYLLERITEQAGVVLSLDPKPIEGDWNGAGCHTNYSTKSMR

SEQ ID NO: 6582 - protein, 68 aa, Luculia pinceana
GEVMPGQWEFQVGPSVGIEAGDHIWCARYLLERITEQAGVVLTLDPKPIEGDWNGAGCHTNYSTKSMR

SEQ ID NO: 6583 - protein, 214 aa, Serratia proteamaculans
GGNKPRKLEYLAADALRQGADTLVTAGAIQSNHVRQTAAVAAKLGLHCVALLENPIDTKEENYLTNGNRLLLGLFNAEVVMCDALHDPQQQLADLAIRLEVQGFRPYVVPVGGSNALGALGYVQCALEIAEQSRRSNVEFSSIVVASGSAGTHAGLAVGLQQLLPEAELIGVTVSRKVIDQLPKVELIQKALACSLDIDELSPIQLWDDYFAPQ

SEQ ID NO: 6584 - protein, 415 aa, Oryza sativa
MSAEAPLGVTPAAAAAEGEEMVAVVDEMAEEAAVWCAVHGLVVGDRAEPEFHMVLNVDSRIEMKIITFFSENRSGTIPGVGLVHAPFALLPTRFPASFWKQARELAPIFNDLVDRVSLDGEFLQDSLSRTRQVDDFTSRLLDIHAKMMEVNKEEFIRTLLNRHGKVLGLDSKRIPQNWVATQFAEALSMAWTEFNNKRDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGHDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDE

SEQ ID NO: 6585 - protein, 62 aa, Coptosapelta diffusa
PGQWEFQVGPSVGIEAADHIWCARYLLERITEQAGVVLSLDPKPIEGDWNGAGCHTNYSTKS

SEQ ID NO: 6586 - protein, 236 aa, Oryza sativa
MTRRYWNINLKEMIEAGVHFGHGIKKWNPKMAPYISAKRKGTHITNLARTTRFLSEACDLVFDAASQGKSFLIVGTKKRAADLVASAAIRARCHYVNKKWFSGMLTNWSITKTRLSQFRDLTAEEKMEKFHHLPKRDVAILKRKLSTLQRYLGGIKYMTRLPDIVIVLDQQKEYIALRECAILGIPTISLADTNCDPDLANISIPANDDTMTSIRLILNKLVFAICEGRSLYIRNH

SEQ ID NO: 6587 - protein, 215 aa, Magnetospirillum magnetotacticum
MRAAFLILNGADYGGSHAQGCHHAQYHRDSIKVAVDLDGSGKYAVKTGVGFLDHMLEQLSRHSLMDLEVEAKGDLHIDAHHTTEDVGISIGQAVAQALGDRKGIRRYGSAYVPMDEALTRVALDLSNRPYLIWKVAFGGDKLGTMDTELFKEWFQAFAQAAGATLHVESLYGDNDHHIVESCFKALARALREAVEIDPRKADAVPSTKGTLGGSL

SEQ ID NO: 6588 - protein, 1080 aa, Pseudoalteromonas tunicata
MKRMLINATQQEEMRVALVDGQRLYDLDIESPGHEQKKANIYKGKITRVEPSLEAAFVDYGAQRHGFLPLKEIARTYFPKDYNFSGRPNIKDVIKEGQEVIVQVDKEERGQKGAALTTFISVAGSYLVLMPNNPRAGGISRRIEGDERTDLKDALSRLELPKGMGLIVRTAGVGKSFEELDYDLKALLIHWDAIVTASEKGPAPFLIHQESNVIFRAIRDYLRRDIGEILIDKTRVFEEAKAHIERFRPDFMSRVKLYKGEVPLFTHYQIESQIESAFQREVRLPSGGSIVIDPTEALTSIDINSSKATKGGDIEETAFNTNLEAADEIARQLRLRDLGGLIVIDFIDMTPPRHQREVENRLKEAVRPDRARVQIGKISRFGLLEMSRQRLRPSLGEASQGTCPRCNGQGTIRSTESIALSILRLIEEEAIKDNTAQVNAQVPVSVAAYLLNEKRRSVSAIEKHHECDVVIVPNQHMETPHYEVHRLKHDETVESVSYSQIKKPEAMSFDASKIQKVEKEQPALQGVISPTEPAPVAKKPEPAPVAVAPSEGLLSKLTRWVKSLFASEEKPEVKEAQERTTPPRNNDSRRRNNSRARPPRKSVDASDSATKPADKPVRDNSDSRVERDSRDNKNKRRRSPNRKPASEVVETAAAAVEAVVEQQPEPRFKERRQRRNLRKKVRVTEDVLETLTLDDIKVVEPAPQVQVKTAQADVKVEDKPSTKTEKVISDEDVGFDNVDALNNEEDGADSKEPRSRSRRSPRHLRAAGQKRRKPNEGENTAQIETVESPGFVPVADQEIAAQQSRKQQALKVAVDAVDAVDAVDAKIVEDSAPVATTEVPVIEVTSTEVASIEVSKTTDIEPAEVVSDVLAVTTAVVEQTQSDEVAQSVEVSPVVEVSPAVEQSVLVSEDVTQTAIEAETTPVNDVEISTDTALQSTDTPLVIETEASEAETVIETETSETEVNQESKEAEATDVTNAAVEQVVETVMAVEVESTPNVEVESTPAIGAEQNPVTVVEARVSAIASAPMTKPTAIALTENVTLPSAMPAEQRVQVQYSEQQSGSIAPTSRASAPMTKAQAV

SEQ ID NO: 6589 - protein, 163 aa, Unknown
  Platanus x acerifolia
TADAVRQYLWLFEEHNVMEFLVLAGDHLYRMDYERFIQAHRETDADITVATLPMDEKRATAFGLMKIDEEGRIIEFSEKPKGEQLKAMKVDTTILGLDDERAKEMPYIASMGIYVVSKDVMLKLLREKFPGANDFGSEVIPGATSIGMRVQAYLYDGYWEDIG

SEQ ID NO: 6590 - protein, 658 aa, Salmonella enterica
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARRVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPDVVEYACECLRYWVETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGPAHGLCVFQRG

SEQ ID NO: 6591 - protein, 125 aa, Arabidopsis thaliana
MASGCALHGGCPSDYVAVAISVICFFVLLSRSVLPCLIHKAPRTNSSSFWIPVIQVISSFNLLFSIMLICFDSGRNIGGDIAIFGQVCLETMIPHLLWIEGPLGFGLLMSCRITQAFQLYFIFVK

SEQ ID NO: 6592 - protein, 175 aa, Bacillus thuringiensis
MNIEIKDTLISEEQLQEKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFIASVVTE

SEQ ID NO: 6593 - protein, 305 aa, Arabidopsis thaliana
MGLQWTFPVAGLHALYVLALIAFTRAVRHVEFRFDELRDLWKGILVSATSIVIWVTAFVLNEIHEEISWLQVASRFVLLVTGGILVVVFFSISSNQPLLSQISLKKRQNFEFQRMGQALGIPDSGLLFRKEEFRPVDPNEPLDKLLLNKRFRHSFMEFADSCYAGETLHFFEEVYEHGKIPEDDSIRRIYMARHIMEKFIVAGAEMELNLSHKTRQEILTTQDLTHTDLFKNALNEVMQLIKMNLVRDYWSSIYFIKFKEEESCHEAMHKEGYSFSSPRLSSVQGSDDPFYQEHMSKSSRCSSPG

SEQ ID NO: 6594 - protein, 355 aa, Zea mays
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 6595 - protein, 150 aa, Oryza sativa
MAPKAEKKPAEKKPAEEKAGEKAPAAGKKPKAEKRLPASKGEKGGEGKKERGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 6596 - protein, 112 aa, Arabidopsis thaliana
MPSLQTSLPPELANNVVRLYRECLRRAKFIGKQSLSNLEQNVERFSFVSVDSLEQHNTELVVGMVRQQFKKHMNETDPEKIQKLKDDAARGLINHMLFESAKLTGGKVSQRS

SEQ ID NO: 6597 - protein, 463 aa, Pseudomonas syringae
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 6598 - protein, 278 aa, Unknown
  Vibrio sp. Ex25
MTILQVSVAQINAQLGDVNANLNTHQDYIKQAAALGSQLLLFPELSLTGYQLQSSVREVAMKRDDARLKELAQLAPHMSVIVGFVEQVAPGEYYNAMAWLLGGTVVAVHRKINLPTYGGLEEGKWFHSGDATTSVSLDDNWRGSVLICADLWNPPLVHCALLDKPEILLAPINSASSIVSKDFSNEDNWLVNVKFYAVLYGTPVLMANRYGPEGEAWFWGGSCILSATGELLAQAEDGETLITATLSLDDIDKARFELPTMRDSNTPLITTLLSKAKR

SEQ ID NO: 6599 - protein, 618 aa, Arabidopsis thaliana
MDLNGECKGGDGFIDRSRVRILLCDNDSTSLGEVFTLLSECSYQVTAVKSARQVIDALNAEGPDIDIILAEIDLPMAKGMKMLRYITRDKDLRRIPVIMMSRQDEVPVVVKCLKLGAADYLVKPLRTNELLNLWTHMWRRRRMLGLAEKNMLSYDFDLVGSDQSDPNTNSTNLFSDDTDDRSLRSTNPQRGNLSHQENEWSVATAPVHARDGGLGADGTATSSLAVTAIEPPLDHLAGSHHEPMKRNSNPAQFSSAPKKSRLKIGESSAFFTYVKSTVLRTNGQDPPLVDGNGSLHLHRGLAEKFQVVASEGINNTKQARRATPKSTVLRTNGQDPPLVNGNGSHHLHRGAAEKFQVVASEGINNTKQAHRSRGTEQYHSQGETLQNGASYPHSLERSRTLPTSMESHGRNYQEGNMNIPQVAMNRSKDSSQVDGSGFSAPNAYPYYMHGVMNQVMMQSAAMMPQYGHQIPHCQPNHPNGMTGYPYYHHPMNTSLQHSQMSLQNGQMSMVHHSWSPAGNPPSNEVRVNKLDRREEALLKFRRKRNQRCFDKKIRYVNRKRLAERRPRVKGQFVRKMNGVNVDLNGQPDSADYDDEEEEEEEEEEENRDSSPQDDALGT

SEQ ID NO: 6600 - protein, 1708 aa, Bifidobacterium breve
MAVRRFSSLAKRLAVTGIAVAMSATTLVALPASADETEANAQARTSVGAPGDVIAIAFQTNWNSVAKECTEAYGPEGVGYVQVSPPMESIQGTEWWTSYQPVSYKLDSKLGTEAEFKTMIATCNAAGVEIIADSVINHTTGADQGEGTGVAGSKYDGEGNFPAIPYTKENFHDCTKNIGDYTNADEVQNCRLTSLQDLDTSQEYVQDKLADYMNRLLDLGVYGFRVDAVKHIATADVAAIKAKLAEKSGRNADDIFFEQEVIGNASEAAEIQPSNYVANGKVSEFNFTNHLSVAFAGDITDASKGLAKVGGDGWVSSDKAAVWVTNWDTERGSSITYKKGSKYLLANAFMLAYDYGQPHIYSGYYFDNSDDGAPGATETSVPDMECPTDGSMTSGTWQCAERWTAIRGMIGFHNAVNGTDVTNWKAYDTNVLGFGRGDVGYLALNNSADDSKQTFQTSLPAGEYCNVYATGDCSATVTVKDDGTFDATLAKNSAIAIYAGATKDSWTGTTKSDPSDPDLSVNDETKKAAADTSRTIYYKLPDGWKQAYLHYGIDGWAEQGHELMADAGNGWVKFTVDPKGKSFEYVFTDGGDNWDNPNGGGNYTAQGHWTAVADHEASAGVPSDVQSYQPKTKVIVHYKPAEGDAVADRGVYMWGTDKNGATLNGAWHAFTGEDSYGKVFETTIDGAYDAAKIGVIVTTEGWDKVGGDRTIDGSTGTAEIWVDGANPDETLTEAPDGYKKAANQIDVTIHYHRLADDYTSEDGMKAWDIWGWADGVNGAAYPFTEHDDYGLIAKYTLKGSGMSTPQFIVRYGGDSWEAKDPNDENRTIPQSAITVNADGTASAEIWLVQGDTTIYTNGTLYDAKGMIVSAEMTDFNTITVKLNKALTIDKPADAVSVEGVKIKDVKASGNTVTITTADNLDVTKAYKVTIEDYGTQNVSLGAVVRSDAFDKKYAYDGDDLGVTYKAEKSTFKLWAPTATKVTLRLYADSTDPKAAQTDAVTLEKSGKKGVWTFAVDKDLKDYAYDYELTFADGTVNTSADPYATAAVANGERSVVLSDKEKGDAGKRMASFSKPTDAIITEANVRDMTINPNSGVSEANRGKYLGFVEEGTTVDGKQGAASTGIDYLKSLGVTHVQIMPVYDYGSVDETGDLSYGAQYNWGYDPENYNVPEGSYSSDPSDPSARVKEMKQMVSGLHKNGLYVVMDVVYNHVYNASEHAFNKTVPGYYFRYDANGNLTNGSGCGNDVASERAMARKYIVDSVKYWATEYNVDGFRFDLMGLIDQTTMNQVRAALDEIDPSILVIGEGWDMTDAIGNQETTQPNASKVKGVAFFNDSLRDAIKGSVFSDEDTGFIAGKADKENLIATNVLGCNNKREGIDENGHCNNGTADTNYGGADQVVQYVEIHDNLTLYDKLVKSAPNDSEETRLARAKLADSLILLSQGIADMQFGQEFLRTKGGNGNSYNAGDAVNAIDWNRTVEQAGSVNYVKGLIALRKSIKNLHLSSYDDIAKNMTVLQQSDGVVAYQLKDGGDTYVVVFNANESAATVEAVPAGKYTVLAADGKVTETQDKNAATTVGADGYQAGALAAAVLKAGADDDSTKPDGGKDDSSKPGNNDGKDDNQSGGTATPGTPGDSGNGNGQTGDGNASNGASDTAAGQSQQFGAAALPNTGVALSVMAVAVLVMTAAGMLLQRFSKGSNVVNSKEGSEQ

SEQ ID NO: 6601 - protein, 1090 aa, Burkholderia mallei
MKRMLFNATQQEELRVAIVDGQKLIDIDIETAGREQRKGNIYKGVVTRIEPSLEACFVNYGEDRHGFLPFKEVARQYFKEGVDMRSARIQDALREGQELIVQVEKEERGNKGAALTTFISLAGRYLVLMPNNPRGGGVSRRIEGDERQELRETMAQLQIPDGMSMIARTAGIGRSAEELQWDLNYLLQLWRAIEAASQSGHPGQPMLIYLESSLVIRAIRDYFQPDIGEILIDTTEIHDQARAFMDIVMPDNVGKVKRYHDDVPLFSRFQIEHQIETAYSRTVPLPSGGAIVIDHTEALVAIDVNSARATKGADIEETATRTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRQEINKIESRFKVGVVLIPNKHLDTPHYKLERLRHDDARLDDPRASWKMAEEAARELEAETGYSKRAEETKPRQEAAVKGITPERPAPSPAPQRQSAPEAAAPVAAAPASGGGFMKWLKGLFGAQPAAVPAPAPAAQETAARPARERAERGERGEKAERGERGGDRNRNRRGGAAQQGGGRDQAAAGGGRAQAPRAEREGKETREPREGREARGGRDNREGREARETREAREPREQREPREAREQREARERAETVDAAEAPRGERRERGERRKPAPHVATLETVNRGESAHAETAEKPLYALGAEAGVDADSNARDGEERRRRRRGRRGGRREREDEVAGAVQAAEGSEGVTAEAEALEHAEHAQQRVAPVANQAPEHAAQAGAGVAAAAAATVAAEAIAHVESGAKVEPQPAAEASAGDTEQAEAVPARSIEAPAQAASTGQAEAVQAAPAAPAHVTPATADVAREPAAPAETASAETTPAEIPPAEAAPAEAPAAEASEVAASAVASAPAPAPAAEPAPAAEPHRPAPVSAAPASAAPAEADAAREPAAVAEPHVPAAAATPTPASVATTPGVSLDTALAAAGLVWVNTDTDKLRAAQAAAAQIVQPVRVPRERKPLPPVDATPMQQVETTHR

SEQ ID NO: 6602 - protein, 348 aa, Oryza sativa
MEGKDLEEPDGRDESAAAAAGDDAAVQEEVIAVLRQAEEGKPVESVRLVDRQLRHLPEAFGRIQGLRVLDVSRNQLEVIPDAIGGLDHLEELRLASNALISLPDSIGLLLNLRILNVGSNRLRSLPDSISKCRSLIELDASYNGLAYLPTNIGYELVNLRKLWVHMNKLRSLPSSICEMRSLYLLDAHFNELCGLPSAIGKLSSLEILNLSSNFSDLKDLPASFGDLLNLRELDLSNNQIHALPDNFGRLDKLEKLNLEQNPLSMPPMEIVNKGVDAVKEYMLQRWLDILLEEERKSIAAAESPQAPTTPSAWLARSVSWVSDVSGSLVGYLSGENKTEKDAYLDQQY

SEQ ID NO: 6603 - protein, 109 aa, Griffithsia japonica
MSDVRTYTIEIDMHGTKYDIPVKEDCTLLEGIEEFGLEVLHSCRAGVCVTCAAKILAGEIDPGFASITDDLKEEGYVLTCSAYPRSDGIKLEMNHFDDAYDKQYGQFEN

SEQ ID NO: 6604 - protein, 223 aa, Brassica napus
MDPCSFVRIILGNLTVRFPATSPSSSSSEPSVSGINPSTPNCYCKIRFKNFPRQIASVPVMFRTESESETRSSGNISTVAACFSLSKAQIQVALKKPNWSVLSIETYSRVGDGVSGASCGLASGSEKLLGRFDVSIDLKSAETKTSLAHNGWVALRRSQKGGMSGSDPELHVTVRVEPDPEIPCFSSTASPECSPQVFQVQGNTKTAVFTCQFGARSFNFGDR

SEQ ID NO: 6605 - protein, 246 aa, Oryza sativa
MPRSLQQPSNTVQSRRRLITLPETCMNLRDFYSRQIVEKVNRTLDLAKRRGPILHREIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNAVQERMSVASFMCPCNSAVISPARKLVADGDAPVYRSFTYDEYYKKFWSRNLDQEHCLELFKGQ

SEQ ID NO: 6606 - protein, 292 aa, Pseudomonas aeruginosa
MTRNVTVAATQMACSWDRPANIARAEKLVRQAAARGAQIILIQELFETPYFCQKPNPDYLQLATTVEENAAIAHFQALARELQVVLPISFFERAGRARFNSIAVIDADGGNLGVYRKSHIPDGPGYHEKYYFNPGDTGFKVWQTRYARIGVGICWDQWFPESARSMALLGAELLFYPTAIGSEPHDASISSRDHWQRVQQGHAGANLMPLVASNRIGREEQDGYDITFYGSSFIADPFGEKVEELNRTEEGILVHTFDLDALERTRSAWGVFRDRRPNLYGPLKTLDGSLES

SEQ ID NO: 6607 - protein, 124 aa, Glycine max
  misc_feature (74)..(74): Xaa can be any naturally occurring amino acid
  misc_feature (87)..(87): Xaa can be any naturally occurring amino acid
  misc_feature (112)..(112): Xaa can be any naturally occurring amino acid
MKPQGFTSFQTVKRAASTRQLMRVRSIIRHARPTVNDLGPPPPFVGGLDSSLVDAVVNRYLAEFEFARQWGSQXQTLRIGLKGSRNXKIPKEAANYLGTRHQELNYSLQKKXHSQEENITHIET

SEQ ID NO: 6608 - protein, 206 aa, Griffithsia japonica
GTRIARTAFAGAAVSRAAAPAKARFSMDASASVPFLERPPKLDGSLPGDVGFDPCGFSNAFELNFLREAELKHGRICMLAILGWVFPELVGHLPNEAYSATNPLYAVGSVGWLPIIQILAFIAICEAKGVAKVYDENCANPGNYGFDPFGLTANPKTKQHYELAEIKNGRLAMCAIGGAIHHALLRNVGLVEQITSGKWFGGYYLH

SEQ ID NO: 6609 - protein, 72 aa, Unknown
  marine gamma proteobacterium HTCC2080
MAKEDQIEMEGEIIDTLPNTTFRVRLENGHVVTAHISGKMRKNYIRILTGDKVRVEVTPYDLTKGRITYRER

SEQ ID NO: 6610 - protein, 508 aa, Gloeobacter violaceus
MPGTVYLVGAGPAGAEYLTVRGRELLEQAEVVLYDDLADPHLLKLASAAQLIDVGKRAGRPGADQGEIGRLLVTHCQAGRRVVRLKAGDPLVFGRAAAELGALVAAGCNFEIVPGVSSALAACAFAGIPLTDRALGRHFCVMSGHDIGTLPWQHLAHIDTLVILMGTRHLEAIAEQLMDYGRPAAMPVAVIFWAGRSEQRTVVGTLEDIASRVAPSGEPAVIVVGPVVRRRECFDWFDRRALFGKHILVTRAADQAGGFSAQLEALGASVLEMPALVVTAPTSWEPLDRAIAQLAGYRWLLLTSANGVEAFFARLTHHRRDLRALGGVRVAAVGPKTAQAARTHGLICDFVPGQYVSDGLLTDFPDIAGIYGERVLFVRVESGGRETITEQFRRWGALVDEVAGYATGCPDSAEPGCVAALRAGRIDCATFASAKTVRHFARLLQGEELESLLRKVRIASIGPQTSAACRETLGRVDVEAEVFTLDGLAQAIVADLGTGRATGPTDEQ

SEQ ID NO: 6611 - protein, 125 aa, Triticum aestivum
MGTAVATAYTMARENEEDGSTVFRPGTAASSPVRTVVALALWLGAIHFNLLLVLASVFVFPGRIAALVLGTQLLFMFAPVSNTNGWGRNIARFICKHAADYFPITLHVVDYNAFDPNTAYGLLYY

SEQ ID NO: 6612 - protein, 316 aa, Mannheimia succiniciproducens
MTIFADNSYSIGNTPLVRLHNFGHNGNLVVKIESRNPSFSVKCRIGANMVWQAEKDGVLTKDKEIVDATSGNTGIALAYVAAARGYKITLTMPETMSLERKRLLRGLGVNLVLTEGAKGMKGAIAKAEEIVASDPNRYIMLKQFENPANPAIHQQTTGVEIWQATEGKVDVVVAGVGTGGTITGISRAIKLDQGKQITSVAVEPAESPVITQILAGEEIKPGPHKIQGIGAGFIPKNLDLSLIDRVETVDSDTAIKTARRLMAEEGILAGISSGAAVAAADRLAKLPEFQDKLIVAILPSASERYLSTALFEGIEG

SEQ ID NO: 6613 - protein, 76 aa, Glycine max
  misc_feature (2)..(2): Xaa can be any naturally occurring amino acid
SXTPGWISDITAMMPAQAHSSAVEERLLEGMSQYQNVVGFHGSTYGNVLDMEGGIQLTITGQCADHEMITHLPLVH

SEQ ID NO: 6614 - protein, 68 aa, Rubia tinctorum
GEVMPGQWEFQVGPSVGIEAGDHIWCARYLLERITEQAGVVLTLDPKPISGDWNGAGAHTNYSTKSMR

SEQ ID NO: 6615 - protein, 342 aa, Gossypium hirsutum
MRNAIMHSTMLLLLSGLLLAIFKTTGAEVGVCYGMKANDLPPAAEVIDLFKQKGIKRMRLYDPNPDALQALGGTNIELLLDLPSANLESVAASQANADQWVEDNIKKYNTVNFRYIAVGNEVKPTDSFAQSLFPAMQNIRTAIVNAGLGDQIKVSTATFFAAIDKSSFPPSKGSLDPEYQKLLGQVITFLRDNQAPLLVNTYPYFSHIGDPEHVPLDYALFTAPSAVVQDGSLQYQYLFDAMLDTFYSALEKAGGVSVDIVVSETGWPSDGGQATSVDNAMTYNTKLVQHVNQGKGTPKKPEKAIVAYLFAMFDENEKEPAYEKHWGLFFPKKQEKYSISFN

SEQ ID NO: 6616 - protein, 68 aa, Calycophyllum candidissimum
GEVMPGQWEFQVGPSVGIEGGDHIWCARYLLERITEQAGVVLTLDPKPIQGDWNGAGCHTNYSTKSMR

SEQ ID NO: 6617 - protein, 165 aa, Roseovarius nubinhibens
MEERALLAGGSFWGLQHLLRDLDGVLSSRVGYTGGDSARPTYRDHGTHAEAVEIRFDPRVLGYRALLEYFFRIHDPTTPDQQGPFIGLSYRSAIYYMNDPQKFEAIRTIADINGSGVWPAKLVTEVLPAGEFWEAEPEHQDYLQRVPDALCSHHLRRHWVLPRKR

SEQ ID NO: 6618 - protein, 1170 aa, Vibrio fischeri
MMKITIDKQTFTIDEEITLLAAAKECNVEIPSLCGNNINGEKVPCDLCVVEIEGQGIQRACETQAVDGMQVITSSEALVKRRQSALNKILSDHYADCEAPCQTACPAGVDIQSYLYHISQDNHQKAIEVIKRTLPMPLSIGRVCPAFCEAECRRGLVDEPLAIRQLKRHAADVDLHAQESYVPPKKADKGKSIAVIGSGPGGLTCGYYLTNEGYSVTVFESMPKAGGWLRYGIPEYRLPKSILDKEIELMCRNGMEIQTSVKLGEDFSLTQLSDEYDAVCLAVGASKAVEMHYQGSELGGCYLGVDYLKDYVTESKLTTGKKVAVIGGGNTAIDCARTAVRDGADTTLIYRRTREEMPAEDYEVVEAEHEGVKFHFLTNPVENIADENGRVAQVRLEKMALGEPDASGRRSPQATGEFFIEEFDTVISAVSQKPDLSFLENDTIDLPLTRWNTADANSLTMHSGVKNIFSIGDFRRGPATAIEAVADGRIAAEAIDRFFNGDMEKIPTKPFNSQKEKKTKQVDPKHFEHIQKAMRVIMPELTAEQREQSFDEVETGFDNLDAIREAERCLECACQANTNCGLRDYATEYKADETDLSNESKQKFAIDTSSEFIVFDANRCISCGQCVEACNEKGVHGVLSFMKNEDGTNASRPECRAGFEHGYQMGNSNCVQCGACVQACPVGALVDSRDKSQGRIEVLKPVDTICTYCGVGCKLTMMVDESTNKIKYVQGAKSSPVNEGMLCVKGRFGFDFVSSDERLKTPLIRKNGELVPASWEEAITLVADKFSTIKSQHGGNALAGFSSAKTTNEDNYAFQKLVRREFETNNLDHCARLCHSTTVTGLEASIGSGAMTNDIPSIKHSDLIFIIGSDTTSAHPIIASHIKQATRHHGARLIVADPKQVDISDHAELYVAQRPGTDVMLLNGIMQQIIKNNWHDQAYIAERVEGFDELKAEVMSEAYSPEKIELITGVKAQDVIEMARYIGTAKRTAIYYSMGITQHTTGHDNVRSIANLQMLCGNIGIEGGGINPLRGQSNVQGACDMGALPTDFPGYQKVENPAVYEKFVKAWNKPTLPSKKGLTLTEIIDAACHEQVKGLFVMGENPVLSDPDQAHVIHGLEKLDFLVVQDIFMTETAAYADVILPSCSFAEKAGHFTNTERRVQRISPAVNPPG

SEQ ID NO: 6619 - protein, 66 aa, Ixora parviflora
GEVMPGQWEFQVGPSVGIEAADHIWCARYLLERITEQAGVVLTLDPKPIEGDWNGAGCHTNYSTKS

SEQ ID NO: 6620 - protein, 364 aa, Cryptococcus neoformans
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPRKELDKAGGNKKGRVEIIQLDLTDLASVEKCAEEFLNKEKKLDLLFANAGIMATPEGQYTKQGYTLQFGTNTLGHHRLITLLLPLLLSSPPSLPSRVILTSSAGHSMAPKGGVNFKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 6621 - protein, 50 aa, Chiococca alba
GEVMLGQWEFQVGPSVGIEAADHIWCARYLLERITEQAGVVLSLDPKPIE

SEQ ID NO: 6622 - protein, 384 aa, Legionella pneumophila
MNKSDSFYNLETIGGILLFIAAVLAIIIANSPYRIGYDYFLSINGSVSVGNLSITKPLLLWINDGLMAIYFLLIGLEIKREVNRGILSDKTNLLVPALTALAGLLFPALIFIFFNAHHPVYLKGWAIPTATDIAFTLGIVSLLGSRVPFSLKILLTAIAIFDDIAAIVIIALFYTEQLSLLSLSLALVFTLILIGLNYFKCRRISVFMLFGVALWIAVLKSGVHATLAGIVIAMTIPDEGKESMLTRLEDGLHHWVVFLILPLFAFANAGVSFVGLDASMLTHPVVLGIGLGLFLGKQLGIFLSLGYFVQFKKFLKADKVNLAQVYGIALICGVGFTMSLFIGSLAYQNYDLSLMPMVKIGVVFGSFIAGLTGFLVLKMTSLKR

SEQ ID NO: 6623 - protein, 379 aa, Triticum aestivum
  misc_feature (260)..(260): Xaa can be any naturally occurring amino acid
  misc_feature (269)..(269): Xaa can be any naturally occurring amino acid
MASALGAQVAAVAPIGSDGRHYRSCSSLKGNNSRNKSWTGKLAWENKTLQPRHTKKVFCMSVQQASKSKCKVAIKPLELENTKEPPLNLYKPKGPYTASIVSVERIVGPKAPGETCHIVIDHGGNVPYWEGQSYGVIPPGENPKKPGAPNTVRLYSIASTRYGDSFDGRTASLCVRRAVYYDPETGKEDPSKKGICSNFLCDSKPGDKIQITGPSGKIMLLPEDDPNATHIMIGTGTGVAPFRGYLRRMFMEDVPSFKFXGLAWLFLGXVANTDSLLYDEEFTNYLQQYPENFRYDKALSREQKNKSGGKMYVQDRIEEYSDEIFKLLDDGAHIYFCGLKGMMLGIQDTLKRVAEQRGESWDQKLSQLKKNKQWHVEVY

SEQ ID NO: 6624 - protein, 238 aa, Porphyra purpurea
MKNQIQVQLSKLKETSNSENAIKKQLEIIETIEYNDYLQLKKLAEIFHYRITKPEYISNCVDGLIYEKLLNSQNSEIIKFTSKLCPKGIVPLKSNKQMDYQDLQILLVQNNLIAADKLTQQKLIKLAGVDEKSRNWLYFTDIKKIPVEDLQTIDQLWNAHSKGKFGFFVQRQIWLALEKNWEQFWYKIGWEINRVPCRYPEEFHWNSTGPKGHLPLCNQLRGVQVLSALFSHKAWDNY

SEQ ID NO: 6625 - protein, 140 aa, Triticum aestivum
  misc_feature (79)..(79): Xaa can be any naturally occurring amino acid
  misc_feature (88)..(88): Xaa can be any naturally occurring amino acid
MAARSLSGAVKSLCSAASGSLSCSIVLRRSYVATSQNVTAARLSKGGSTRVMVGKMEQRGLDQEAESAWGPDPVTGYYXPSNRAAEIXDPAELRELLLEKQSKVFLRILIGWLTWVPVGRWSKANLMIMGVYVCLACAIQ

SEQ ID NO: 6626 - protein, 470 aa, Bifidobacterium longum
MRMYAAPSSEGAALISPAIFGAIWVETGNAAHCGLLLFFMSDELSPEVFDAVCRQADQAARAQERLAQANTEAKNELLLAIADALDEHAADIEAANALDMLESKENGMDAGKLDRLLFDVPRVAAAAQGVRHVATLPDPVGEIVRGYNLPNGLRLTQTRVPMGVIGMIYEARPNVTVDVASLCLKSGNAALLRGGHAAERTNAATLGVIAPVLEAHGFESALVQSVDQYGRAGATAMMEARGHIDVLVPRGGAGLIQAVVRNSKVPVIETGAGNVHIYIDKSGDLAKAIPIIINAKTQRVGVCNAAEKLLVHKDVAAEFLPQIAAALAEANVVLQTDTTSYGIISGAAIEGLDLNHAAEEDWDTEYLALKMGIKVVSDLDAAIDHINTHSTGHTESIIAEDYAAIEEFTKRIDSAVVMVNASTRFTDGGVFGFGAELGISTQKMHARGPMGLREMTTTKWIGYGTGQVRA

SEQ ID NO: 6627 - protein, 309 aa, Methanococcoides burtonii
MENIYEDITKTVGKTPLVRLNRITVGCYATVLVKVEAFNPLGSIKDRIALNMIETAEKDGMLKKGAIVIEPTSGNTGIGLAFVCATKGYRLILTMPETMSVERRNILKVLGAEIVLTPGPNGMKGAIEEAERIGKETPDSFIPHQFMNPANPDIHRCTTAGEIWDDTGGKVDILVAGVGTGGTITGVSEELKSRKPGFKAIAVEPKDSAVLSGGSPGPHMIQGIGAGFVPDVLNVDIIDEIITVSNEDAFETTRELAKKEGILAGISSGAALFAALDVARRKENEGKMIVVVLPDTGERYLSTTIVEKE

SEQ ID NO: 6628 - protein, 963 aa, Vicia faba
MEPFTRDHRGSLEVFNPSSSETNGTPNPNPNPNPSNSWNTGTSSRGTEAPPLRDSIISDEVPTATSWMALKETTPSPKSGESGSVAEQRAAEWGLVLKTDSETGKPQGVGVRGSGGGGGSRRDSNNSVRSSGESSDDGREGGRGIPRVSEDLRDALSAFQQTFVVSDATKPDYPIMYASAGFFSMTGYTSKEVIGRNCRFMQGADTDPNDVAKIREALAAGTSYCGRLLNYKKDGTTFWNLLTIAPIKDEHGKILKLIGMQVEVSKHTEGTKEKMLRPNGLPESLIRYDARQKEKANSSVTELVEAVSKRPRSLSESANRLPFNKKPTNGSNDHATPPNSESSSRKSGSTLRSFRRKSHSGAGNSNSMHPITELPENNNKSRRRSFMGFMRKSLSNNERFNHEQVIDRNSSEDEDRLDSFDEQNIAQKREKRKGFDLATTLERIEKNFVITDPRLPDNPIIFASDSFLELTEYSREEILGRNCRFLQGPETDPATVKKIRYAIDNQTEVTVQLINYTKTGKKFWNLFHLQPMRDQKGEVQYFIGVQLDGSQHVEPLHNGIAEDTAKEGENLVKKTAENVDDALRELPDANMKPEDLWMNHSKVVHPKPHRREDSAWRAIQKIMESGEQIGLKHFKPIKPLGSGDTGSVHLVELCGTDHHFAMKAMDKGVMPNRNKVHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPELIVPSTNDKKKGQHGPIFMAEPMRASNSFVGTEEYIAPEIITGSGHTCAVDWWALGILLYEMFYGYTPFRGKNRQRTFANILHKDLKLPKSKQVSLSAKQLIYHLLQRDPTSRLGSKGGANDIKHHSFFKGINWALVRCTKPPELDAPLFDTNKEEKEKDDKYVDNGQEDMSVF

SEQ ID NO: 6629 - protein, 87 aa, Wolbachia endosymbiont
MIKDEKSKTIFEVEGAVTALLPAAEFRVKLDNEHEIICHVSGKVRRSKIRIIIGDRVLVEMSIYDRNARKGRIIRRLKGTSDRTISK

SEQ ID NO: 6630 - protein, 317 aa, Unknown
  marine gamma proteobacterium HTCC2080
MSQPQHHRLIILGSGPAGYTAAIYAARANLNPVVITGIQQGGQLTTTTEVENWPGGASDLQGPQLMVEMQAHVERLDAAILFDHIEKVDLDSRPFRLGGSQDYTCDALIIATGASAQYLGLPSEEAFMGRGVSACATCDGFFYRGKEVAVVGGGNTAVEEALYLSNLCSRVHLVHRRDSLRSEKVLQDRLFAREKEGKVVIHWHQTLDEVLGDNSGVTGLRLRSTLDNSAKELELAGVFIAIGHKPNTDIFDQQLSMEGGYIQVNSGVDGEATHTSVPGVFAAGDVADHIYRQAITSAGFGCMAALDAEKYLDELNS

SEQ ID NO: 6631 - protein, 878 aa, Ostreococcus tauri
MASVRGGTTSMDRVPSTSSLNDGPVTTSDVHVLVVDDERICRTVTSSLLRRCGYRVTMAESGEEALELLRRGTEFHMLLTDVMMPGIDGPALLQIVRNDERLRDMPVVMMSANEHSDTVFRCIQHGAEDYLLKPVSRRAVKHMWTHVWRKSQVNVSRTVPQLGEDGEELLEDDEDRGEMVHGVPSVPQHGEEVTNSGEYNVIDRVHSPAGMRRNVSMLSLASAGLSTKASLFSAPVQTEGEDVSQKEEATMDIDEDVGKSNIQIVPEPVVHSLPPPLAGLETGARCLREWLDDETSGAQATRKEERWHVAWRITAFVDGLKYGTSAASYDMFDANCLNISPQGDITFAAKAHNEERSFVELAQELDDRDALFVVGLIILNMFWPEVFITVYEAEYPEKALTQVLAMSGFAKQAMTGEFEAAKVVVNHDLDVTGFEAARKRARKESTSGATEVGVSCYDDGTLMHKNLNSVVKSAFRSAKSLERQVFEDLEISLFDKCIVAMRQTSPSDCDSDGAWLKRVRENVGGSGYSVCNALDDFESEIRLVTRSVSLKRCASIGGDVTDFVANNSMVCCASWDRDGELFATAGTSRSICVYEADAVMKLGARVHCPAVEFEANDKVSSLCFNHYVKQSIASGDYQGVVQLWDVHKEVSTWENNTHRRRVWSLDFSSIDPTKLASGSDDGTVRVFSTTTKEATCTIQNHANVCSVRFHPTAPHLLAIGSANHKIHCYDLRQLNNPLLTLQGHRKAVSYVYWVGDELLSASTDNTLKLWDVKRNNPQTACVRTYTGHTNEKNFVGLSANADGYIACGSEDNVVHLYAKHSSVPVSSYSFSDKPAPVTQHRRDKAGFISSVVWSPDSKHLLAANSKGHLKILALSKSV

SEQ ID NO: 6632 - protein, 421 aa, Ehrlichia ruminantium
MVRYISDYDLQDVDTEVFKCITDESNRQNSQLQLIASENFVSKAVLQAQGSIFTNKYAEGYPGKRYYCGCHFADIIENIAIERLCKLFGCKFANVQPHSGSQANQGVFAALLKPGDTVIGMSLDCGGHLTHGSAPSISGKWFNAVQYQVDRDTGMIDMDAIEKLALSHNPSLIIAGSSSYPRTIDFKRFREIADKVGAYLLADIAHYAGLVAAGEFPSPIEYAHVITSTTHKTLRGPRGAVIMTNHEDIYKKIQSSIFPGMQGGPLMHVIAARAVAFGEALKPEFKDYAKQIIKNSKTLVKVFQERGLNVVTGGTDSHMVVVDLRPKSVTGKDAVLALERLGIICNKNAIPFDPEKPFVTSGLRFGSAAETSRGLQEPEFEKIGHMVCDVIDSLKTTDDVRLSIEQDVIRRVKELTDTFKV

SEQ ID NO: 6633 - protein, 419 aa, Yersinia pestis
MNLLEHMGKAAKQASWQLAMLSTAKKNQALAVIANLLESESQTILQANERDMAAARESGMSEALLDRLLLTPARLAAIANDVRQVCRLNDPVGRVIDGSLLDSGLKLERRRVPLGVIGVIYEARPNVTIDVASLCLKTGNAVILRGGKETHYTNQATVNVIQRALEQCGLPAAAVQAIESPDRQLVNELLRLDRYVDMLIPRGGASLHKLCREQSTIPVITGGIGVCHTFVDENADFEKALLVIENAKIQRPSACNSLETLLVHQAVAKTFLPLLSARMHAFGVTLHASPLAMPYLADGKAKVVAVEAADYDDEWLSLDLNVDIVTDIDAAIDHIREHGTSHSDAILTRSLSHAEYFVRAVDSSAVYVNASTRFTDGGQFGLGAEVAVSTQKLHARGPMGLDALTTYKWIGYGDDLVRS

SEQ ID NO: 6634 - protein, 493 aa, Bacteroides fragilis
MEKKLKSWQGWLLFCGAMAVVFVLGLVVSSLMERRAETVSVFNNKRVEITGIEARNEVFGENYPRQYETWKETAKTDFKSEFNGNEAVDVLEQRPEMVVLWAGYAFSKDYSTPRGHMHAIEDITHSLRTGAPMDDKSGPQPSTCWTCKSPDVPRMMEAIGVDSFYNNKWGAFGSEIVNPIGCADCHEPTNMKLHISRPALREAFARQGKDIDKATPQEMRSLVCAQCHVEYYFKGDGKYLTFPWDKGFSVEDMEAYYDEADFADYTHALSKARILKAQHPDYEISQMGIHAQRGVSCADCHMPYKSEGGMKFSDHHIQSPLAMIDRTCQVCHRESEETLRNNVYDRQRKANEIRGRLEQELAKAHIEAKFAWDKGATDVQMAEALKLIRQAQWRWDFGVASHGGAFHAPQEIQRILGHGLDKALQARLAISKVLAQHGYTADVPMPDISTKEKAQEYIGLDMEKERKAKDKFLKTIVPEWLEKARANGRLAKL

SEQ ID NO: 6635 - protein, 219 aa, Unknown
  Mesorhizobium sp. BNC1
MFFQTSEKKLRLPSPQEALPGRPQPIATAEHHFVNGRPLKGPYPEGAEQVLFGMGCFWGAERLFWQMEGVWVTAVGFAGGLTPNPTYRETTTGLTGHAEVVLVVYDPKVVSFSALLKVFWESHDPTQGMRQGNDVGTTYRSVIYATTDAQLHEAEASRDAYEKALRGAGRDRVTTEIDRAPTFFFAEEEHQQYLAKNPGGYCGLQGTGVACPMPGASVQ

SEQ ID NO: 6636 - protein, 367 aa, Yersinia pestis
MSGSQTLVVKLGTSVLTGGSRRLNRAHIVELVRQCAQQHAKGHRIVIVTSGAIAAGREHLGYPELPATIASKQLLAAVGQSRLIQLWEQLFSIYGIHIGQMLLTRADLEDRERFLNARDTMNALLDNRIVPVINENDAVATAEIKVGDNDNLSALAAILASADKLLLLTDQAGLYTADPRNNPEAELIREVHGIDDVLRGMAGDSVSGLGTGGMATKLQAADVACRAGIDVVIAAGSQVGVIADVIDGTPVGTRFHSLETPLENRKRWIFGAPPAGEITVDDGAVFAIMERGSSLLPKGIRSVKGDFSRGEVIRIRNLNGRDLAHGVSRYNSDALRMLAGHHSQQISEILGYEYGPVAVHRDDMIVS

SEQ ID NO: 6637 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQDLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 6638 - protein, 625 aa, Kineococcus radiotolerans
MVGPLHRARRADRGRVRVGRARLRAPGPPRRTRSRLLRAVLTVDLPVPGLQERGGLRNDPQWYKTAVFYEALVRAFADSNGSGTGDFSGLTAKLDYLQWLGIDCLWLPPFYASPLRDGGYDISDYNAVLPEFGTLHDFQRLVTEAHQRGIRIVIDLVMNHTSDQHPWFQASRSDPEGPYGDFYVWSDTDEQYPDARIIFVDTETSNWTFDPVRRQFFWHRFFSHQPDLNFDNPAVEEAMFDTVRFWLDMGIDGFRLDAVPYLYVREGTNGENLPETHDYLHRLRRMVDEEYPGRVLLAEANQWPFDVVEYFGTEEAPECHMCFHFPVMPRLYYALREGRATPITEILSATPDIPTSSGQWGTFLRNHDELTLEMVTTEERAAMYGWYAPDPRMRANVGIRRRLAPLLDNSRPEIQLIHALVLSLPGSPCLYYGDEIGMGDNIWLDDRDAVRTPMQWTPDRNSGFSSADPGKLYLPTIQSLVYHYQSVNVEAQLATGSSLLHWVRNVLAVRRAHPAFGRGRYLPLPTRDDPRPDDGSCSNEAVLAFLRVLDPTPEEEGETVLCLNNLSDHPQAAVLRMPGQAGATARDVFGGAAFGEVDAEGTLTVMLGSRGFYWLALTGGRGVGA

SEQ ID NO: 6639 - protein, 160 aa, Prochlorococcus marinus
MTLDLEAKKVLLRKIPHGIFICTVREGDEINGFTASWVTQGSFAPPLVVMAVRSEGSSHGIIQRTNQFSLNVLRADQKELAAVFFKPQKGLGGRFEAAPYNFGENGLPLLEDAIGGIECNVVGNVANGDHTVFVAEVISAKLNADGDPLILSDTGWSYGG

SEQ ID NO: 6640 - protein, 140 aa, Triticum aestivum
  misc_feature (38)..(38): Xaa can be any naturally occurring amino acid
  misc_feature (42)..(42): Xaa can be any naturally occurring amino acid
  misc_feature (44)..(46): Xaa can be any naturally occurring amino acid
  misc_feature (48)..(48): Xaa can be any naturally occurring amino acid
  misc_feature (52)..(52): Xaa can be any naturally occurring amino acid
  misc_feature (54)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (64)..(65): Xaa can be any naturally occurring amino acid
  misc_feature (92)..(93): Xaa can be any naturally occurring amino acid
  misc_feature (98)..(98): Xaa can be any naturally occurring amino acid
  misc_feature (100)..(100): Xaa can be any naturally occurring amino acid
  misc_feature (102)..(104): Xaa can be any naturally occurring amino acid
  misc_feature (108)..(109): Xaa can be any naturally occurring amino acid
  misc_feature (112)..(114): Xaa can be any naturally occurring amino acid
  misc_feature (120)..(120): Xaa can be any naturally occurring amino acid
NCSYQVTCAKSPRQVINVLNCEGAEIDIILAEVDLPFXNCFXMXXXIXRNKXLXXIPIXMXSNXXKVSVVVNCLRLGAPDYLLKPLHMNDLXXLWTHXWXRXXXLGLXXKNXXXDTLDLXLSELVIQYNSTHFGTDPPID

SEQ ID NO: 6641 - protein, 352 aa, Glycine max
LEPNRLERLESIFTSIAQVLVAAYRKRKVELPREKHVDGVFYDPPLIGTQVLSKLPLTNQFRGLNKAAVIMEGELNPDRSRANKWKLVSIQQVEDVKCLARIFPIWAAGILGFTSMAQQGTFTVSQALKMDRHLGPKFQIPAGSLGVISFITIGVWVPFYDRIMVPTLRRVTKHEGGITLLQRIGIGMVFSILSMVVAALVEKVRRDLANANPSPLGIAPMSVLWLVPQLVLMGLCEAFNVIGQIEFFNRQFPDHMRSIANALFSCSFAGASYVSSALVTTVHHVTRTHSHPDWLTNDINAGRLDYFYYLVAGTGVLNLVYFLIVAQRYHYKGSGDLQDNAQDVELASKGKS

SEQ ID NO: 6642 - protein, 66 aa, Guettarda uruguensis
GEVMLGQWEFQVGPSVGIEAGDHIWCARYLLERITEQAGVVLTLDPKPIEGDWNGAGCHTNYSTKS

SEQ ID NO: 6643 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVAVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 6644 - protein, 175 aa, Oryza sativa
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 6645 - protein, 68 aa, Cephalanthus occidentalis
GEVMPGQWEFQVGPSVGIEAGDHIWCARYLLERITEQAGVVLSLDPKPIEGDWNGAGCHTNYSTKSMR

SEQ ID NO: 6646 - protein, 244 aa, Enterobacter aerogenes
SIGGNKPRKLEFLAAGALREGADTLITAGAIQSNHVRQTAAVAAKLGLHCVALLENPIGTHAENYLTNGNRLLLDLFNVQVEMVDALTDPTAQLDELATRLEAQGFRPYVIPVGGSNALGALGYVESALEIAQQCEGAVNLSSVVVASGSAGTHAGLAVGLEQLLPDVELIGVTVSRSVADQKPKVVTLQQAVAEQLELKAKADILLWDDYFAPGYGTPNEEGMEAVKLLARLEGILLDPVYTG

SEQ ID NO: 6647 - protein, 169 aa, Zea mays
MVSPESQTDARKENIHSDVAETDECTKTQKAALAGTEGENSAEDSGVPVSEMDKCNEMPKDAPTLTAAGANPAEDEASLKDLSVQTENKASSASPAPDDPKASDEKTLAEENQKLKELLQKLLASGNDQMGVITDLSEKVKVLERKLARKKRPKVRVHRSSRHATAKVQ

SEQ ID NO: 6648 - protein, 593 aa, Mycobacterium smegmatis
MEEHTQGSHVEAGIVEHPNAEDFGHARTLPTDTNWFKHAVFYEVLVRAFYDSNADGIGDLRGLTEKLDYIKWLGVDCLWLPPFYDSPLRDGGYDIRDFYKVLPEFGTVDDFVTLLDAAHRRGIRIITDLVMNHTSDQHEWFQESRHNPDGPYGDFYVWSDTSDRYPDARIIFVDTEESNWTFDPVRRQFYWHRFFSHQPDLNYDNPAVQEAMLDVLRFWLDLGIDGFRLDAVPYLFEREGTNCENLPETHAFLKRCRKAIDDEYPGRVLLAEANQWPADVVAYFGDPDTGGDECHMAFHFPLMPRIFMAVRRESRFPISEILAQTPPIPDTAQWGIFLRNHDELTLEMVTDEERDYMYAEYAKDPRMKANVGIRRRLAPLLENDRNQIELFTALLLSLPGSPVLYYGDEIGMGDIIWLGDRDSVRTPMQWTPDRNAGFSKATPGRLYLPPNQDAVYGYHSVNVEAQLDSSSSLLNWTRNMLAVRSRHDAFAVGTFRELGGSNPSVLAYIREVTRQQGDGGAKTDAVLCVNNLSRFPQPIELNLQQWAGYIPVEMTGYVEFPSIGQLPYLLTLPGHGFYWFQLREPDPEPGAQQ

SEQ ID NO: 6649 - protein, 120 aa, Unknown
  Platanus x acerifolia
LLQTNVKWPLGWPVGGYPGPQGPYYCGAGADKSFGRDISDAHYKACLYAGINISGTNGEVMPGQWEYQVGPSVGIEAGDHIWCSRYILERITEQAGVVLTLDPKPIEGDWNGAGCHTNYS

SEQ ID NO: 6650 - protein, 475 aa, Prochloron didemni
MSKLILFWHRRDLRISDNMGLAAARKQSSKIVGLFCLDPNILNSNEVAPARVTYMLGCLQELKESYSKIGSQLLIVRGEPIEAIPQLAVALQVTGVFWHKDGEPYARERDGKVEQELLKQGIAVTNYWDQLLHPPEDILTQSGKPYTVYTPFWKNWSQKPKLEVAEKLDRIQGLTAEEIKIAQETGVVSLPTGKDLGYYWDGELILTPGETAAREQLEEFSERAIAQYQEQRNFPAVEGTSLLSPALRFGVIGIRTVWQATLEATKNSYSEEVRANIETWQKELAWREFYQHALYHFPQLTVEPYRQQFKDFPWDNNPEHFQAWCEGKTGYPMVDAAMRQLNETGWMHNRCRMIVASFLTKDLIINWQWGEQYFMQKLCDGDLASNNGGWQWSASCGMDPKPLRIFNPASQAKKFDPEGEYIRQWLPELSSIDTEYLVRGKIPDDERERCDYPQPIVDHNLRQREFKRRYKELSP

SEQ ID NO: 6651 - protein, 970 aa, Vicia faba
MEKHLKKSPSSSSSSSMRPSFPRDPRGSLEVFNPTSNTSSPVRSPSNLKNWTETEEPRNEFPDKVTNTSWMAIKEGETGAAVQRAAEWGLVLTTDAETGKPQGVAVRHSGGDEPNAVELESKRNSNNTVRTSGESSDGGDPRGFPRVSDDLKDALSAFQQTFVVSDATKPDYPILYASAGFFKMTGYTSKEVIGRNCRFLQGADTDPNDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRAMSESGHRPFIRKSGGGGSSEEDERLENKSRRKSDSVASFRPKPQGKIRHSMERISELPENKQKNSRRGSFMGFMRKSHSIDESIDNEVIVDVSSGSEDDERDDSFEFDDKEKLKEKRKGLDLATTLERIEKNFVITDPRLPDNPIIFASDSFLELTEYSREEILGKNCRFLQGQETDPATVRKIREAIDNQTEVTVQLINYTKSGKKFWNLFHLQPMRDHKGEVQYFIGVQLDGSQHVEPLHNCIAEESAKEGELLVKETAENVGEAVKELPDANQKPDDLWKNHSKVVRPKPHRKDDDAWRAIQNVVGNGEQVGLKHFRPIKPLGSGDTGSVHLVELEGTGHYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQRNGHVSLTDFDLSCLTSCKPQLILPATEEKKKRKNKKKKGQPKNQEVPMFMAEPMRASNSFVGTEEYIAPEIITGSGHTSAVDWWALGILLYEMLYGYTPFRGKTRQKTFGNILHKDLKFPKSKPVSPHGKQLIYWLLHRDPKNRLGSLEGANEIKNHPFFKNVNWALVRCMKPPELDAPILLDNDEKKEAKDIDPGLDDLQKNIF

SEQ ID NO: 6652 - protein, 245 aa, Medicago truncatula
MGVVGSGQMAPYGSNPYQPNPMTGSPGMVVPSVGTIQPGGQPDGTQLGQHQLAYQHIHQQQQQQQQQQLQTFWGNQYQEIEKVTDFKNHSLPLARIKKIMKADEDVKMISAEAPVVFARACEMFILELTLRSWNHTEENKRRTLQKNDIAAAITGTDIFDFLVDIVPREDLKDEVLASIPRGPMPVGGPADGIPYCYMPPQNAQQAGNPGLMMHNPNMYAPQSHPYMAPQMWPQPPEQQQSPSDH

SEQ ID NO: 6653 - protein, 452 aa, Dactylis glomerata
MAQEEKEKPDESTSSRRPQAKETKPNPAPEPEPEMATVAMDISKPPPAAAGDDSAKGARAGGEGLRQYYLQHIHDLQLQIRTKTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSTTMNLMRGIDLKKIAGKMNGASGAELKAVCTEAGMFALRERRVHVTQEDFEMAVAKVMKKDNEKNMSLRKLWK

SEQ ID NO: 6654 - protein, 297 aa, Bacillus cereus
MQVGLIGLGKMGLNLGKNLMDHKHEVVAFDLNTSAVEEMKEYGATGTSSLSELVQSLQSPRILWVMVPHAVVDSVIDEVTPLLSKGDILIEAGNSHYKESIRRYEQLKEDGIHFMDAGTSGGMEGARNGACYMIGGDQEAWDIVEPIFRDTAVENGFLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 6655 - protein, 282 aa, Atropa belladonna
  misc_feature (15)..(15): Xaa can be any naturally occurring amino acid
  misc_feature (24)..(24): Xaa can be any naturally occurring amino acid
EVMVGLPNSDVKHIXSGMEHAKWXVQKNVKDFWPDVKIKYIAVGNEISPVTGTSYLTSFLIPAMVNIYRAVGEAGLGNDIKVSTSVDMTLIGNSYPPSQGSFRNDARWFTDPIVGFLRDTRAPLLANIYPYFSYSGNPGQISLPYALFTAPNVVVQDGSRQYRNLFDAMLDSVYAAMHRSGGGSVGIVVSESGWPSAGAFGATTDNAATYLRNLIQHAKKGTPRKPGPIETYIFAMLDENNKNPEVGETFWIVFHPTSSPNTNSSWRISAETSVTASLKSDM

SEQ ID NO: 6656 - protein, 480 aa, Unknown
  Mesorhizobium sp. BNC1
MAGETAKLNAFPVFLRVEGRRVVIVGSGGEALAKARLMAQSSAEILIVAEKPEPALAAWAAENGAALTRSSYNPALLDGAVLVFAATGDEEADRAVVADARERSIPVNAVDRPELCDFFTPALVNRAPVAVAIGTEGAGPVLAQMIRARIDQMLSPSLGRLALLAASYRAAVEHRLAKGVVRRRFWKAFFTGGPACAVEAGNADRAAWAAEMLLDSQGVEPGHVALVGAGPGAEDLLTLRAQRLLMEADVIVHDALVPEAVVAMGRRDAERIAAGKRKGCHSKTQAEINELLVALGRNGKRVVRLKSGDPLIFGRAGEEIAALREAGISYEVVPGVTAAFAAAADFELPLTLRGIASSLVFTTGHDLKGQALPDWAKLAIDGATVAVYMGRSTAAEVAQHLQEAGLSPDTAVAVVENASLGNRRLFHGTLSDLPALGRRADLSGPVLTIIGDAVAGANLARSEPLAAYHEHGARTPAEEE

SEQ ID NO: 6657 - protein, 503 aa, Pectobacterium carotovorum
MSNSFCVVYKGSDTDINNIQRDFDGKGEALSNGYLFIEQNGHYQKCEMERGTAYLIGSLYNRTFLIGLAGVWEGEAYLANDAELLALLFTRLGANALALAEGDFCFFIDEPNGELTVITESRGFSPVHVVQGKKAWMTNSLKLVTAAEGEGALWFEEEALVCQSLMRADTYTPVKNAQRLKPGAVHVLTHDSEGYSFVESRTLTTPASNQLLALPREPLLALIDRYLNAPLEDLAPRFDTVGIPLSGGLDSSLVTALASRHFKKLNTYSIGTELSNEFEFSQQVADALGTHHQMKILSETEVINGIIESIYYNEIFDGLSAEIQSGLFNVYRQAQGQVSCMLTGYGSDLLFGGILKPGAQYDNPNQLLAEQVYRTRWTGEFATHGASCYGIDIRHPFWSHSLISLCHALHPDYKIFDNEVKNILREYADSLQLLPKDIVWRKKIGIHEGSSVNQAFANVLGSTVDNYQTKSRFTYRVYQAFLRGRLSITDVTPSQLKDLIKKD

SEQ ID NO: 6658 - protein, 136 aa, Griffithsia japonica
MARTKQTARKSTGGKAPRKQLATKAARKSAPASGGVKKPHRFRPGTVALREIRKFQKSTELLVRKLPFQRLVREIAQDFKSDLRFQSSAVLALQEAAEAYMVGLFEDTNLCAIHAKRVTIMPKDIQLARRIRGERT

SEQ ID NO: 6659 - protein, 605 aa, Glycine max
MTGVETMGKNENQSVEKNEKSVIDEEPKINYRGWKVMPFIIGNETFEKLGTIGTLANLLVYLTTVFNLSSLTATNIINIFTGSASLSTLLGAFLCDTYFGRYKTLGFCTIASFLGLLVIQLTAWIKKMHPPHCGSESITCTGPTTGQMTFLLAGFGLLIVGAAGIRPCNLAFGVDQFNPNTESGKKGINSFFNWYFFTYTFAQMVSLSLIVYIQSNVSWAIGLGIPAALMLISCTLYYTGSNYYVKVKATGPAPLTSLAQAVVVAIKKRRLNLSEYPLDSSLFAYVSPQSINSKLLHTSQFRFLDKAAIITPQDGINPDGSASDPWSLCSMQQVEELKCLLRVIPIWFAGIFFYIAIVQQNTMLVFQALQSDRRILSTNFKILAASYTIFQMLSLTIWLPIYDRILVPSLQRVTKKEGGITVLQRIGFGMFLSILCTMVSGVVEERRRTLALTNPIGLEPRKGAISSMSGLWLVPQLTLAGLSDAFAIVGQVEFFYKQFPENMKSLAASLFFCGLAGSSYLSSLLISIIHRATAKSSTGNWLPQDLNKGRLDYFYYIITALAVVNFGYFILCAKWYKYKGTGSSSSGDLQLDQVSKPSERTVNTV

SEQ ID NO: 6660 - protein, 103 aa, Griffithsia japonica
MSGRGKGGKGLGKGGAKRHRKVLRDNIQGITKPAIRRLARRGGVKRISGLIYEETRNVLKVFLESVIKDSVTYTEHARRKTVVSMDVVYALKRQGRTLYGFGN

SEQ ID NO: 6661 - protein, 1198 aa, Ustilago maydis
MSLSSQPNGGGGASAAAAAAAAANKTKDLFNAALQTRNPNNAYIAHLKIWEEVAAEDGSATVIAAASRATKKARYLILAVQKDTGRVTINKAKRNANGSFSIGKDWDLNTLRQVHVIQPDIFSITLSRPYQWQTQQPVEQQLFLQSLVKVYRKYTQDDGPRLVGIDVPLSSNSAAAVVADSANLSDRPSSGYRTDNSQPTSSATATASNRAAVVESIPAPAINTSALPKISGDNGASPTHSYGSNVVNNRDGRGSPSSGVQPIKSKREGGLQPSPLSRTVQLPSRPTTDLQKSAATDASTAPLQQTSRAATLAVPKHPPPRKNSADSVSIKSGSSGGLAGGGGDARARLSSIEPIRGGAAYERMLLAGTGLTGVTEVDDYDEAADQDEDPYGGAVLADKDADPDASFTSKRATLGRPAIARLETDKTKLGERPKNNDALDEDEDENSTLVAVEEMLEGLEWRNASAKGYGIASGKGTADMIEARLLDELSALEAANIFAIIESDDRVALVVKHMEEALADLDMMDSMIAGFKVQLNARADDISHIESQNRGLQVQTSNQRTLMAEIEMLINTINVDEDAIHSLTAGRLESPEGVAQLEMAAASLYKSMLQARRDGDGGGADMAAAAERLADHEAISSRFCKRVLDYLNVTFHAETQRLLADPSRQMALQPPHPSLRDHAPMEEVLGQYCGLLLYMREVSSATFSRVSAAYFASASECYRTEMQQLFSAYRKQLRKASDEDMVESSFVVPTSTGVGTSAIRSGTIRRTQRDKSSRGARDRGDVSGQDSLQRILSCIFPVLLREQSFISDFLHINDNNITFADYMDLEPYFRRRAAGMFTSSSGPLREMKGAMDLIFGFVAPELQAFTDDALAKDRMSIVGLLATLDRGIMEAEEVSCESLQKVLAKLHLRLASQLERLVQEQIKGIEQTKLTVKKRKGVVHFMRVFPVFVERVEAQLVNAETLNIRTAVDGYYVQICGAMFEALQTISRVESVGAVDEDKGQLNHLVILIENMWYFISEINRLTLRGANPSGCLSALVKRAESIYGDSLTSYTQFVLRRSLAKMMDFGEGIDTLLKNTPASEVCLHSAFSKGAFKKLCKDYTAKDTRKAVEALAKRVAKHFDDDDVPGVTAVEGGAGRVEQDVEVLARVWSSCEQGYIREFQRIARIGQECYPDLAGASLELGANELRRLFASLAPKRR

SEQ ID NO: 6662 - protein, 427 aa, Silicibacter pomeroyi
MSESSGKHSPSRRRFLTSVAAAGAGAVAAGAARAAGPDPLITEVQDWARATGDGVDATPYGLPIEYEGDVIRRNVEWLTADTISSINFTPIHALDGTITPQGCAFERHHSGAIALKKEDYRLMINGLVDTPLVFSYADLERFPRENHVYFCECAANSGMEWAGAQLNGAQFTHGMIHNMEYSGVSLRTLLEEAGLSAAGDLKDKWVYVEGADASSNGRSIPMEKALDDVLVAFKANGEALRKEHGYPVRLVVPGWEGNMWVKWLRRIEVMDGPVESREETSKYTDTLEDGTSRKWTWVMDAKSVVTSPSPQAPITHGAGPLVITGLAWSGRGAITGVDVSIDGGKSWQPARLAAPGQDKALTRFYLDTNWDGSEMLLQSRARDSSGYVQPTKAQLREVRGLNSIYHNNAIQTWWVKANGVAENVEVS

SEQ ID NO: 6663 - protein, 124 aa, Griffithsia japonica
MAPKGKSVPIAEKKVAKKAVPGATEKVTKKKKRSESYSIYIYKVLKQVHPETGISSKAMSIMNSFVDDLFERIATEAAKLATYNNSKTLTSREIQTAVRLLLPGELAKHAVSEGTKAVTKYSSS

SEQ ID NO: 6664 - protein, 540 aa, Prochlorococcus marinus
MSLIDHPNMNLPDYSPNNSSLQWERFSELLWHNEELGLWVDISRMNVNEHELKELKPIFQKAFEAMNSLEKGSMANIDEERMVGHYWLRNPDLAPSRDISKLIANQISQIEQFTTSILSGDIRSDAGELFTDVLWIGIGGSGLGPLLLIESLQELNKGLKFHFLDNVDPIGIDKKLELLQSKLSTTLFVVVSKSGGTPEPQIAMDQARHVVETNGKNWPTRSVAITMCNSLLDNKAKQENWLKTFDLPDWVGGRTSITGAVGLLPLGLIDSDLKSFLLGASKMDELTRNNELLDNPAALMAMAWYSSGSAKGLKDMVVLPYRDSLEVFSRYLQQLVMESLGKKNDREGNIVFQGLSVYGNKGSTDQHAYVQQLRDGINNFFVTFIEVLTNNESPCLNNKLPGDYLSGFMQGTRLALSDSNRQSLTITLKTFDPLSLGALIALFERTVGLYAELININAYHQPGVEAGKKAAADILNLQLQIEDILSDYSNYSIEQISTRLSSSNSESIYFILRNLVFNNKYSAKGSWKNPSSLIFKREKL

SEQ ID NO: 6665 - protein, 561 aa, Rhodococcus erythropolis
MSKTNGVVTTPTSVDVLVVGAGFSGLRALHHLREKGYRTHLIEAGDDVGGTWYWNSYPGARVDIESLEYSYAFDDELQLEWEWPERYAAQSDVLRYLQHVADRFDLRRDISFGERVQSATYDEASATWLVTTDCGEQWRSRFFIPAVGFLSTPYVPDIQGRESFAGQLVHSARWPEGGIDFAGKRVAIIGTGSTGVQLIPQIAESAESLTVLQRSPMWVVPLQNTPMPEEYQTRIKARYPELRRRELDESFAGNLLVDFDLRSSETRSALEVSPEEREAEYDFRWAAGGLSLYTSFTDLIFNQEANDTLREYLERRIRQLIKDPATADKLIPTDYPPLTKRLCCETGYYDAFNRDNVHLVDTKADPIAEITPTGVRLESGAVHDVDIIIFATGFDAATGSLKRLNITGPGGRTLDEHWADGARTHLGLMSDAFPNMFFLAGPLSPGGFFSPPLQSDYQVQLIARMLDRLAGEDAVAIEPEPAAVEDWMTQVDAVYNATLLPKAQSWWSGANIPGKARQFLYYLGGFAAYRDACEQMFADEMRGYRRIGDQASAPAATSSAV

SEQ ID NO: 6666 - protein, 893 aa, Magnetospirillum magnetotacticum
MIRFVLDGAEVEAKEGETIWQVSKRLGTTIPHLCHTDRPGFEPEGNCRACVVEIKGERVLVASCRRLPTPGMVVESRGERVEKSRRLVFELLLADHVSPDLDSAFLGWAKAVGVEQSRFAPRTASCAPDTSHPAMAVRLDACIHCALCLRACRDVQVNDVIGMSGRGAHSRISFDFADPMGASSCVGCGECVQACPTGALALAGGPVRAERMVDSLCPYCGVGCQLTYHVTGDAIIAATGRDGQANHERLCVKGRFGFDYSRHPQRLTVPLIRKDGVPKEPLDPADPFTHFRPASWEEALDRAAQGFKRLPKSALAGLGSAKGSNEEAYLFQKLVRTGFGTNNVDHCTRLCHASSVAALLEGIGSGAVTAPVAEVANADLIILIGANPSANHPVAASFIKNAVKRGAQLVILDPRGQALTRFASHHLKFKNGTDVALLNAMLHTIVAEEIYDRDFVAARTTGFAQLAEHLKSYSPEAMAPLCGIDAGTIRMVARAYARAGSAMILWGMGVSQHSHGTDNSRALIALALLCGQLGKKGSGLHPLRGQNNVQGASDAGLIPMMLPDYGRVGIEAARSRFEAGWSVDLDPNPGLTVVEMMDAAAAGTLRGMYIEGENPAMSDPDLAHAREALAGLDHLVVQDIFLTETAMLADVVLPASSFFEKTGSFTNTDRHIQMGRQVIDPPGEARPDLWIITEMAKRLGLDWTYTGPDEVFDEMCGLMGSLSGITWKRLDAEGGITTPGGKAILFGESFPTEDGKARLVPAKGLSAAENPDSDYPFVLSTGRVLEHWHTGSMTRRSGVLDRLQGLPAVNVSPADMERLGLTEGARVRLESRRGSVEAAVAADSRLSPGALFLPFCFTEAAANWLTNPVLDPVGKIPELKVSAVRLVPLRHPG

SEQ ID NO: 6667 - protein, 346 aa, Oryza sativa
DQLFCRGVAITQENSLLDNTARIEGWLARFPMFDWVGGRTSEMSAVGLLPAALQGIDIKEMLVGAAQMDEETRNTEIKENPAALLALCWYWASDGIGSKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 6668 - protein, 148 aa, Zea mays
  misc_feature (51)..(51): Xaa can be any naturally occurring amino acid
  misc_feature (78)..(78): Xaa can be any naturally occurring amino acid
  misc_feature (83)..(83): Xaa can be any naturally occurring amino acid
  misc_feature (104)..(104): Xaa can be any naturally occurring amino acid
  misc_feature (123)..(123): Xaa can be any naturally occurring amino acid
  misc_feature (127)..(127): Xaa can be any naturally occurring amino acid
YSFLVNVTVYSPERGRSEIVFVSPTGELIKNYRQLSQYLKAHLGGRADSDXDWAAGNTARRFARISERVKVFYSAEGXEKIPXRSRISSGRKGRQVKMEALETXEAKYAAAGLDAPSEDGTQXTDVXMKPAEETKVALNETDDAEGAA

SEQ ID NO: 6669 - protein, 342 aa, Solanum lycopersicum
MADECAAFMKGTELPVKRPREEEAETEMEAANNSNNGCEKEESSPYISSVLPGWFSEISPLWPGEAHSLKVEKILFQGKSDYQNVLVFQSSTYGKVLVLDGVIQLTERDECAYQEMITHLPLCSIPNPKKVLVIGGGDGGVLREVSRHSSVEQIDICEIDKMVVEVAKQFFPDVAVGYEDPRVNLHIGDGVAFLKNVPAGTYDAVIVDSSDPIGPAQELFEKPFFESIAKALRPGGVVSTQAESIWLHMHIIEEIVANCRQIFKGSVNYAWTTVPTYPSGMIGFMLCSTEGPAVDFKNPINPIDDESPAKSIEPLKFYNSEIHQASFCLPSFAKRVIETKGK

SEQ ID NO: 6670 - protein, 267 aa, Gloeobacter violaceus
MGCRARGRILCSGRESLGRSWQNMYRPFLEHLQQKLQSSFDLQSLTIPAGLDYRISERGRESTTIRSWCYTCSELRKIRYTYIDGGEHAQVFNSVIYPAHRYDLPLLGIDLLAFGKKKNLIVLDFQPLFRDKAYLARYIEPMRILRERYGDVAQDVEMKFYDANQYFSKYLLFARTDAETVAGRVFTAYCDYLDLYWQLLASAAPLGDAQDIRRIVKAQKDYDQYSADRDPASGLFSSYFGHEWAERFLYEFLFEDAVPLAVGQPGR

SEQ ID NO: 6671 - protein, 392 aa, Deinococcus radiodurans
MTEVTSVRPSSIKNAAVNLPYGGGKGGIRIDPRKYSQGELERVTRRYTTEIGLIIGPEKDIPAPDVNTGPQTMAWMMDTYSMNVGRTATGVVTGKPVSLGGSLGRADATGRGVFVTGAEAMKKLGMPLEGARIAVQGFGNVGEAAARIFHQHGAKIVAIQDVTGTIHSAAGIDPGKALAHLRQTGKITGLEGSEEMQKDDFWSVDCDVLIPAALEKQITLQNADKIRARLVVEGANGPTIPAADDLLAQKGVTVVPDVLANAGGVSVSYFEWVQDFSSFFWTEDEINERLDRIMREAFQSLWDVKEQHGVTLRTAVYIVACTRVLEARACAGCIRKSTREKGRFLDGAALFVGCWGAFRTFDRKRHPPPLFARPSPIKVKGQRQNRSFCQML

SEQ ID NO: 6672 - protein, 401 aa, Mycobacterium smegmatis
MRMADDAVIDELAAAVVRSPELTELRLHLAALLVERGRYAEALAHCSTVLAQDAGNSRAVDLLQTCSAALSSTPRPERFDWSAAEEQVADIVKPAFVEEPAQVVDENDFDAVRSSGVRLSDVAGMADVKRQLELSLLGPIRNPELMKAFKMSARGGLLLYGPPGCGKTYIAKAVSGELGANFYQVGIADVLSRWLGESERAVRAVFDTARRKAPCVLFFDEVDALGHRRSALGGSSGLRPVVNTLLEEMDSAASSNDGVYVLGATNAPWDVDVALRRPGRFDRMIFVPLPDPDARAAIVRLHLQDRPVEGINLATVLNRTDGFSGADLAHICDTATQLAMSHSLRTGQVRPVQMHDIDAALAQIRPSAGAWFDTARNVVEFGNRDGAFDDLANYMRRRRIR

SEQ ID NO: 6673 - protein, 244 aa, Arabidopsis thaliana
MANHETIFDQLKKQIPVDEEEPLILNRDSSVGLVIVDVVNGFCTIGSGNMAPTKHNEQISKMVEESAKLAREFCDRKWPVLAFIDSHHPDIPERPYPPHCIIGTEESELVPALKWLESEDCATLRRKDCINGFVGSMESDGSNVFVDWVKEKQIKVIVVVGICTDICVFDFVATALSARNHGVLSPVEDVVVYSRGCATFDLPLHVAKDIKGAQAHPQELMHHVGLYMAKGRGAQVVSKISFET

SEQ ID NO: 6674 - protein, 369 aa, Brassica juncea
MSVSAIGFEGYEKRLEVSFFEPSLFVDTHGKGLRALPKSQIDEILAPAECTIVSSLSNDELDSYVLSESSLFIFPYKIIIKTCGTTKLLPSIEPLLRLAGELSLEVKSVRYTRGSFLCPGGQPFPHRNFSEEVSVLDGHFAKMGLSSVAYLMGDDDETKKWHVYSASAPARNGNGNNNNNVYTLEMCMTGLDKEKASVFYKNESSSAGSMTDNSGIRKILPQSQICDFEFEPCGYSMNSVEGDAISTIHVTPEDGFSYASFEAVGYDFTTMDLSHLVSKVLTCFEPKQFSVAVHSSVAQKSYDSGLSVDLEDYGCRETTIELLGEERGTVMYQSFEKLGRYCGSPRSTLKCEWSSSSSCTSEDEKEEGI

SEQ ID NO: 6675 - protein, 381 aa, Dianthus caryophyllus
MMVPTLGNSNYNTVSPMNGDDNNTMALSAIGFEGFEKRLEISFFEPGIFVDPEGKGLRALSKAQLDEILGPAECTIVDSLANESVDSYVLSESSLFVYSYKIIIKTCGTTKLLHSILPILTLADGLCLDVKSVRYTRGSFIFPGAQSYPHRSFSEEVAVLDKYFGNLGTGSKAFVMGSPAKPQKWHVYSATAEPSYDDPVYTLEMCMTGLDKGKASVFFKSESASAAVMTETSGIRKILPDSAICDFDFEPCGYSMNAIEGPAVSTIHITPEDGFSYASFEAVGYDLKIVDVNQLVERVLNCFQPREFSIAVSVDTADKVLEQYCAVNVAGYCREEGGVEGLGVGGSVLYQKFGKVATVSGLNKSPKCCRKEEENDEKREC

SEQ ID NO: 6676 - protein, 377 aa, Dianthus caryophyllus
MTIPMMGNTTDDNNNMTISAIGFEGFEKRLEISFFEPGIFVDPEGKGLRALSKAHLDEILGPAECTIVDSLANESVDSYVLSESSLFVYSYKIIIKTCGTTKLLNSIPPILRLAETLFLDVKSVRYTRGSFIFPGAQSFPHRSFSEEVAVLDNYFAKLGAGSKAIVMGSPGKPQKWHVYSATAETNYDDPVYTLEMCMTGLDKEKASVFFKSQSASAAVMTESSGIRKILPDSVICDFDFEPCGYSMNAIEGPAVSTIHITPEDGFSYASFEAVGYDLQVVDLNLLVERVLACFEPKEFSIAVHADTDTADKVLARNCSVNVIGYSREEGGIEELGLGGSVFYQKFCKGTAPVCPPAPKKTLKCCWKEEEIDEEMEF

SEQ ID NO: 6677 - protein, 258 aa, Streptococcus suis
MAVISMKQLLEAGVHFGHQTRRWNPKMAKYIFTERNGIHVIDLQQTVKLADQAYEFIRDAAANDAVILFVGTKKQAAEAVKDEAIRAGQYFINHRWLGGTLTNWGTIQKRIARLKEINRMEEDGTLDVLPKKEVALLNKQRARLEKFLGGIADMPRIPDVMFVVDPHKEQIAVKEAKKLGIPVVAMVDTNTDPDDIDVIIPANDDAIRAVKLITAKMADAIIEGNQGEDSVAAVEAELAAEPASTESIEELVEVVEGK

SEQ ID NO: 6678 - protein, 509 aa, Glycine max
MPSNDSDSPMKIVHGDAGYILEDVPHFTDYIPNLPTYPNPLRSNPAYSVVKQYFVHMDDTVPQKVVVHKDSPRGIHFRRAGPRQKVYFKSDEVHACIVTCGGLCPGLNTVIREIVCGLSYMYGVNKVLGIDGGYRGFYSKNTITLTPKVVNDIHKRGGTILGTSRGGHDTGKIVDSIQDRGINQVYIIGGDGTQRGATVIYEEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIQKRLKENGHMVIVIAEGAGQDLLTESMQAMDQKDASGNKLLQDVGLWISHKIKDHFARKDKIPINLKYIDPTYMIRAIPSNASDNVYCTLLAQSAVHGAMAGYTGFTVGLVNGRQTYIPFIRINERQNKVVITDRMWARLLSSTNQPSFLSPKDLEEAKKAEQPPTQLLEENNCNDVGDAEKEEQPPKDEQESGNHTDNGIKTQN

SEQ ID NO: 6679 - protein, 235 aa, Magnetospirillum magnetotacticum
GGRGADPWKSISVKRRISLGLKQTLQNPWDAFAEKHPVGSEVEGEVKNKTEFGLFIGLEGDVDGMVHLSDLDWNRPGEQVIEEFKKGDMVRAQVLDVDVEKERISLGVKQLGGDPFAEAGEIKKGQIVTCEVVEVKDSGLEVKLVDTDMQTFIRRAELARDRGDQRPERFATGEKFDARVVQFDRKARRVQVSIKALEVAEEREAMAQFGSADSGASLGDILGAAFNKKKGGDEE

SEQ ID NO: 6680 - protein, 368 aa, Brassica juncea
MSLSAIGFEGLRERLEVSFFEPSLFLDTHGKGLRALSKSQIDEILAPAECTIVSSLSNDELDSYVLSESSLFIFPYKIIIKTCGTTKLLLSIEPLLRLAGGVSLEVKSVRYTRGSFLCPGGQPFPQRNLSEEVSVLDGHFAKMGLSSVAYLMGDDDETKKWHVYSASAPAKNSNGDNNVYTLEMCMSGLDKDKASVFFKNESSSAGSMTDNSGIRKILPQSQICDFEFEPCGYSMNSVEGDASSTIHVTPEDGFSYASFEAVGYDFTTMDLSQLVSRVLTCFEPKQFSVAVHSSVAQKSYDHSGLSVDLEDYGCRETTVGVSRRRERNSDVSEVREAGNVLWFSEIDLKCEWSSNSSCTSEDEKEEGI

SEQ ID NO: 6681 - protein, 357 aa, Catharanthus roseus
MALPASAIGFEGYEKRLEISFFESSFFADPDGKGLRALNKSQIDEILEPAECTIVDSLSNQYLDSYVLSESSLFVYPYKIIIKTCGTTKLLLSIPAILKLAESLSLSVRNVKYTRGSFIFPGAQSFPHRSFSEEVELLDNYFGKLGLESNAFIMGNPDQPQKWHVYSASVGSEQSSDPTYTLEMCMTGLDREKASVFYKSESSSAALMTTRSGIRKILPDSEICDFEFDPCGYSMNSIEEAAISTIHVTPEDGFSYASFEAAGYDLKAQNLGMMIERVLACFQPSEFSVAVHCDVTCKSLEQICSLELKEYSLDEKINEELGLGGSIIYKKFLRIDACGSPRSILKCCWKEDESEEE

SEQ ID NO: 6682 - protein, 363 aa, Triticum aestivum
LNKFVQKSRLVPVRNSRDIVDPRVKSWIGTALACDSKAAAQPRHVCRAVQQSSKSKVSVAPLDLESAKEPPLNTYKPKGPYTATIVSVERAVGPNAPGETCHVVIDHGGNVPYWEGQSYGIIPPGENPKKPGNPQNVRLYSIASTRYGDSFDGKTASLCVRRAVYYDPETGKEDPSKNGVCSNFLCNSKPGDKIQMTGPSGKIMLLPESDPNATHIMIATGTGVAPYRGYLRRMFMEDVPNFRFGGLAWLFLGVANSDSLLYDEEFTSYLKQYPDNFRFDKALSREQKNKSGGKMYVQDKIEEYSDEIFKLLDGGAHIYFCGLKGMMPGIQDTLKKVAEQRGESWDQKLSQLKKNKQWHVEVY

SEQ ID NO: 6683 - protein, 595 aa, Unknown
  Frankia sp. CcI3
MTPPIAGEDHTGHAGDVRPGDPAPRTVLSSRSPTPAVAAVRLAVRRAVTDLPPGGLVLVACSGGPDSLALAAALAFVAPRRALRAGMVTVDHGWDTGSTERAERVARQGRALGLDPVEVLTEHTARSEGIARQARRAAIAAAADRLGARAVLLGHTLDDQAETVLLRLARGAGARSLGGMSADDGLLSRPLLGIRRADTRAACLAEGLEVWDDPTNRDPAFTRSRVRHTVLPVMETELGPGIAESLARSADLLRADADALDAMAAEVYGKVVRARGRPCTGEVAFDVAALAGLTAAVRGRLLRRAAIDVGASASALRAEHIWAVEELVTRWRGQKPVPLPTGVLARRWENRVTLTGPVVPPPPPAGPAARRSDAARRSDAVTAPHIKEDDQVSQTATTTPDTGGAHDGPRHSPHPDIAEVLVSSDEIAAKIVELAARVDADYAGREILLVGVLKGAVMVMADLSRALTVPLTMEFMAVSSYGSSTSSSGVVRILKDLDRSIEGRDVLVVEDIIDSGLTLSWLLKNLRSRGPASLEVLALFRKPEAVTVDVDVRYVGFDLPGAFVVGYGLDYSEYYRTLPFVGTLTPAAIERGAPA

SEQ ID NO: 6684 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTHEEVDGRLKDIMANIFNTAKETAEKYDLGTDYLAGANIAAFEQIADSMIAQGLV

SEQ ID NO: 6685 - protein, 362 aa, Datura stramonium
MEMDLPVSAIGFEGFEKRLEISFVEPGLFSDPNGKGLRSLSKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGPVQSNDPVYTLEMCMTGLDREKASVFYKTEGSSAAHMTVRSGIRKILPNSEICDFEFEPCGYSMNSIEGAAVSTIHITPEDGFSYASFESVGYDLKTMELGPLVERVLACFEPAEFSIALHADVATKLLERVCCVDVKGYSLAEWSPEEFGKGGSIVYQKFTKTPYCASPKSVLKGCWKEEEEEKEEKE

SEQ ID NO: 6686 - protein, 264 aa, Gossypium hirsutum
MATSAIQQSAFAGQTALKQSNELVCKIGAVGGGRVSMRRTVKSAPTSIYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 6687 - protein, 965 aa, Psychrobacter arcticus
MTISQNPTLDTFKGLFNEAEFVYRHLGSNDAKQADLLSAIGYKDMATFINDTVPEPVRLHKELDLPVAMSEHAALAKLRTMADDITVNKSYIGQGYSPVRMPAVIQRNVLENPGWYTAYTPYQAEIAQGRLEALLNFQQVCIDLTGLELAGASLLDEATAAAEAMAMSKRVSKSKSMQFFVDDRVYSQTLDVINTRAKYFGWEVVVGDFELAKSGDYFGALFQYVGVEGDVKDLTDVIAAVKKNKTYVNVVSDIMSLVLLKSPADMGADVALGSTQRFGIPMGFGGPHAAYFAFSDKAKRSAPGRIIGVSKDSQGNTALRMALQTREQHIRREKANSNICTSQVLLANLAGMYAVYHGPGGVKRIATRIHAFATAFADVIKNANDSNLNVVHDQFFDSVVIDCGSEKLATQIFENADNVGYNLWRLGDSKLSVAFSETSDQEDFKILTQLFVTKAHDLPEDARISLDSTHLRTDDILTHPVFNSHHTEHEMLRYLKSLEDKDLAMNRSMISLGSCTMKLNATSEMLPITWPEFANVHPFAPRDQVTGYVAMIDSLQEQLKAITGFDDVSMQPNSGASGEYAGLLAIRRYHESLGETDRDVCLIPMSAHGTNPATAMMMGMKVVVVKTDDNGNVDIDDLTAKSEEHSARLGALMITYPSTHGVFEEGIRKICDLIHKHGGQVYMDGANMNAQVGMMQPADVGADVLHMNLHKTFCIPHGGGGPGMGPIGMKSHLAPFMANHTLSPVHNAQKDCSAVSAAPYGSASILPISWMYIAMMGRDGLLKATELALLNANYVAAELKDYYPVLYTGKNGRVAHECIIDIRPLKEETGISESDIAKRLMDYGFHSPTMSFPVAGTLMIEPTESESKEELDRFISALKSIKAEAMKAKAGEDNWTLENNPLVNAPHTAAMVIDGEWTYPYSRETAAFPLPYIRTNKFWPSVARVDDAYGDKNLMCSCPSIENYM

SEQ ID NO: 6688 - protein, 326 aa, Borrelia burgdorferi
MLEFETIDINLTKKKNLSQKEVDFIEDVIIVGSGPAGLTAGIYSVMSNYKAAILEGPEPGGQLTTTTEVYNYPGFKNGISGRNLMLNMREQVVNLGAKTFPETVFSIKRKGNIFYLYTENYIYKSKAVIIAVGSKPKKLETLKNSGLFWNKGISVCAICDGHLFKGKRVAVIGGGNTALSESIYLSKLVDKVYLIVRKNNLRAIAMLRDSVAKLPNIEILYNSEAIEVDGKSSVSSVKIFNKKDNVVYELEVSAVFMAVGYKPNTEFLKGFLDLDEEGFIVTKDVVKTSVDGVFSCGDVSNKLYAQAITAAAEGFIASVELGNFLK

SEQ ID NO: 6689 - protein, 1098 aa, Debaryomyces hansenii
MKTSDDNISFSKGGVPPTSKEISVLKDDCNKKHIIIVGFGMVGFAFLEKMLVDDTAGEYRLTIIGDEPHLAYNRVGLTEYFEHQDFDKLLLAPHSFYDQKNADTCEYRVNQKVTKIEKEHKYIETSNAKRYHYDYLVLATGSYAVLPIDLFPRSQSNEFCDLKSCRKLGCFVYRTIDDLNAMISFSETIRSTIKKPVLKRAVIVGGGLLGLEAAKALLDMECYDEVTIVHRSKWLLSQQLDEKGGNLLTERIAEMGVKLRTDTTINKLQYDHCTLSFEVQYNNGDVEICQLLCYTIGIKPQDILARSSGLKVAKKGGIEVDNFMKTSNRYIYAIGECASWNNQTFGLIAPGVMMADILSFNLIQAKYHSERQFTKPDIGTRLKLMGVNVASFGDYFADKNGPSRLPKGYKIKKVKSLVYDDPIEANYTKLLLSYDGKYLLGGILVGDTTQFTKLASITKSGKPLEKPASTFIIGQSNSENNDVDDLPDDTQVCSCHNVTKGKLIEKIKSGTCNSLGELKSCTKAGTACGGCEPTIKVILDTEMKKMGKNISKALCIHYKESRQDLFSLIMVKRYKSFKEVMSHLGVDPCALGCEICKPTIASILATLFNRHILETNLHGLQDTNDKYLGNIQRNGTYSIVPRMSAGEVTPEKLVAIGEIARKYDLYTKITGAQRVDLFGASKSDLPKIWEELGKYGFESGQAYGKSLRNVKSCVGSTWCRYGIGDSVGLALRLEERYKGIRSPHKMKGGVSGCVRDCAEFHSKDFGLCAVQNGFNLYVGGNGGMKPAHAQLLKADVPPDQVIPLLDRYLMFYFRTADRLQRTARWLENLDGGIEYLREVVVYDKLGIAMELEKQMNQLVSQYFDEWAAAVDSYKYSNIFKQFVNTDKAQETVEIIRDRGQRRPVDWPEYEVTKEVFKDTKWSSLSWVKVCQSKELPNSEAGSSANVLISDTQIAVYRLNGKLFASQNMCGHKRAFVLSQGILSMDGNKNTYISCPLHKKNYIIDKASDKAGSCTNDASQSVALFDVMESNGEVFVKLPPIEELDKVLGTSRWKVRKQESESNGSIATYKNIDEAFNIKVPIRKPIPSVGCSGGPELDW

SEQ ID NO: 6690 - protein, 364 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINITRQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAIKLFENLGKELKDGDEIDLLKA

SEQ ID NO: 6691 - protein, 292 aa, Oryza sativa
  misc_feature (249)..(249): Xaa can be any naturally occurring amino acid
MEPCRDGHVVTEFDSVEMVCVAPLQVAWPTDQIDTHGHLTQERVRRDFEIGEEIGRGRFGVVHRCASRSTGEAYAVKSVDRSRLSDDLDRSLAALEPKLARLAAAGNPGVVQVHAVYEDDDWTHTVMDLCTRPDILDWVRLRCGKPVPEPDATAVVAQIAEALALCHRRGVAHRDVKPDNVLLDATGDGPPRRRRGSWGQPHYVAPEVVAGGEYGEKADVWSAGVVMYVLLTGGALPFGGETASDVFAXVLRGNLRFPPRLFSGVSPAAKDLMRRMMCRDVYRRFSAEQVLS

SEQ ID NO: 6692 - protein, 527 aa, Debaryomyces hansenii
MVDLIASFNCKGEHHLIIGISRVATNRMNSIINAGAKPILIADVPFGSLPTSIQHYIKLGIIKHLERNFKIVDLTLLGRAECNFIVDKVFVSVPMSQKEFKYKTYHECCRLRIPIHVSDSNEFSSFSILSTFTSGDFLVGVTTLGKGCKLSARILREMRNTLPPNINDICNNVGKLKAQIEEEDNLNSLDNNMSIVGENDEDATNTIELISLVKEFDMTKKQKRLQKMLWLLQTTEYFPLKALADMSLEGLNPKKNLNDFKESNAKGMMGTRKGSISLVGAGPGSVSLLTLGSLQKIQEADLVLADKLIPQEILNLIPGHTKLFISRKFPGNAEKAQEQLFQIALHSLMKGERVVRLKQGDPYIFGRGGEEYNFFSKHGFVPKIFAGITSALAAPLLGNISATFRGIADQILICTGTSKYGDFPNLPDFVRSRTVVFLMALHRVVNLVPILIDEKKWDPQVPVAVIERASFPDQRIIRTKLSFVAEAIVSCIPKPPGLLVVGYACQALVKPREGEKWVIEENLDNQY

SEQ ID NO: 6693 - protein, 175 aa, Saccharomyces cerevisiae
STSHCRFYENKYPEIDDIVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEELYKTIAWPLSRKFGHAYEAFKLSIIDETVWEGIEPPSKDVLDELKNYISKR

SEQ ID NO: 6694 - protein, 400 aa, Zea mays
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTACAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 6695 - protein, 245 aa, Gloeobacter violaceus
MTLYEPFLERAQQVLTRRLELAPYPIPVGFERKEALVRGEAVVTTSTAWQSPKLRQIRAAHVQGGGALQVLNFVISPRLEYDLPFFGADLVTLPGGHLIALDMQPLFRDDPAYQAKYTEPIVPLFEAHRAHLEWGGDFPEEARPFFSPAFLWTRPKETGTVETRVFAAFVDYLNAYLDFVERAEPVTHPEGLAAVERAQLRYLHYRAEKDPARGMFRRFYGPEWTEEYIHGFLFDLERRREAVHR

SEQ ID NO: 6696 - protein, 584 aa, Coccidioides immitis
MPSSVPAREDVRSPLLTENSRRSGEVWEDATAIARQSDKEGESKSSWYLFLLTLSIGGLQIVWSVELSNGSPYLLSLGMSKSLLAFVWIAGPLTGTLVQPYVGIRSDNCRVPWGKRKPFMIGGGIATVISLMALAWVREMVGGVLGIFGAGAQSQGVKVTTIVVATLFMFCLDFAINTVQAAIRAFIVDNAPAHQQESANAWASRLTGIGNILGYISGYLDLPKVLPFFGNTQFKVLCVIASLALGTTLLISCLYIQERDPRLEGPPRSKNPGVICFFKQVFASIKRLPPQIRKVCEVQLCAWLYVNPIFDQHPDLPEDAISAIWEEATRVGTFALLAYAVTSFVASMVLPLLVVPTYRPALAQDSDTDTTSSDRPYLSRHPSTSTLSFTASAGAAIETSHEAVQPSEKYNVLSKLQIPGLTLRRLCTFLIYSPQAGTVVIAIVGISWALTLWAPFAFISAEVAKSDAENRERRHQLRQGIPDLSHGHPGSECDENGSSEEKVDQAGVILGIHNVAISFPQIASTLISSAIFKALQKPRGEPWDDSVGWVLRFGGCAALGAAYITTRLGEGAGGKTSGENGDMA

SEQ ID NO: 6697 - protein, 137 aa, Griffithsia japonica
MARTKQTARKSTGGKAPRKQLATKAARKSAPITGGVKKPHRYRPGTVALREIRKFQKSTDLLIRKLPFQRLVREIAQDFKSDLRFQSSAVLALQEAAEAYLRGGLFEDTNLCAIHAKRVTIMPKDIQLARRIRGERA

SEQ ID NO: 6698 - protein, 435 aa, Spinacia oleracea
MAVAELSPCYQTQIVKPPHLSWLSNNHKLNLLGLPKASRITEICCSLAPNQVQTPVAVPTGAQSIKPECYGVFCWTYDLKKEEETRSWKKMITIAISGAAGTISNHLLFKLASGVVFGPDQPIALKLLGSEKSFHALEGVAMELEDSLYPLLREVSIGIDPYEVFEDAEWALLIGAKPRGPGMERADLLDINGKIYAEQGKALNAVASPNVKVIVVGNPCNTNALICLKNPPNIPAKNFHSLTRLDENRAKCQLALKAGVFYDKVSNVTIWGNHSTTQVPDFVNAQIGGVPVKEVIKAQKWLEEEFTEKVRKRGGVLIQKWGRSSAASTAVSIVDAINPLITPTPPGDWFPSGVYTNGNPYGIAEDLIYSMPCRSKGDGDYELVKDVIFDDYLRKRIKTSEEELLAEKRCTAHLTGEGIAVCDLPAGDTMLPGEM

SEQ ID NO: 6699 - protein, 354 aa, Glycine max
MASSTITSSFLTSPPSSLFNKSSSPSHADTDGGIAFHATPTLRPLAPRASMSASAPPYDFGSFRFDPIRESIVSREMTRRYMIDMVTHADTDVVIVGAGSAGLSCAYELSKNPSINIAIVEQSVSPGGGAWLGGQLFSAMVVRKPAHLFLDELNVEYDEQDNYVVIKHAALFTSTIMSKLLARPNVKLFNAVAAEDLIVKNGRVGGVVTNWALVSLNHDTQSCMDPNVMEAKVVVSSCGHDGPFGATGVKRLKSIGLIDSVPGMKALDMNKAEDAIVRLTREVVPGMIVTGMEVAEIDGAPRMGPTFGAMMISGQKAAHLALRSLGLPNALDSVGNVHPELVLAAAESAEIAEA

SEQ ID NO: 6700 - protein, 356 aa, Oryza sativa
MASLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHNAAKIFSSPEVASEEPWYGIEQEYTLLQKDINWPLGWPVGGFPGPQGPYYCGIGADKSFGRDIVDSHYKACLYAGINISGINGEVMPGQWEFQVGPSVGISAGDQVWVARYILERITEIAGVVVSFDPKPIPGDWNGAGAHTNYSTKSMRNDGGYEIIKSAIEKLKLRHKEHISAYGEGNERRLTGRHETADINTFSWGVANRGASVRVGRETEQNGKGYFEDRRPASNMDPYIVTSMIAETTIIWKP

SEQ ID NO: 6701 - protein, 346 aa, Gloeobacter violaceus
MVRTLIDIRSLTIDPNCWYAVAQSAELKTEPRSITLWGEAIALFRGADGVAHAVEDRCPHRQVKLSHGRVVEGSLECAYHGWRFDGDGRCTHVPYREGSLPGCRLRTYPVREHDGFVWLFAGDPGRAHAVEPLRLPEWDHLNYIASVAPIACAAHYSYLIENLMDMHHGHLHERFQAWGAAHLEKLEEHPGRIDALYEAQSYYRIDRIWSVAQLFVPALRRAHPEALAVSYVYPHWRARLGEDFRLYCLLCPEGERSTRAYLVHFTSLEAFPDLHKLPVPFRRFVKDRCFGSAQGMLAGLIRQDVQMIEEEQRAYDRDPQRRNWEVNRSIAAVQRLWRQQKKADVS

SEQ ID NO: 6702 - protein, 402 aa, Mannheimia succiniciproducens
MSPSINLTFKGGCNMFMAQIQRFFKMGSASGILLFFFALLAIIFANTSLNNFYFNFLDIPVSVQFGEFMINKTLLHWINDGFMAVFFVLVGLEVKREMLEGSLSRYQLAIFPAVAAIGGMIVPALIYYLITNQHPELSNGWAIPMATDIAFALGIVALLGTRVPLPLKVFLLALAIIDDLGAIVVIAVFFSEELSIQALSVAIVAIAGLITLNRMKVGHLCAYLIFGLILWAAVLKSGVHATLAGVIIGFCIPQKDSEGKSPLHTFEHILTPWCSFFVLPLFAFANAGVSLGTINTDMIFSTLPLGIALGLIVGKPLGVFSFSYFSVKLGIAKLPEGIKWKQVFAIAILCGIGFTMSMFLAGLAFTDGQSDSLINTLSRLGILLGSSVSAILGYLLLKSTTK

SEQ ID NO: 6703 - protein, 180 aa, Arabidopsis thaliana
GSHMENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 6704 - protein, 449 aa, Streptococcus agalactiae
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAACGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASKAADEFGDSGNLVLGANIAGFLKVAQAMSAQGIV

SEQ ID NO: 6705 - protein, 408 aa, Clostridium perfringens
MTKFKSYNKEKNEETLDKKAFIFGLMSVFLCGMGFSIISPVVPFLVEPYVSNTSEQAFFVTLLTSVYAVCVFFVAPGLGALSDRYGRRPILLICLLGSSIGYLIFGIGGSIWVLFLGRIIDGVTGGSISTIFAYFADITPKEERTKYFGWISASAGIGAAIGPTLGGALAKFGYAVPMYFGAIITLLNFIYGILYMPESLHENNKLKKITLVRLNPFTQLMSVLSMKNLKRLLISAFLIWIPNGSLQSIFSLFTMDTFNWTPTLIGLMFSIMGIQDIISQGLIMPKLLMKLSDVKIAILGMVSEIIGYALIAASAIFTFYPFFIVGMFIFGFGDSIFGPSFNGMLSKSANSSEQGRIQGGSQALQSLARIIGPILGGQIYVSLGHSSPAFTGMILIILAIPILYKSIR

SEQ ID NO: 6706 - protein, 346 aa, Brassica juncea
MKMSGVRVLASSPILLLLLSLLMASFFDTTVGQIGVCFGQVGNNLPNPSEVVAMYKQYSIPRMRMYGPNGAALDALRGSNIEFILDVPNSDLVGIANSQMTANTWVQNNIKNYQGVRFKYISVGNEVMPRGPGGAGRVLIQAMQNIDRALSQAGLSIPVSTTTFMGAFTDTYPPSRGRFSDEYRNFLQPVIGFLASKRYPLLVNIYTYFGYKNGDVSLQFALLQPSNNEFTDPNNQLRYRNLFDANIDSVYAALEKSGGGSLEVVVSESGWPTQGGPGTSVPNAEAYVNNLRLHVQNGSPKRPGKAIETYIFAMFDENQKPGDVTERYFGLFNPTTRQLKYGVKFN

SEQ ID NO: 6707 - protein, 231 aa, Brassica napus
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDAHGHHAQEALRRAKFKFPGRQKIIVSRKWGFTKFNRADFTKLRQDKRVVPDGVNAKFLSCHGPLALRRPGKCIFASHLLKFQNCCLLIL

SEQ ID NO: 6708 - protein, 197 aa, Pseudomonas syringae
GGNKPRKLEFLAADALREGADTLITAGAIQSNHVRQTAAVAAKLGLHCVALLENPIGTHAENYLTNGNRLLLDLFNVQVEMVEALTDPTAQLDELATRLEAQGFRPYVIPVGGSNALGALGYVESALEIAQQCEGAVSLSSVVVASGSAGTHAGLAVGLEQLLPDVELIGVTVSRSVADQKPKVVTLQQAVAEQLAL

SEQ ID NO: 6709 - protein, 253 aa, Unknown
  Platanus x acerifolia
MSLLSDLINLNLSETTEKIIAEYIWIGGSGMDLRSKARTLPKLVDDPKKLPKWNYDGSSTGQAPGTDSEVILYPQAIFKDPFRRGNNILVMCDTYTPAGEPIPTNKRCNAEKIFSHPDVAAEEPWYGIEQEYTLLQKDVKWPLGWPVGGYPGPQGPYYCGVGSDKAWGRDIVDSHYKACIYAGINISGINGEVMPGQWEFQVGPSVGISAGDEVWVARYILERITEIAGVVLSFDPKPIQGDWNGAGAHTKLQ

SEQ ID NO: 6710 - protein, 353 aa, Pisum sativum
MAVSAIGFEGFEKRLEISFSDPGLFSDPQGRGLRSLTKSQLDEILAPAECTIVSSLANEDVDSYVLSESSLFVYAYKLIIKTCGTTKLLLSIPPILKLADSISLNVRSVRYTRGSFIFPGAQSFPHRHFSEEVAVLDGFFGKLGSGSMAYILGGSDEAQNWHIYCASSDSVSPEGSVYTLEMCMTGLDREKASVFFKEQTGSAAEMTVNSGIRKILRNSEICDFDFEPCGYSMNSVEGSAVSTIHITPEDGFSYASFETAGYDLKAINLNEMVMRVLACFQPTEFSVAVHVDNASKSFEQGCLLDVKGYCCEEKSHQGLGMSGSVVYQKFLKTSYCGSPRSTLKCWKDEDEEE

SEQ ID NO: 6711 - protein, 571 aa, Triticum aestivum
MKSLLGEERSFIIESDDDDEEDPAHRGDGVGHGDDGSSSDSSSCATPRGGGGSGGGDSQPNSYTNQWPQSYRQSIDILSNVQSPSLGFLGTPTLSRLSNSFLNSSFLNNSFRGKTPEIVSNLVKPLIRPTTSDEQQQQQQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLSIGGLTINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGEATESQFTLNLPENLVVSKIAVWATVANPITKYALTITPLAMSLEELLPRSQQKYSNIILLRSALVVSTLIIALSVPFFALVMALIGSLFAMLVTYILPCACFLAILKAKATWYQTATCSFIIAVGVTCACVGTYSSLSGIVQNYAT

SEQ ID NO: 6712 - protein, 445 aa, Unknown
  Mycobacterium sp. MCS
MPTLLWFRRDLRLHDLPALVDAAQGDGQVLACYVLDPRLHRSAGPRRLQYLHDALRDLRDQLDGRLLVTRGRPEQRIPALAKSIDASAVYVSGDFTPFGRRRDDAVRKALGEVPLQPSGSPYLVSPGRVTKGDGTPYKVFSPFFDAWRRHGWRAPAQSGPDSATWIDPADLTGRDLRTEIPDDGATLDIPAGERAAAQHWRAFVADELDGYADNRNRPDLDVTSRMSAHLKFGTIHPRTMVDDLGRGKGAQAYLRELAFRDFYAAVLHEWPRSVWWNWNTGFDGIRVDEGAVAEQRFDAWKRGRTGFPIVDAGMRQLAGIGWMHNRVRMIVASFLVKDLHLPWQWGARWFLEQLVDGDMANNQHGWQWTAGCGTDAAPFFRVFNPSTQGAKFDPDGTYVRRWVPELKGVADVHKMGDDRPADYPAPIVDHAAERAEALRRYAEIS

SEQ ID NO: 6713 - protein, 520 aa, Ralstonia solanacearum
MERRSFLTAAGLGLAAPFGLTPRDVMAMATESPDAWASGFAAARAERAWLAGFEGVSADLPPSALTVEGRFPAALHGSLYRNGPVRHQIGGLRYHHLFDGDGMIQRYDIDTRGARTRVTHRGVFVRTDKFVADTAAGRPVRGTFATLLPGMVPIDSPDAINVANTSVVMRGDELLALWEGGSATRLDPDSLRTLGVKTWRADYAGMPFSAHPKVEADGTLRNFGVSSAAGLLTVYCVGADGALRRAQSVRVPQMAMVHDFAVTQRHLVFLLPSFIYDVERARDGASFLDAHVWRPELGMRALVLDKNDAARMRWFELPAGFVFHVGNAWSSPDGQRIHLDYVRSDDAAIVTTALRELMRGHIVHPAAPARLTQLTLDLRSGRAGQTATPYAAEFPKIDTRRTGLRHRALFCVANAVSRPGADSPIGFDTLMRFDTESGHVQRYRFAQRALVEEHLFVPAGPNAPEGEGWLLGTVFDVDAGRTLLTVFDARNVSAGPVAVAAREGVVPQGFHGLFRSRMAA

SEQ ID NO: 6714 - protein, 361 aa, Nicotiana tabacum
MDSALPVSAIGFEGFEKRLEISFFEPGLFADPNGKGLRSLSKAQLDEILGPAECTIVDSLSNDDVDSYVLSESSLFVYSYKIIIKTCGTTKLLLAIPPILKLAETLSLKVQDVRYTRGSFIFPGAQSFPHRHFSEEVAVLDGYFGKLAAGSKAVIMGSPDKAQKWHVYSASAGPIQSNDPVYTLEMCMTGLDREKASVFYKTEGSSAAHMTVRSGIRKILPNSEICDFEFEPCGYSMNSIEGAALSTIHITPEDGFSYASFEAVGYDMKTMKLGPLVERVLACFEPDEFSIALHADVATKLLERVCSVDVKGYSLAEWSPEEFGKGGSIVYQKFTRTPFCGSPKSVLKGCWKEDEEKEEKE

SEQ ID NO: 6715 - protein, 437 aa, Zea mays
  misc_feature (325)..(325): Xaa can be any naturally occurring amino acid
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIVQLVKHSAENKGIKGFKGGDAIAPDSLLTEECDVLIPAALGGVINKDNANDIKAKYIIEAANHPTDPEADEASPXLKTNRLLSAMFSDPLCIPFHPQILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 6716 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 6717 - protein, 526 aa, Nicotiana tabacum
MDSARGWFQKLSSTKKDPMASGREDGKPVSAEEASNITKQRVAAAKQYIEKHYREQMKNLQERRERRILLEKKLADADVSEEDQNNLLKFLEKKETEYMRLQRHKMGADDFELLTMIGKGAFGEPICMIGFSVITGQNCREKTTGQVYAMKKLKKSEMLRRGQVEHVKAERNLLAEVDSDCIVKLYYSFQDDDYLYLVMEYLPGGDMMTLLMRKDILTEDEARFYVAETVLAIESIHKHNYIHRDIKPDNLLLDRYGHLKLSDFGLCKPLDCSTLEEKDFSVGDNANGGSRSDSPPAPKRTQQEQLEHWQKNRRMLAYSTVGTPDYIAPEVLLKKGYGMECDWWSLGAIMYEMLVGYPPFYSDDPMSTCRKIVNWKNHLKFPEEAKLSPEAKDIISRLLCNVTERLGSNGADEIKVHSWFKGIDWDRIYQMEAAFIPEVNDELDTQNFEKFEESESHSQSGSRSGPWRKMLSSKDINFVGYTYKNFKVVNDYQVPGMVELKKTNTKPKKPTIKSLFGDESEASEDN

SEQ ID NO: 6718 - protein, 467 aa, Oryza sativa
MATRLEQCCLLLLLLLCSCSSAAVAAASPAAMSSSRKAVDRLPGFAGPLPFSLETGYVAVGEARFFYYFIESERSPEEDPVLLWLTGGPGCSAFSGLIYEIGPLFFDFHGHKGGLPTLHYKANSWTKISNVIFVDSPPGTGFTYATTAEGLKSSDTIVVHQLYTFIQKWFDDHPQFSSNPLYVSGDSYSGIIIPTLTMEIAKGKESSDERHLNLKGYIAGNPLTDTTHDDNSKFPFLHSLGIIDDELYEVARKNCKGDYMTPPNSQCANSVQAIRDCIRDVNDLHILEPRCEEDGISLMSDNSASSHDRRTKLLESAVSSICRNATYVLSKIWANDEAVRESLGIHKGTVTTWERCNHDLLYKKQIVSSVEYHLSLITQGYRGLVYSGDHDSVVSLIGTQGWLRSLNLSITHGWRPWYVNSQVVGFTRTYSNNLTYATVKGAGHTAPEYMPKECLAMVDRWLSGEPL

SEQ ID NO: 6719 - protein, 298 aa, Sorghum bicolor
MGSFKGHVLPGTLFLLVGLWRVWCSASRHAASPSTFRVRAWNPVRTTTSSSPLRLLELYVVAGGAFADMCVEVLYSTHLRIFVDGGEVNPAHLNDLEHGGMLLMFFLFGALALASQLWPRYLPLTDGALCLVAATAFTAELVLFYFHSTTHMGLEGYYHYLLVVLVALCVAATVLGALLPASFPVDLASGVLIALQGLWFYQTAFTLYGPMLPAGCARDADGHIDCHARAAQERAEQLANFQFFGLVFLAFCYVLGCYAVAAARYGHPELAAMHDKHVAAMEGHGDAGGGDRQEECAI

SEQ ID NO: 6720 - protein, 252 aa, Methanopyrus kandleri
MSVTKVYFVGAGPGDPELMTLKGVRVLRRADLVIYPGSLIPRESVEEWAPNAELIDSHGKTLEELVETMVEAVEDSRTVVRLVSGDPFVYSSLYEQVRELRRRGVDYEVIPGVSSVNAAAAALGEELTKPGISQTVILTRPAGRTGKPEGESLSELAEHGCTMVIFLGAAYLERIVKSLLGGAYDEDTPAAVVYKASTPEEKVILGTLGDIAEKAREEGIDRTALIIVGDVLKEEGKRSHLYSEEYARRVRR

SEQ ID NO: 6721 - protein, 503 aa, Geobacter sulfurreducens
MKKIKRVALITPPYHSGVVESAGTWLNVGFVYIAGSLRAAGYEVDYYDAMSLWHTWPDIRRRIEAFRPDVVATTAFTASIVDAIRLLRFAKEIDPGIVTVLGNVHATFCYDEILAHDHDAVDFIVRGEGEVTLPRLCTCLNAGDDPYKVEGLAFRRDGGVVVTPRAPYIHDLDGLPMAWDLVEWPIYTYRAKNDARLAIVSSSRGCKQQCSFCSQQLFWSQSWRARSAENFVAELEMLHTVHGVQVAMLSDEIPTFDRQRWVRILDLMIERQVPVKLLMETRVDDILRDADIMDRYREGGVEHIYVGVEAGTQETLDLFKKDTQVEQSKQAIDLINNADIVSETSFVLGMPDDTPESIAQTIELAKHYNPDMAFFLAIAPWPYAELYPQLEEYVATKDYRKYNLVEPVIKPKHMTLEELERQLGKASQQFFMHKFQNLHQLSAWKQEFMLSVLDLLINHSYLAGQMRAMLKEGKEMPAEVKALLRAVGERTGAAHPHAVAPIP

SEQ ID NO: 6722 - protein, 284 aa, Griffithsia japonica
  misc_feature (208)..(208): Xaa can be any naturally occurring amino acid
  misc_feature (224)..(224): Xaa can be any naturally occurring amino acid
ARGVGILADDTDPMVSVMKVDKAPLESYADIGGLETQIQEIKEAVELPLTHPELYEDIGIKPPKGVILYGEPGTGKTLLAKAVANSTSATFLRVVGSELIQKYLGDGPKLVRELFRVAEDMAPSIVFIDEIDAVGTKRYDTTSGGEREIQRTMLELLNQLDGFDSRGDVKVLLATNRIETLDPALLRPGRIDRKIEFPLPDEKTKRRXFSIHTGRMTLAGDVNXEEFVMNKDELSGADIKAICTEAGLMALRERRMKVMHADFKKARENVLYKKNQGVPEGLYL

SEQ ID NO: 6723 - protein, 702 aa, Streptomyces coelicolor
MQVWPGEAYPLGATYDGAGTNFAVFTEAADRVELCLLHDDGSETAVELRESDAFVRHAYVPGVMPGQRYGYRVHGPYAPERGLRCNSAKLLLDPYARAISGEVQWGEEVYGYHFGAPERRNDLDSAPHTMTSVVVNPYFDWGDDRRPRTEYHHTVIYEAHVKGLTMRHPGLPEELRGTYAALAHPALIEHLTGLGVTALELMPVHQFVNDHRLVDMGLNNYWGYNTVGFFAPHNAYASWGDRGQQVLEFKSAVKALHEAGIEVILDVVYNHTAEGNHLGPTLSFKGLDNPSYYRLADDPRYYMDTTGTGNSLLMRSPHVLQMIMDSLRYWVTEMHVDGFRFDLAATLARQFHEVDRLSSFFDLVQQDPVVSQVKLIAEPWDVGEGGYQVGNFPPLWTEWNGKYRDTVRDLWRGEPRTLAEFASRLTGSSDLYQDDGRRPLASINFVTCHDGFTLHDMVAYNDKHNHANGEDNRDGESHNRSWNCGVEGDTDDPAVLELRARQMRNFIATLLLSQGVPMLSHGDEFARTQRGNNNAYCQDNELAWVAWPEDGHDLLEFTRAMVWLRKDHPVLRRRRFFHGRPVQGTHDELSDIAWFTPEGAEMAQRDWNSARASALTVFLNGNAISEPGTRGERIADDSFLLMFNAAPRPLDFVVPVDHGRQWEVVVDTVLTAGVPAGTGPKVQAGDRLTLLDRSLTVLQRPV

SEQ ID NO: 6724 - protein, 462 aa, Unknown
  Mesorhizobium sp. BNC1
MATPTDLVAASFRPPAPSPRQTPPSTLQMMRIVYRNPLELWGEPSYNEPWVQLTGGIGGPLLIANDPGLIRHVLVDNARNYKMARVRQKILRPILRDGLLTAEGEVWRRSRKAMAPVFTPRHISGFAGPMLQKAEAFAERYEQAIGGTVDVSRDMTMLTFDILSETLFSGEVAGDPGGFAHQVDRLFETMGRVDPLDLLGAPDWLPRITRILGRNSLAFFRNIVARTMEMRKEKLAGGDAEVPEDFLTLLLRAEGPQGLSRGEIEDNIITFIGAGHETTARALGWTLYCLANLPEERERIEAEIDSVLSSEPDPVKWLDAMPLTRAAFEEAMRLYPPAPSINREAIENDSYSDLKIAAGTQVLVMPWTVHRHRKLWDDPDAYRPSRFHPENREKINRFQYLPFGAGPRVCIGATFAMQEAVIALAVLMSRYRFDLLPETKPWPVQKLTTQPQGGLPMGVSRR

SEQ ID NO: 6725 - protein, 839 aa, Sorghum bicolor
MTRLLSSYLLTVIFTVFLLLLKASAAGTPSDTLSSSSNITDGETLVSSGSSFTLGFFSPAGVPAKRYLGVWFTMSPEAICWVANQETPLNNTSGVLVVDDSTGTLRLLDGSGHTAWSSSSSTTTTSSAPPPPVVLPQAQLLDSGNLVVRDQSTGDVLWQWFDHPGNTYLAGMKFGKNLRTGAEWTTTSWRASNDPAPGDYWRSLDTRGLPDTITWHGNVKMYRTGPWNGQWFSGIPEMASYLDLYSNQLVVGADEIAYSFNTTAGAPISRLLLNENGVMHRLGWDPVSLVWTSFAEAPRDVCDNYAMCGAFGLCNMNTASTMFCSCAVGFSPVNPSQWSMRETHGGCRRDVPLECGNGTTTDGFKMVRAVKLPDTDNTTVDMGVTLEQCRERCLANCACVAYAAADIRGGDHGCVMWTDAIVDVRYIDKGQDMYLRLAKSELVEKKRNVVLIILLPVTTCLLALMGMFFVWVWCRRKLRGKRRNMDIHKKMMLGHLDETNTLGDENLDLPFFSFDDIVSATNNFAEDNMLGQGGFGKVYKGILGENREVAIKRLSQGSGQGTDEFRNEVVLIAKLQHRNLVRLLGCCIHGDEKLLIYEYLPNKSLDSFIFDAARKNVLDWPTRFRIIKGISRGVLYLHQDSRLTIVHRDLKTSNILLDADMNPKISDFGMARIFGGNQQEANTNRVVGTYGYMSPEYAMDGAFSVMSDTYSLGVILLEIISGLKITSTHSTSFPSLLAYAWSLWNDGKAMDLVDSFVLESCSANEALRCIHIGLLCVQDNPNSRPLMSTVVFMLENETTLLSVPKQPMYFSQWYLEAQGTGENTNSSMNNMTVTVLEGR

SEQ ID NO: 6726 - protein, 323 aa, Candida albicans
MPATTPIIYEDSLFESQDLFASPVKQQHQKVDTVATKNEIGLELNLGLPEMQKASETVSTPFQIHSSVLESGFSTNLDGVNDIDHTPMFDELDLIMDGAKVNSSEDWVALFGDDNDDGVAIAGATSKEPMLSLNEDNENNDDDADDADDDDDALVPREDTIEALLLEPSPNRTISAATSASTSSLNSPESTIATTVTAGGEVVVASKKQFQLVTPNPSSTLPTPLLDSKNSKKRVKVDHLGCVTYSKKHRSQPLQPIVVDDIKDAAALKRAKNTEAARRSRARKMERMSQLEDKVENLINEKQALQDQVERLQELLRVNGIQF

SEQ ID NO: 6727 - protein, 735 aa, Coccidioides immitis
MMASVLQDLAWGSLRKRMEEETDPDESPEAGEQEFWTSWALFILILLLIAALFTSYMLKQKRVQAVHETVLSIFSGMVVGLIIRVSPGTLIQKSVSFNYQFFFNLLLPPIILASGYELHQANFFRNIGAILTFAFAGTFISALVLGLILYLWTRIPLDGLNISFVEAISVGATLSATDPVTILAIFNVYKVEPKLYTVIFGESILNDAIAIVLFETAQRYKPGSTAGSLTVLSLFEAIGIFLLVFFGSLLIGVVVGVVTALGLKYTHVRREPKIESCLIVLVAYASYFFSNGVHMSGIVSLLFCGITLKHYAYYNMSRRTQLTTKFIFQILAQLSENFIFIYLGLDLFTEENLQFKPLFILVTVVGICVARYMSVFPLSKAINWFIRYRARRRGKDVADELPFSYQAMLYWAGLRGAVGVALAAGLEGTNAPALRATVLVVVVLTVIIFGGTTARMLEILDIRTGVAEEVDSDDEFDIEMTDGGTYYKRSGTGIGHTPRRSDFTIPLDSVHITNGLDSSPHAGESYATSRHSGPSPQPGDGRGNLASRKPAGYNQRDRNPRSRDAASSQALLGSRSVSQNGSASGSSADEAAMHSRNRATSRAASKALADTDPDLEDFDLELDSISDDDHLPPAAPSHRASRTPSRLSTRAPHEPSPVSGQAASSSSPAPAVTAGQAQSQQGRPIFSGATSAFRDLLSGAGSRDHAEWFKQLDEEYIKPKLLLDQGSGHKEPGAA

SEQ ID NO: 6728 - protein, 494 aa, Unknown
  Dehalococcoides sp. BAV1
MKILLVNPGTEYKPRFRTYAVFPNGLLYIASVLERAGHEVRIFDNVVSELTPPDYAKDFAPEVVGFSVLTGPCIGNALVQSKEFKALLPGVKVVWGNVHATCTTEQTLKEEAIDFVVRGDGEYTFLDLIDHLEKGEENYAEIQGLAWKDREGRVTINQPRPFIHNLDELPNPAWHLIDVPKYWDITLNTSRGCPFKCSFCYNIPFHHGHRADLSVERIVAQIEHLQKNYKVKFIRFFEDNFTFNRKRMREFCQTVIDRRIKIKWDTESRADMSEEDVALMAKAGCTSVGIGVETGSKRMLEYLNKGVDLDEMGRTFWRFVKHGIMPRLYIMLAVPTETVEDFTETQDMLHRMEDPPFMYMRFVPYPGTPLYNQLVQDNRIKPPESLGEWAKFSVYFATKGNLSELSDEVINQAISHWAHSYASRRVMFTLRHNPRYLLSAVKNPAEFFKAVSSLIKNSLPVVFNKNTNIKPLVLEAVPNKMHGKQEPRLISNYE

SEQ ID NO: 6729 - protein, 507 aa, Staphylococcus aureus
MLNADLKQQLKQLLELMEGNVEFVASLGSDEKSKELKELLTEISDMSPRLSLSEKSLKRTPSFSVNRPGEETGVTFAGIPLGHEFNSLVLAILQVSGRAPKEKQSIIDQIKNLEGSFHFETFISLTCQKCPDVVQALNLMSVINPNITHSMIDGAVFREESENIMAVPAVFLNGEEFGNGRMTIQDILSKLGSTADASEFENKEPYDVLIVGGGPASGSAAIYTARKGLRTGIVADRIGGQVNDTAGIENFITVKETTGSEFSSNLAAHIDQYDIDAMTGIRATDIEKTDEAIKVTLENGAVLESKTVIIATGAGWRKLNIPGEEQLINKGVAFCPHCDGPLFENKDVAVIGGGNSGVEAAIDLAGIVNHVTLFEFASELKADNVLQDRLRSLSNVDIKTNAKTTEVVGEDHVTGIRYEDMSTGEEHLLNLDGIFVQIGLLPNTSWLKDAVELNERGEIVIDRNNNTNVPGIFAAGDVTDQKNKQIIISMGAGANAALNAFDYIIRN

SEQ ID NO: 6730 - protein, 252 aa, Oryza sativa
MALASTSATASAAVLKTPFLGAKRALANAVGVAGAKPAPRRALVVSAKKSWIPAFKSDAEFINPPWLDGSLPGDFGFDPLGLGKDPAFLKWYREAELIHGRWAMAAVLGIFVGQAWSGVPWFEAGAQPEAIAPFSFGSLLGTQLLLMGWVESKRWVDFFNPDSQAVEWATPWSRTAENFSNATGEQGYPGGKFFDPLGLGGETRDGVYIPDTDKLDRLKLAEIKHARLAMLAMLIFYFEAGQGKTPLGALGL

SEQ ID NO: 6731 - protein, 559 aa, Xanthomonas campestris
MTESFAELFEASQANLAKLKPGSIVTGTVVEVRGDVVVINAGLKSEGIVPIEQFRNDAGEIDVGVGDQVKVALDSIENGFGETVLSREKAKRAMVWDELEEALEKNETITGRISGKVKGGFTVDIKDVRAFLPGSLVDVRPVRDPAYLEGKELEFKLIKLDRKRNNVVVSRRAVVESEHSEEREQLMDKLQEGAILKGVVKNLTDYGAFVDLGGIDGLLHITDMAWKRVRHPSEVVNVGDELDVRVLKFDRERNRVSLGLKQLGEDPWDNIARRYPANSRVFGKVSNVTDYGAFVEIEPGVEGLVHVSEMDWTNKNVNPSKVVQVGDEVEVMVLDVDEERRRISLGMKQVAANPWETFAATHKKNDKVSGQIKSITDFGIFIGLDGGIDGLVHLSDISWNTTGEDVVRNYKKGDTLEAVVLAVDPERERISLGVKQLEQDPFGQYMASNPKGSKVEGVVREVDAKGATIDLADGIEGYVAARDIANERVDDATQHLKVGDKIEAKFVGMDRKGRTLQLSIKAKDDAEMREVLEEYQSASGGTTQLGALLRAQLNSNKSE

SEQ ID NO: 6732 - protein, 163 aa, Candida albicans
MSDFYEFAPNDIKGTPYSFKKLQGKVVLIVNVASKCGFTPQYKGLQDLKQKFADQPVEILGFPCNQFGHQEPGTNEEIEKYCREYFGVTFPVLSKVETNGKNAEPVYKFLKSQKPGLLGLHRIMWNFEKFLIDQDGNVVARFSSFTKPETIGLRIEEMLKHQA

SEQ ID NO: 6733 - protein, 161 aa, Candida albicans
MSQFYELAPKDAKGEPYPFEQLKGKVVLIVNVASKCGFTPQYKGLEELNKKFADQPVQILGFPCNQFGHQEPGSNEEIGSFCSLNYGVTFPVLDKIEVNGDNTDPVYKYLKSQKSGVLGLTRIKWNFEKFLIDQNGKVIERFSSLTSPESIGTKIEELLKK

SEQ ID NO: 6734 - protein, 246 aa, Oryza sativa
MAHRVDNEYDYLFKIVLIGDSGVGKSNILSRFTRNEFCLESKSTIGVEFATRTLQIHRYRATEIVQVDPVQKYFRRRVTFWGGRKGIEGKTIKAQIWDTAGQERYRAITSAYYRGAVGALLVYDITKKQTFENIQRWLRELRDHADSNIVIMMVGNKSDLNHLRSVPEEDGQALAEKEGLSFLETSALEALNVEKAFQTILKDIHQIISKKALAAQEAAGSGPPTQGTTINVTDSAVNTKRGCCSS

SEQ ID NO: 6735 - protein, 702 aa, Methanobrevibacter smithii
MLLINLYYLNKLFGDYKMVEIKYVPTICPYCGTGCGLNFVVKDDKIVGVEPYKRHPVNEGKVCPKGNFGYEFINREDRLTTPLIKENGEFREASWDEALDLVANKLKEVSDDDPNKVGFYACARSPNENIYITQKLARVACGTQNVDHCARICHGPTVAGLATTFGSGAMTNGFDSIKEADYIFCIGSNNMEAHPLFGRKLIQAQKNGAKLVVLDPRYTPTAKIADEYVQFKTGTDVALMNGMIKVIIDNDLQDDEFIKNRTKGFDELKETVQKYDLETVSEITHIAPEVIEELAIEYAKADKAAIVYSLGITEHSHGADNVMSTANLAMLTGNIGREGTGVNPLRGQNNVQGACDMGALPSDYVGYRKVADQETTDWFNEYYGTNLPAKPGLTLVEMMNAAHAGDLKVLYIHGEDPVLSDADIKHTKEALANLDMLIVQELFMTDTAQCADVVLPAAGWGEQEGTFTNGERRVQCLHKAQEPPEGAMLDWKIMEEIAVRMGVPREKFHYESAEEIFEEIRECAPIFAGMNRERLDTPEALHWPCPSVDDPCQPLMHKDKFAHPDGLGIFQALEHRGPVEVPDEEYPLLLTTTRVLFHYHAAMTRRCKTLDNEVKTGFIEINTEDAKELGILNNEIVKASSRRGEIEIPARVTDDIKKGIVNIPMHFTECAANMLTNSDSFDPKCKMVELKACAIKVEKIEE

SEQ ID NO: 6736 - protein, 294 aa, Xanthomonas campestris
MTRHLLPVALIQERNHGDAEANLAVIESRVAEAAAQGAKLVLLQELHNGAYFCQHESVDVFDLAEPIPGPSTERLGALAKQHGVVIVASLFERRAAGLYHNTAVVLEADGRLLGKYRKMHIPDDPGFYEKFYFTPGDLGFTPVDTSVGRLGVLVCWDQWYPEAARLMALAGAELLLYPTAIGWDPDDAQAEQERQRDAWVLSHRGHAVANGVPVLSCNRVGHEPSPIGASGIQFWGNSHVLGPQGEFIAEAGQDPTILVCDVDLQRSEHVRRIWPFLRDRRIDAYGDLLKRYID

SEQ ID NO: 6737 - protein, 349 aa, Brassica napus
VNLNLSETTDKIIAEYIWVGGSGMDMRSKARTLPGPVSDPSELPKWNYDGSSTGQAPGEDSEVILYPQAIFKDPFRGGNNILVMCDAYTPAGEPIPTNKRHAAAKVFSHPDVVAEVPWYGIEQEYTLLQKDVKWPVGWPIGGFPGPQGPYYCSVGADKSFGRDIVDAHYKACLYAGITISGINGEVMPGQWEFQVGPAVGISAGDEIWVTRYILERITEVAGVVVSFDPKPIPGDWNGAGAHCNYSTKSMREDGGYEIIKKAIDKLGMRHKEHIAAYGEGNERRLTGHHETADINTSSWGVANRGASIRVGRDTEKEGKGYFEDRRPASNMDPYIVTSMIAETTILWKP

SEQ ID NO: 6738 - protein, 379 aa, Pisum sativum
MKVLCSSMLFAPPNANESFMNEQKQCLDNTSSLPLQITNIPSEFIWPDHEKPCLTPPKLEVPPIDLKAFLSDDPKSISNACSKVNHACKKHGFFLVVNHGVDNKLIAQAHKLVDEFFCMQLSEKQRAQRKIGEHCGYANSFIGRFSSKLPWKETLSFRYSADESCRTVEDYFVNIMGEDFRQFGIVYQKYCEAMSNLSLGIMELLGMSLGVGKEYFREFFEGNESVMRLNYYPPCKNPDLAFGTGPHCDPTSLTILHQDQVEGLQVLVDGIWHSVVPKEDAFVVNIGDTFMALSNGMFKSCLHRAIVNDKIVRKSLAFFLCPNEDKIVTPPKELIDKENPRKYPNFTWPSLLEFTQKHYRADERTLDAFSMWLQEKTTT

SEQ ID NO: 6739 - protein, 655 aa, Clostridium perfringens
MRRNFNSKEFNDKYYYDGELGAIYNKEKTIFRVWSPEAKSLELLLYRDGNTESLIERDLLHKKSNGLWELVKKGDLNGVYYKYHIVGEDFEHDFVDPYCKALGVNGYRAMVIDLKKTNPKGWENEKKPSLENPLDSILYEMHLRDFSIDESSGVSLENRGKFLGIVEENTKVPGKEVKTTLDHLKELGITHVHLLPSFDFGTVDEERLDEEQYNWGYDPVNYNVPEGSYSKNPYKGEVRIKEFKEMVLKLHKAGIRVVMDVVYNHTYSGENSNLNLSYPGYYHRQDDFGNFSNGSGCGNELASERLMVRKYMVDSLKYWAREYHIDGFRFDLMALHDIETLKGIREELNKIDPSILIYGEGWNGGESPLPKEEACFKCNIEKFDKLQIAAFSDDMRDGIKGHVSHLKDGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEELLRTKINEKGEFIENSYNSNDFVNKIDWTRKVKYMDLFKYYKGLIELRKEYPLFRLESNKEIREKISFIESKLGINEKGIVAYRLKDNNNEFIVIFNSNNNEVKINLPKGLWGVMVNNKFSGKEIRDEARDFYDIIRKSAYVFKKISN

SEQ ID NO: 6740 - protein, 149 aa, Deinococcus radiodurans
MTTPLDLARGSLYDRIGPDTLALLVHRFYAHVARNPDLAPIFPADLSETARKQLAFLTGFTGGPPLYHELYGHPRLRARHLPFPITPGRARAWLACMNAALRETPGLAEADAHELYAALARVAVHMVNTEEAPDSDSSGEAANATPNAT

SEQ ID NO: 6741 - protein, 307 aa, Desulfitobacterium hafniense
MNNNPWFAIVNPASANGQTRKIWPKIYKRLLDQGVNLEFAYTTGPGDATNLTRQAMHSYTQILAVGGDGTLNEVVNGFFADQKPINPEASLAVLSHGTGGDFLRTLDQKRGLPSLLEVLHRQKIVPIDCGLVQYQDATGQLYTRYFLNVADVGLGGMAVSRVNQHSKFLGGKLSFLLGGIMTILTYKNKNMKCVIDGKIVVNGPANSIWIGNGRFVGGGMMIAPHAELDDGLFDVVVLGNLSMFQLLRHLPKIYQGHHLEVPDVTVHRGKEVSIISNPSAYLELDGEHPGFTPVHFSLIPQGIRLWT

SEQ ID NO: 6742 - protein, 522 aa, Vibrio vulnificus
MLDQAIKQQLTQYLTNLKQDVRLVVSLDDSKGSQDILALANEIADLSPLITVVRDDAASTRKPVMTVTNPEKSTALRFAGLPMGHEFTSLVLALLHSGGHPIKLDAETIEQIAQLDKELDVEVFISLSCQNCPDVVQAFNMMAAINPKIRATMIDGALFQDEVKQRDILAVPSVFVNGELFGQGRMSLTEILNKLDDGAAEKAAASLNEKDPYDVLVVGGGPAGAAAAIYAARKGIRTGIVAQRLGGQVMDTMAIENFISVKHTEGPKLAANLGEHLKEYGVDIITEQQAEKLMGAQYTEDGKIHVNLQSGATLKSNSVILSPGARWREMNVPGEQEYRNKGVAYCPHCDGPLFKGKKTAVIGGGNSGIEAAIDLAGIVEHVTVLEFADTLRADQVLINKANSLPNVDIITMAQTTEVVGDGKRVTGLKYKDRNTDEIKQLDLAGIFVQIGLVPNTEWLKDSDVELSARGEIEIGSRGETSLEGVFAAGDATTVPYKQIIIAMGEGAKASLGAFDYLIRKQG

SEQ ID NO: 6743 - protein, 342 aa, Ralstonia solanacearum
MFLKNAWYVACTPDEIADKPLGRRICGERMVFYRGQEGKVAALEDFCPHRGAPLSLGFVRDGHLVCGYHGLTMKADGKCASMPGQRVGGFPCIRQFPVVERYGFIWVWPGDPEQADPARIHHLEWAESEAWAYGGGLYHIQCDYRLMIDNLMDLTHETYVHATSIGQPEIEEAAPQTKVEGDAVVTSRFMENIMPPPFWATALRGAGLADDVPCDRWQICRFTPPSHVLIEVGVAHAGKGGYHAAPEHRVGSIVVDFITPETETSIWYFWGMARNFRVDDAALTDTIRQGQGKIFSEDLDMLESQQRNLLAYPERNLLKLNIDAGGVQSRRVLERLLERERQ

SEQ ID NO: 6744 - protein, 148 aa, Triticum aestivum
HLMFLSARNESSESEDIQELINSSLKCNASTPADDMESGRGGAGAAGSTSSSPSPPVVLPSEQKARYSREEDPGRCSCSDSFFGKYFSFLLLMFVTASLVILPLVLPPLPPPPSMLMLVPVAMLLMLLVLAFMPTSGGRGATGPTAYL

SEQ ID NO: 6745 - protein, 220 aa, Unknown
  Burkholderia sp. 383
MAKNRFNQHWLHDHINDPYVKMAQREGYRARAAYKLKEIDEQDKLIRPGQVIVDLGATPGSWSQYARNKLAQGKKRDTEREGGIDGTIVALDILPMEPIADVHFLQGDFREDEVLHQLEEVLEGRDVDLVISDMAPNLSGVASADAARIEHLCDLALEFAQNHLKPDGALLVKCFHGSGYSQIVEKFKQQFKTVAPRKPKASRDKSSETFILGRHLKRPR

SEQ ID NO: 6746 - protein, 261 aa, Arabidopsis thaliana
MVHEQLNLIRKIVGILGNFISLCLFLSPTPTFIHIVKKKSVEKYSPLPYLATLLNCLVRALYGLPMVHPDSTLLVTISGIGITIEIVFLTIFFVFCGRQQHRLVISAVLTVQVVFVATLAVLVLTLEHTTDQRTISVGIVSCVFNAMMYASPLSVMKMVIKTKSLEFMPFLLSVVGFLNAGVWTIYGFVPFDPFLAIPNGIGCVFGLVQLILYGTYYKSTKGIMEERKNRLGYVGEVGLSNAIAQTEPENIPYLNKRVSGV

SEQ ID NO: 6747 - protein, 393 aa, Hordeum chilense
MAAPVSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLNSGGNAYVIGDPAKPGQKWHIYYATEQPEQPMVTLEMCMTGLDKTKASVFFKTHADGHVSCAKEMTKLSGISDIIPEMEVCDFDFEPCGYSMNAINGSAFSTIHVTPEDGFSYASYEVQGMDASALAYGDIVKRVLRCFGPSEFSVAVTIFGGRGHAATWGKKLDAEAYDCNNVVEQELPCGGVLIYQSFAANEELAVSAGSPRSVFHCFENVESGHPLVKEGKLANLLAWRAEEESLEEGTGALLCE

SEQ ID NO: 6748 - protein, 362 aa, Ipomoea nil
MALSTSAIGFEGYEKRLEISFFEAGIFSDPEGRGLRALSKEQLDKVLKPAECTIVSSLSNNEVDSYVLSESSLFVYPYKIIIKTCGTTKLLLSIPPILELADGLSLKVKSVKYTRGSFNFPEVQPYPHRNFSEEVAILDGYFGKLGTGSKAYVMGGAGKQQQWHVYSASAESAENTFPIYTLEMCMTGLDKKSASVFFKTQSSSAAVMTDASGIRKILPGSDICDFDFEPCGYSMNAVEGGTISTIHVTPEDGFSYASFEAMGYDFKDVNLDALIQRVLSCFQPAEFSVALHCDSIGEKLDSVFELDVKGYACGERSYEALGKGGSIMYCGFTSTGSCGSPRSTLLCCWSENEDQEGEKKHF

SEQ ID NO: 6749 - protein, 65 aa, Zea mays
  misc_feature (24)..(24): Xaa can be any naturally occurring amino acid
  misc_feature (43)..(43): Xaa can be any naturally occurring amino acid
MSVGEHFFQYPMSTSGMTLHICQXNSHHIIKAYFIAFGRTLRXAIDYDLRYQGTISDSKGVLSRS

SEQ ID NO: 6750 - protein, 853 aa, Bacillus cereus
MMQITKRLINKTVLLLTLIVMLSSVFSFQSVKAVSNSKTTEIIIHYKEKLGNTKDWNLWLWGENANGTSYQFTGEDEFGKYAKIKIDGDYNRVGFIVRTNEWEKDGGDRWIENIKDGRAEVWILSGDEKVYNSKPSSDLSIQKATIDSFHEITVTTNVPFHIKEKKIEIEGIKIKNITPYDINSGDITNKVKIITEQKIDLKQTYKVKIENLADTNTEIGKVIRSEEFDNLFYYGGNDLGNTYTPQHTKFRLWAPTASEAKLVTYKKWNDKIGTEINMQQGEKGTWTAELKGNQKGLFYTYKVKIGDKWTEAVDPYVRAASVNGDKGAVVNLEETNPKKWKANKKPKFKNPEDAIIYELHVRDLSIQPESGIKQKGKYLGVTEKGTKGPEGVKTGLDHIKDLGVTHVQFLPIFDYASVNEETLNEPQYNWGYDPKNFNVPEGSYSTNPYEPTVRITELKQMVQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFINGKENMEDRIKKGITAGIDYDTNSSTYQDPEQVLTYVEAHDNHTLWDKLELTNPGDSDEVRTQMHKLSSSILLTSQGIPFLHAGQEFMRTKYGDHNSYKSPDSINQMDWLRRATFNNEVDYMKGLIELRKKYSAFRMTSAEQIKTHVSFIDAPKNTVAYIIEGNKHEYFTVAHNANREAVEITLPSKGPWKVLVDGKQARSKPLYVVHDNKIKVPALSSIVLKSEKTIK

SEQ ID NO: 6751 - protein, 230 aa, Oryza sativa
MQQQQLCSSHCLPARAGSIASPGSGRRVVPLGRRRASLGKVTAYAYPTTRRVVDAAKSSLLQDVHVAASNPSLQLLQDYAPAKKSAKQQNGSRTKDGFYEVEMTVQDDELDEYGVVNNAIYASYIHSRDVFLENVGVGVDYWTSTGNALALSELNLKFYTPLRKDDRFVVRMKVVKIKGVRIIVEHLIETLPDRKLVVDAKATAVCLDNKYRPTRVFPELSTKLHQFFLS

SEQ ID NO: 6752 - protein, 647 aa, Burkholderia thailandensis
MKLLLVDNLVMPEEGSLAYLDVHPHLGLLALAAVAEADGHRVQIYDPKRLIRDGTLAYDATLYERASQAILAARPDGVGFTALGCSFLFALNVAALLKRREPDLPVLLGGPHATMLHRQILERFPQFDIIVRYEADEILPAVLDCLPHRTFDVIPGLSWRATGRGSPLRFTDGKPKVEDLDLLPIASYDHYPVEELGLSMLRIEAGRGCPFACTFCSTAGFFQRSFRLKSAERLVRELDILHQRYRVSDFKLDHDMFTVNRRKVMEFCEAVAGRDYRWRASARIDCVDEALLKKMADAGCVNLYFGVETGSERMQKLCKKRLDLQRVEPILAAADSFGIETTASFITGYPEETGEDQDDTLDMIGRCARRASCLTQLHMLAPEPGTPLFDERGAEIAYDGCGGPYNTRLLSSSDERAVLGHPDIFQTYYHYPAALPRARYIFAVGAADLLRRVGPVIFAYALRGFGGRLSTLISAWRQFADETSPGAPADAAGLEAFIAARFGRGHHLHSLFRYALRLYAARAPADVIVEGPYEPDRPCMLAENVGLLEDIHNCDALVDRIRRSTEGAPMLGDADVGGLGTYIVQGHGEAATGYWVESGIATLLDLFRSPRSCRAVAQWLADATRNDGIDASIFEPLLRRGILVSAG

SEQ ID NO: 6753 - protein, 210 aa, Oryza sativa
MHHQIWRLLPSALSPIHAGAPRPSRPPARLGRPSPQRRRALALTHLATRRTCRLLAVSAQSASPHAGLRLDQFFEVEMKVRDYELDQYGVVNNAIYASYCQHGRHELLESVGISADAVARSGESLALSELHLKYYAPLRSGDKFVVKVRLASTKGIRMIFEHFIEKLPNRELILEAKATAVCLNKDYRPTRISPEFLSKLQFFTSEGSSS

SEQ ID NO: 6754 - protein, 313 aa, Arabidopsis thaliana
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTAGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 6755 - protein, 306 aa, Schizosaccharomyces pombe
MPISSHSHSGQFCLHAQGKLEDVIQEAIQQGFQSFSFTEHTPRDRVEDLYPEELHLQPEDLFKTFDEYVNEARRLKQNYGDQINILIGAETEYIRPESVELLKSLNTKYNLDYFVGSVHHVNSIPIDFSPELWQKALQHVGNNPEQLFIDYFEHQYDLMQRLHPLVIGHFDLICLFAPEDAKEVFKNSKSVWELIQRNIKYAVSYGGIFEINTSAFRKGWKTAYPQQRLLELMVEQGAQLTLSDDSHGPHQVGLNYHLAKSYLDKCGITSLCMIEKGPDGNGTVVKNVTVDNVWSKFVGTNGITNT

SEQ ID NO: 6756 - protein, 532 aa, Saccharomyces cerevisiae
MKAFTSLLCGLGLSTTLAKAISLQRPLGLDKDVLLQAAEKFGLDLDLDHLLKELDSNVLDAWAQIEHLYPNQVMSLETSTKPKFPEAIKTKKDWDFVVKNDAIENYQLRVNKIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTVAAGKDVYNFLELFFDQFPEYVNKGQDFHIAGESYAGHYIPVFASEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDYLNQDYVKEAVGAEVDHYESCNFDINRNFLFAGDWMKPYHTAVTDLLNQDLPILVYAGDKDFICNWLGNKAWTDVLPWKYDEEFASQKVRNWTASITDEVAGEVKSYKHFTYLRVFNGGHMVPFDVPENALSMVNEWIHGGFSL

SEQ ID NO: 6757 - protein, 355 aa, Triticum aestivum
MASPATPRPALIRPRASRSRSQLGAVSLASDHAAATASSGRRRDFVFVVNPSGANGRTGKQWKQLLPFLHTRLADQCNICECITSGPSHAIDVTREAIKDGADAVIAVGGDGTLHEVVNGFFWKGSPVRALDRGPDHLTALGLIPLGTGSDFARTFGWSNDPHQAIDRIVRGVKSKLDIGMMEGPNGDPHFFINVADIHLSAKAGYFASMYKRFGNLCYVLGALRGFWGHSNRDLRIKVNGGEWRTVDKVTALCVGNAKYFGGGMKITPTVDPFSGDLQVVIIQDFKWYSFLLKLHRLYGGTHLTVNGVSSIRVQSIEVVEVVPNGDVFVQSDGEHFGFLPTKFSVLPGAVDFFS

SEQ ID NO: 6758 - protein, 229 aa, Candida albicans
MVKSNVESAWETMEDTFSEIQNKFHQIYKPIDTGKPDEDDETTKKESLDITDDSTLSVSPITQLLYLARSKFYDLTPLDNSKSPFPFKNLRGKVVLIVNVASRCGFSFQYNGLEQLNKRFANDDFVLLGVPCNQFLWQEPGTNDQIVTKCKKKYDVSFQILDKINVNGEQADPVYKFLKAQKEGLWGTNRVKWNFEKFLIDKNGRVVERYSTFTRPVAITPRIEQLLES

SEQ ID NO: 6759 - protein, 318 aa, Corynebacterium glutamicum
MIGAPPDMGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 6760 - protein, 361 aa, Unknown
  Synechococcus sp. WH 5701
MTVTPSEISSTEAELDPTGVGPIDLDPTSETSADLNLDIPEEVPTADDPSSRAVSRDTDGAGFTLEEFASLLSKYDYNFKPGDVVNGTVFAMEPKGAMIDIGAKTAAFMPLQEVSINRVEALSDVLQPGEIREFFIMSEENEDGQLSLSIRRIEYQRAWERVRQLQKEDATIYSEVFATNRGGALVRVEGLRGFIPGSHISTRKPKEDLVADFLPLKFLEVDEERNRLVLSHRRALVERKMNRLEVGEVVIGTVRGIKPYGAFIDIGGVSGLLHISEISHEHIETPHTVLNVNDQMKVMIIDLDAERGRISLSTKALEPEPGDMLTDPQKVFDKAEEMAARYKQMLLEQAEENEPMGVTLD

SEQ ID NO: 6761 - protein, 932 aa, Haemophilus influenzae
MLINATQKEELRVALVDGQRLFDLDIESPGHEQKKANIYKGKITRVEPSLEAAFVDYGAERHGFLPLKEIAREYFPDDYVFQGRPNIRDILTEGQEVIVQVNKEERGNKGAALTTFVSLAGSYLVFMPNNPRAGGISRRIEGDERTELKEALSSLDVPDGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLVSRNVETTVVTEQPAVESAVVALSISEAAPTPVERKSNEPSLLAKIIAKIKGLFATKSEENKPKNNRTSRNPNRNQRRSQDRRSSRRPRSENNETERNEEQVRNVRERNQRRPRRNESITESAVNSTPVFEAKEERTEPVTQRRQRRDLRKRVRVEDNETNETVVENNFSTTEKMPEVDVITVQNNDEKPVHQNQRSERQERQRRTPRHLRAANNQRRRRNQEPKSPMPLFAAVVSPELASGKAWIDYSTVNLPKENHFLSVDELLEQEKTKKGFITPAMGIIVEEKSPDVKPALDFITQPANESVQKKVQESLDRLSSYKPQEVVESIDPAINVDEPETLEKVSKFVRTYEFNGRLGTISSVPHTKAEMTLAKANDEMPEAFPIRAWQDSRYYFYGKGAAGHHCAISHVYSEPTRAKSE

SEQ ID NO: 6762 - protein, 336 aa, Secale cereale
MLSLHMALLLGVVFASILTRAASVGVCYGMSANNLPPASTVVGMLRDNGFNSVRLYAPDSDALAALAGTGIGVIVGAPNYVLPELASSASAAAAWVRANIAAHPDVTFRYLTVGNEVAGSDTQYLVPAMENVHGALAAAGLGDAVKVTTAISQATIAVHVPPSAGEFADESKPFLLPVLQFLERTGAPLLANLYPYFVYTYKAAGDMDVSFMLFTAPGTVVQDGEYGYQNMFDASVDAVHAAVERLGVSGVEVVVSETGWPSAGGEEASVENARTYNQNLVSHVGKGTPRRPSKVETYVFSMFNENLKEAGVEQNWGLFYPSTDKVYPITSASEVD

SEQ ID NO: 6763 - protein, 464 aa, Escherichia coli
MSKQQIGVVGMAVMGRNLALNIESRGYTVSIFNRSREKTEEVVAENPDKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCITYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRIAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRTDKEGVFHT

SEQ ID NO: 6764 - protein, 488 aa, Oryza sativa
MSAAAEGRPPAAAAAGEMVREATAWCALHGLVVGDRADPRSGTVPGVGLVHAPFSLLPTHLPESHWRQACELAPIFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESYPFMLFLSSTWSKHKIYTPLTIHYTWHNDYQENFVRDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEGGVAAGFAVLDSLYLTDKAM

SEQ ID NO: 6765 - protein, 525 aa, Mannheimia succiniciproducens
MNGVIIVNILRKTLSSLAIVGLGFAMANSAVAEEKAMATHQQAQQLQQPAPETAAKRAPTKEELTPVNPNLKIEAANEKFAADFPRQYNSWAKTAEQTEFHKEVEDDPRMIVMWGGYAFAKEFNSPRGHIYAVTDVRNILRTGSPKDANGGPQPMACWTCKGPDVPRLIAEWGEEGYFSGKWAKGGAEVVNSIGCADCHDTQSQDFKDGKPALRVARPHVLRALDTVGKTFATSDRTDQRAGVCANCHVEYYFDKSTGANNVVFPWYKGRDVDSIEKYYDEIGFKDWEHSISKAPMLKAQHPDFETWSMGTHGKNGVTCVDCHMAKTQDKDGKVYTDHQVVGNPVKDNFQNTCARCHDQSQDTLIKTVEQHKADVREVMLKLEDQLVKSHFEAKTAWDNGATQEEMKDALQAIRHAQWRWDFAAASHGMHMHAPDVALKIIASGLDRVADARAKLAVILAKHGVQQPIQYPDISTAEKAWKVMGIDIEKERKEKEEFIKTVIPEWNKEAISKGLILTAPPTTPAK

SEQ ID NO: 6766 - protein, 337 aa, Oryza sativa
NVASTPRNVGSSKQTRHHLPAGHGRRRRRHAAQQHRPHPSRRRLRRRRRVAPVQPRQALLPAPGHLRRAGVVPRAGRALPGARPHHRRQRRGVRHGDVRRPLDAPPLRRRRVLPSDRLHNHEHAIICLSLAVYAAAALHLDRARAPARGTLGLLLVAAVFAQELLVFHFHSTDHAGVEGQFHWLLQVVVAACLATSLLGVGYPRSFAVGLARSACVAFHGLWLAVIGAMVWVPSLVPRGCELVREDGRDTVRCRSKESLHRAKALANLQFGWYLSFMTVFVVALYLYVSNRYPAAEEAAYAPLQKAGAGDGDDDGDDDAHKGGGAGVHGFAALEIEV

SEQ ID NO: 6767 - protein, 417 aa, Oryza sativa
MERVPLLRDAALSAPRQLFVGSCSQATRWGASALVDTVSSLAISPSTLDLVAGRRPTAETGTELFYYFVESERSPSTGPVILWLTGGPGCSGFSGVVFEVGPMKYVLEPYNGSLPRLVYNQYSWTQMASILFLDTPVGSGFSYAHDPKGYNVGDISSSLQVVTFLKKLQGYIVGNPITGSKIDDNFKIPYSHGVGIISDQLYEAAVANCNGDYVTTTNELCAKALNAIDNLMSEVDYGNILDDKCVRATPKPINEVSRSRSLLEDYIRLSEPTVRPTINCFSYRYYLSFLWMNNNLTREALKIKKGTVGEWIRCKTGLPYVQDVASSIKYHFDLTTGGYRALVFSGDHDLILPFLSTQAWIRSLNFSIVDEWRAWHVDGQAAGFTILYANNLTFATVKCPALHNSHTGFLKNPKQGL

SEQ ID NO: 6768 - protein, 142 aa, Oryza sativa
  misc_feature (29)..(30): Xaa can be any naturally occurring amino acid
  misc_feature (33)..(33): Xaa can be any naturally occurring amino acid
  misc_feature (55)..(55): Xaa can be any naturally occurring amino acid
  misc_feature (72)..(72): Xaa can be any naturally occurring amino acid
  misc_feature (83)..(83): Xaa can be any naturally occurring amino acid
FRASFPLVCVCAVRCGRRRRVAIGAPEVXXSSXNISVFPMEACDLIGGEACNVQXYPRRPQLSSSAAVAVSXRAAAEEVDRDXYRSLVRASPPRCVPEEACDESWAERCLQGHRSPSVPVQWRSWRSCRSQSVSVRRASTYR

SEQ ID NO: 6769 - protein, 465 aa, Triticum aestivum
  misc_feature (214)..(214): Xaa can be any naturally occurring amino acid
  misc_feature (255)..(255): Xaa can be any naturally occurring amino acid
HYRTSLYKKAGWYRSGIPGISSTHASAHASARSGKAPGVGLLHAPFALLPMSFPKVYWEQALELAPLFNELVHRVSLDGDFLQQTLARTKEVDPFTRRLLDIHSKMMELNKKEDIQLGLTRSDYMVDGATDKLLQVELNTISTSSNGLACGVSELHRNLIRHHERELGLDPASVVGNTAITQHAEALATAWAEYNNQSAVVLVVVQAEERYLPXGITVALREMYGVTTIRKTMAEIEAEGDLRPDGTLVINGRPXAVVYFRAGYSPADYPSEAEWRARLLIERSSAIKCPSIAHHLVGTKKIQQELAKENVLERFLDNQSDIENVRKCFAGLWSLENDIIVNSAIESPELFVLKPQREGGGNNIYGDNLRETLIRLRKDGSNETAAYILMQRIFPPASPSYLVREGTFVRDNVVSEFGIFGAYLRNNDKVIINDQCGYLLRTKAASLNEGGVVAGYAFLNSIFLT

SEQ ID NO: 6770 - protein, 586 aa, Triticum aestivum
MITGTDFYHVMTAVVPLYVAMILAYGSVKWWGIFTPDQCSGINRFVALFAVPLLSFHFISTNNPYTMNLRFIAADTLQKLMMLAMLTAWSHLSRRGSLEWTITLFSLSTLPNTLVMGIPLLKGMYGDESGSLMVQIVVLQCIIWYTLMLFMFEYRGARILITEQFPDTAGAIASIAVDPDVMSLDGRRDMIETEAEVKEDGKIHVTVRRSNASRSDIYSRRSMGFSSTTPRPSNLTNAEIYSLQSSRNPTPRGSSFNHTDFYSMVGRSSNFAAGDAFGPVVRTGATPRPSNYEEDKAGGNNNSKYGQYPAPNPAMAAPQKPSKKAANGQAKGEDGKDLHMFVWSSSASPVSDVFGNGTEAYNDAAAKDVRVAAASPRKADGVERDEFSFGNKERDAEAGDEKAAAEQGTAGLVAAPTVMPPTSVMTRLILIMVWRKLIRNPNTYSSLIGLIWSLVCFRRNFVMPAIIMKSIAILSDAGLGMAMFSLGLFMALQPRIIACGNKRATFAMAVRFLTGPAVMAAASIAVGLRGTLLHIAIVQAALPQGIVPFVFAKEYSVHPDILSTAVIFGMLIALPITLVYYILLGL

SEQ ID NO: 6771 - protein, 466 aa, Oryza sativa
MGSHRHRSAGQCSLVQPPSLITCLLLLLLLLLSPPALPCSASSSSSSSSSVITHLPGFLGRLPFYLETGYIGIEEKTGTELFYYFVESETNPDTDPLVLWLVGGPRCSAFSGLAYEVGPLNFVLEAYNGSLPRLVYNQYSWTQMASIIFLDSPVGSGFSYARDSNGYDVGDISSSLQVVTFMKEWLNDHPRYRSHNFYVGGASYAGKVVPVIVQYISEGSKFDKNFHVPYSHGVGIISDQLYEAAVTHCKGDFVNPTNQLCANVVYTINKLMSEVSDGNILEDKCVKAAPKPTIDVSASRALLEEYSRLSKPPIRPSMDCASYGYYLSYCWMNDNTTRDALKIKKGTIGEWLRCNRGVFPYAEDIPNALDYHFNLTTRGYRALVMSGDHDLKVPFLSTQAWIRSFNFFIVDDWRAWHVDGQAAGFTITYANNLTFATVKGGSHVATVNRPKESFAMGKRWLANKPL

SEQ ID NO: 6772 - protein, 368 aa, Oryza sativa
MDMASIECVSYSDSMDDDDDDGVGVGGVSHLPRPILVKPSSAAAAVNVVVVSAGSGGGAGGGGVGVGVVAGAPAVPPATSVHELLECPVCTNSMYPPIHQLGHWEPEELLSMLSVILLECQNGHTLCSTCKTRVHNRCPTCRQELGDIRCLALEKVAESLELPCKYYSLGCPEIFPYYSKLKHESQCNFRPYNCPYAGSECSVVGDIPFLVAHLRDDHKVDMHSGCTFNHRYVKSNPREVENATWMLTVFHCFGQYFCLHFEAFQLGVAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 6773 - protein, 355 aa, Unknown
  Gerbera hybrid cultivar
MVIQATTRVESLSTSGIHQIPKEYIRPQEELRSITNIFDEEANKQKPQVPTVDLTDIESDDPEKRHKCLEELKKAAMEWGVMHVVNHGVSGDLIGRVKAAGEGFFGLPVEEKEKYGNDPDGGRTQGYGSKLANNASGQLEWEDYFFHLVFPEEKRDLTIWPTTPSDYTDATTEYAKQLRALATKILPALSLGLGLEEGRLEKEVGGIEELILQLKINYYPKCPQPELALGVEAHTDVSALTFILHNMVPGLQLFYDGQWVSAQCVPDSIILHIGDALEILSNGEYKSILHRGLVNKEKVRISWAVFCEPPKEKIVLKPLPETVSEAEPPLFPPRTFRQHMEHKLFRKNKDEVMQN

SEQ ID NO: 6774 - protein, 254 aa, Hordeum vulgare
TGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKNWEDVLLELGVEGSEPGIVGEEIAPLA

SEQ ID NO: 6775 - protein, 355 aa, Unknown
  Gerbera hybrid cultivar
MVIQATTRVESLSTSGIHQIPKEYIRPQEELRSITNIFDEETNKQKPQVPTVDLTDIESDDPEKRHKCSEELKKAAMEWGVMHVVNHGVSGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLIYDGQWVSAQCVPDSIILRIGDTLEILSNGKYKSILHRGLVNKEKVRISWAVFCEPPKEKIVLKPLPETVSEAEPPLFPPRTFQQHMEHKLFRKNKDEVMQN

SEQ ID NO: 6776 - protein, 255 aa, Oryza sativa
MLRPPTPTRRLLQSVGGGSNPNRIPGIPPADPPSGGVSSDVVVILAALLCALICVVGLAAVARCARNRRNSGGAGAGAGSASPSHSPAHAGHFGGGGSGGGGVTTTTAATTAAKGLKKKALKALPKLAYADAVAAAAAARGTVVGEEEEGKVEVLAECAICLSEFGEREEVRVMPQCGHGFHVACVDTWLRSNSSCPSCRRPIVLDDPSPPKRCRKCEAIVLEAVVAASSSSSSSAATATGSGGGGGGGGGRFLP

SEQ ID NO: 6777 - protein, 601 aa, Unknown
  Mycobacterium sp. MCS
MCGATGEVRLDGRTPDLAAVSAMAETLSPRGPDGAGAWSQGRVALGHRRLKIIDLSEAGAQPMVDSDLGLAIAWNGCIYNYQQLRDELRGHGYSFFSTSDTEVLLKAYHHWGDRFVDRLYGMFAFAIVERDSGRVLLGRDRLGIKPLYISEDAHRIRFASSLPALVAGGGVDTRIDPVALHHYLSFHSVVPPPLTILRGVKKVPPASLVAIEPDGRRTTTTYWTPDFTRHADRADWSEQDWEDAMLTALRRAVERRLVSDVPVGCLLSGGVDSSLIVGLLAEAGQTGLQTFSIGFESVNGVAGDEFKYSDIVAQRFGTDHHQIRIDTARMLPALDGAIGAMSEPMVSHDCVAFYLLSQEVAKYVKVVQSGQGADEVFAGYHWYPPMAEPGAASVEGSVASYRAAFFDRDPAALGGLVTPPYFADGDPSGRFVTEHFAREGAATGVDRALRLDTMVMLVDDPVKRVDNMTMAWGLEGRVPFLDHELVELAATCPPEYKTAQGGKGVLKEAARRVIPAEVIDRPKGYFPVPALTHLEGPYLDMVRDALSAPAAKERDLFRPEAVDRLLADPNGRLTPLRGNELWQMALLELWLQRHGITGPAA

SEQ ID NO: 6778 - protein, 315 aa, Clostridium difficile
MENVYDLVIIGSGPAGLAAGLYGARAKLKTLILEKDKTGGQIVITHEIANYPGSVPNATGPSLIARMVEQCKEFGAEMLRDNIVDTELDGDIKVLKGEKAEYRAKAVIIGTGATPRKIGCPGEKELTGKGVSYCATCDADFFEDFEVFVVGGGDSALEEAMYLTKFARKVTIVHRRQGFRCAKSVEEKAKANPKIEFLLDTVIEEIKGDGILESVVFKNKVTGETHEYFADEEDGTMGVFVFVGLDAQTDLFKGKVDMDEKGYIITDEDMRTNIPGVFAAGDCRSKTLRQVVTATNDGAIASIVAEKYIDEKFGN

SEQ ID NO: 6779 - protein, 257 aa, Solibacter usitatus
MNTPELFSLKNRVAVVLGGTSGIGLAIARGFAQAGAITIASSRDQAKVDSTAAELEALGARTLRLTSDVQDRASLQRLCDETVLAYGQVDVLMVTSGALKKAPSAELTDEDWERVVDINLNGSFRANQVFGRQMLKQKRGSIINTCSMTTFVSFGEVAVYSASKAGVNMLTKSLACEWATQGVRVNAIAPGVFRTPLNTNALDIPERMAAIIGRTPMGRVGHVDELVGCAIFLASDASSFVTGQTIPVDGGFLAKGI

SEQ ID NO: 6780 - protein, 264 aa, Synechococcus elongatus
MSFSAGVYFVGVGPGDPELMTVRAQKLIAAADVLLYTDSLVPPAILADARPDAERLPTAHRTLEEILPILKERVAAGAIVARLHDGDPSLYSTIAEQIAGLRSQDIPYQVIPGVSAFQAAAARLGQELTLPGLVQTIILTRCAGRIGLPDRESLSSLAAHQASLCLYLSARQAEKAQTELLEHYSPETPIAVCYRLGWPDEAIWLGKLSELAQITQDQQLDRTVLYLISPALQAVETGRSQLYNPDYHHLFRPETTAARSPQPS

SEQ ID NO: 6781 - protein, 406 aa, Desulfitobacterium hafniense
MSNSYDLIIIGGGPAGLAAGIYGGRAKLRTLIINKGTIGGMVDTTREIVNYPGYIHTSGPDLMSDFKKHAESFGVEFLKDEVVSTELSQDLKKVTTKKKKEFYGKAVIIAAGTQPRLLNIPGEKELRGSGVAYCATCDAEFFQDEDVVVVGSGDQAIEEGMFITKFARKVTVIVLHDEGILDCNKVSAEKAFQNEKMEFVWNSTLEAVLGEENVEGVQVKNLKTGGSSLLPCQGVFFFVGMIPATEFLQNSGIEMDRRGYIPVNDLMETNLPGIYAVGDNRVKYLRQVVSAAGDGATAAVAAERYIEELEAFQKNILHSEKKVLLAFFNAANTASLEFTVVMEELIQEHSDMYKLVKVDMATKKSLAEKYGVTNVPAVVMLDKGEKIKELECSLDKEILAEQLGKE

SEQ ID NO: 6782 - protein, 255 aa, Gossypium barbadense
MLRSLALTTSSSSSLVAKPFFSFSQASLTLSAPISLPFPQTRRSISLHTRPMNILKSLGFGANNKPTASMDNCAIAQGPEDDVPPPGQQFAQFGAGCFWGVELAFQRVSGITKTEVGYSQGFMHNPSYEDVCSGTTNHSEVVRVQYDPNECSYDTLLHVFWARHDPTTLNRQGNDVGTQYRSGIYFYSPEQEKAAVESMEKQQKLLNRKIVTEILPARKFYRAEEYHQQYLAKGGRFGCKQSAEKGCNDPIRCYG

SEQ ID NO: 6783 - protein, 170 aa, Glycine max
IRLEEERDDTLRIQRLRKKFYFHFQDYVDLIIWKVQFLDRHHLLIKFGSVDGGVSRNADHHPAFVAVYNMDTTEIVSFYQNSPDELYLLFEQFCDHFHATSRNSMYMNFISSHSNNIHALEQLRSIKDKASSSAQFVKKMLASLPFSCQSQSPSPYFDQSLFRFDDKVYY

SEQ ID NO: 6784 - protein, 341 aa, Brassica napus
MAAKLLSTGFRHSTLPENYVRPLSDRPRLSQVSQLEDFPLIDISSTDRSRLVQKIHQACARFGFFQVINHGVSKATIDEMVSVAHEFFGMPMDEKMKLYSDDPTKTPRLSTSFNVKEEEVNNWRDYLRLHCYPIDKYVHEWPSNPPSFKEVVSKYSREIRELGLKIEELISESLGLEKDYMKKVLGEQGQHMAVNYYPPCPEPELTYGLPAHTDPNALTILLQDATVCGLQILIDGHWFAVNPRPDAFVINIGDQLQALSNGVYKSVWHRAVTNTENPRLSIASFMCPDNGAVISPAKPLWEAKEEEAKPIYRDYTYAEYYKKFWSRNLDQEHCLENFLND

SEQ ID NO: 6785 - protein, 754 aa, Ralstonia solanacearum
MLRLPSHLSPGKPYPLGAQWDGLGINFAVFSANATRIDLCLFDPTGRKELARLPLPECTDEVWHGYLPGVESGLVYGYRAYGPWEPYRGHRFNPHKLLLDPYARRLVGALRWSDALFGYRLNSSRADLSFDRRDSAPACPKAVVTDESFNWGNDVRPNTPWSRTVIYEMHVRGASMLRDDLLPPERGTFAALADPVFIEHLRALGVTAVELLPVHAFLQDRFLVERGLRNYWGYSTLAFFAPEPAYLSTPTLHEMKVAIRRLHAAGIEVLLDVVFNHTCEGNELGPTLSFRGLDNASYYRLVPGQERYYINDTGCGNTLNLSHPRVLQMVMDALRYWVNACHIDGFRFDLGVTLGREGLGFDPGSGFFDAVRQDPVLATVKTIAEPWDVGPDGYQLGNHPPGFAEWNDRFRDGVRRFWRGDAGQRPELAARLTGSGDLFGRRYRRPWASINYAASHDGFTLRDVVSYTHRHNEANGEDNRDGHHDNCSANWGVEGPTDDAAILAQRARVARALLATVLLSNGTPMLLGGDEFGRTQQGNNNAYCQDNAISWLDWSMRAQAEGRALFAYTARLIALRKTSPALRWPHFVHGEAEVLPGVPDIAWFDERGQPLTPDAWNDAEARALALRRACIETIDGEARPHVALTLINGAAADLIFTLPGPAMDWLLAIDSAAPEREARPHAEPTVRVQGRSVVLLLATQLAAIAQIASAPEREAAGQTVGRVPDRPVEAGAGAGVQPHPDETVPATGQGEALP

SEQ ID NO: 6786 - protein, 106 aa, Oryza sativa
VGIDTKPRYQRIEWPMNRKYGHAYEALKIIDNKPNAILDSITYYEKETEAHRQEGTNEAPAHTHDGKDALFKNIKRRMTPEPIKIRADVDMKCIQCDGGLDIKQAM

SEQ ID NO: 6787 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 6788 - protein, 817 aa, Oryza sativa
MASLPAPPTPLGSCPRGRGGGRVVARPRRAGLACAARSCYRFRTDDDGVVDVAVSGEDGDGGGGGYAVSVEVPGTRGREGGLVLRASGSGEGVPLAPAAGGASLAAELSFDPTRAPFYLSFLLTDASGAEIRTHRKTSFRVPVGVGPGSPAPLGMSISGDGAVNFAVYSKNANAVSLYLYAAAVGGGGGDEPALEIDLDPYIHRTGNVWHVSLASVDGYVSYAFCCGGIRRPLLDPYAKVIGDFVSSNSVYDEGVTAPSMRCFASLAIAPSYNWGRDRHPRLPLEKLVVYRANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEVVFTHTAEGESECQTISMRGIDNSSYYIANGIAGCKASILNCNHPVTQKLILDSLRHWVLDFHVDGFCFINAPFLVRGPGGEYLSRPPLLEAITFDPVLSMTKIIADPWSPLDISNVQFPFPHWKRWAEVNTRFSIDVRKFLKREALISDLATRLCGSGDLFSTRGPAFSFNHVSRNSGLSLVDLVSFSNDDLLSESSWNCGEEGPSENSAVLQTRLRQIRNFLFILFVSLGVPVLNMGDECGHSAAGSVSYKDRGPLNWRGMKTTFVKEVTGFISFLTALRSRRGDIFQRREFLKLENIHWYGSDLCEPGWDDPTSNFLCMHINAEVDEMAADSVRGDLYICFNANEESRRNNAVVSRRWGMKAAQMESPSWPCSSGDSVGNLVIIRFETNRLSLLTANEMSGLVALAKIFLRRLIIVFYRCKVLMGT

SEQ ID NO: 6789 - protein, 112 aa, Unknown
  Acinetobacter sp. ADP1
MEQTMSANIVNTTDANFQADVLDAETPVLVDFWAGWCAPCKAIAPVLEDLSREYEGKVKIVKVDVTACEDTAVKYNIRNIPALLLFKDGKVVAQQVGAAPRSKLAAFIDENV

SEQ ID NO: 6790 - protein, 254 aa, Hordeum vulgare
TGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKNWEDVLLELGVEGSKPGIVGEEIAPLA

SEQ ID NO: 6791 - protein, 215 aa, Pseudomonas aeruginosa
MVLRSEILTKKSELPTPDQALPGRESAMPVPEAHFVNGRPLTAPFPAGLQQVLFGMGCFWGAERRLWQQPGVWVTAVGYAGGYTPNPTYDEVCSGLTGHSEVVLVVYNPQETSFEQLLKVFWEAHDPTQGMRQGGDIGTQYRSVIYTFDAAQKAAAMASRESFQAELAKAGYDRITTEIADVPPFYYAEAYHQQYLAKNPNGYCGLGGTGVCLPA

SEQ ID NO: 6792 - protein, 177 aa, Bacillus cereus
MRDISAEGGDILFVGTKKQAQEAIKEEATRAGMYFVNQRWLGGTLTNFQTIQKRIKRLKDIERMQEDGTFEVLPKKEVVQLKKELERLEKFLGGIKDMKGLPSALFVVDPRKERIAVAEARKLHIPIIGIVDTNCDPDEIDHVIPANDDAIRAVKLLTSKMADAILEAKQGEETVTA

SEQ ID NO: 6793 - protein, 386 aa, Thermosynechococcus elongatus
MYNATNSRSRMFRYEVVGLRQTAETEKTNYAIRNSGSQFFNVPYDRMNQFMQQITRWGGKIVSIQPLNGTVAPLAATTEPAANNGAAPVKEKKVDIPVNIYRPNNPCIGKVISNEELVREGGEGTVKHIIFDISGTELRYLEGQSIGIIPAGTDANGKPHKLRLYSIASTRHGDFQDDKTVSLCVRRLEYKDKETGETIYGVCSSYLNQLQPGDEVKITGPVGKEMLLSDDPEATIIMLATGTGIAPFRAFLWRMFKENNPDYQFKGLAWLFFGVAYTANILYKDELEAIQAQYPDHFRLTYAISREQKTPDGGKMYIQGRIAEHADEIWQLLQKKNTHVYMCGLRGMEPGIDEAMTAAAAKNGADWQEFLKGTLKKEGRWHVETY

SEQ ID NO: 6794 - protein, 238 aa, Angiopteris evecta
MQQKNWNINLEEMMEAGIHFGHRTQKWNPKMSPYIFTERKGVHILNLTQTARFLSEACDLVFHAANEGKQFLIVGTKYQVSDLIASAAIKARCHYVNQKWLGGMLTNWSTMETRLQRFQDLENKANTGGFNRLPKREAAILKRQLSQLQKYLGGIKYMIDPPDIVIIADQHKESTAIKECINLGIPTICVVDTDCDPDLTDIPIPANDDARSSIRWILNKLTFAIHEGQSNYMLSKDS

SEQ ID NO: 6795 - protein, 393 aa, Unknown
  Bradyrhizobium sp. BTAi1
MNAPLKQHLIDPEICIRCNTCEETCPEDAITHDNNNYVVDATKCNFCMDCIQPCPTGSIDNWRIVAQAYSIDDQYSWNELPKQAELASGAEGEAVDAEVLALIDAAHTGAGGKSVAPASAAKPAINLYNRDAAAVATVTGNYRLTHDESDVDVHHVILDFADQPFPVLEGQSIGIVPPGLDADGKPHRIRLYSIASPRHGERPNTNNLALTVKREPNGVCSNYICDLKKGDKVQVTGPFGATFLMPNDPAANIIMICTGTGSAPFRGFTEWRRRAMPGASGRMMLFFGARRPQDLPYFGPLQKVPESLLRKHFAYSRVPGEKKVYVQDLLRREEAAVSGLLASAATHIYVCGLKGMEQGVDAALDDICRGSELRWHELRSQMRAEGRYHVETY

SEQ ID NO: 6796 - protein, 448 aa, Streptococcus suis
  misc_feature (364)..(364): Xaa can be any naturally occurring amino acid
MSRKLITINQVKDYVGQEVTIGAWVANKSGKGKLAFLQLRDGTAFFQAVALKPNFIEKFGEEAGTEKFDVAKRLSQETSVYVTGIVKEDERSKFGYELDVTDLEVIGESQDYPITPKEHGTDFLMDNRHLWLRSRKQVAIQQIRNAIIYATYEFFEKNGFIKFDSPILSGNAAEDSTELFETDYFGQPAYLSQSGQLYLEAGAMALGRVFDFGPVFRAEKSKTRRHLTEFWMMDAEYSFLSHEESLDLQEAYVKALIQGVIDRAPQALETLERDVDALKRYIAEPFKRVAYDDAITLLQEHEADEDTDYEHIEHGDDFGSPHETWISNYFGVPTFVVNYPASFKHFYMKPVPGNPERVLCADSXAPEGYGEIIGGSMREDNYDALVAKMDELGMDKSEYEFYLDLRKYGSVPHGGFGIGIERMVTFVAGTKHIREAIPFPRMLHRLHP

SEQ ID NO: 6797 - protein, 523 aa, Karenia brevis
SVLCLAPYRGRMVAPAAGTARAFWFRTDLRLDDQPALSTACEDALSLLPIYVFDPAKFIDLTLAGARKSSARRARFLIESLVNLRRRLEDRGSGLAVAIGDPAVVIADLCASASAIYVTQGICSEETQDEARVESKMKAPALLSRVWGGSLYFPDECGCNPTKAPLLFSNFKKKAEVFGKIREPLAELTKLPSLPGAVCEPDLSQALRFMPTLAELGFESEEINAAEFDDPRGVLPFSGGEDAALTRLQKWIWDDDHLREYWMIRNGMKGEGYSSKFSPWLALGCLSPRRVWKEVQRYEKERVKNKSTYWLVFELMWRDFFVYMALTHGDKLFRKGGITGDRKRSWPGSTTDLDRWKNGKTGDLLVDANMLELLATGWMSNRGRQNVASYLIFNMRVDWRYGAAHFEEHLLDYDPCSNWGNWVAAAGLTGQRVNKFNTLYQLDRYDPSREYVKHWLGNLDDQHSKLDAEVPECSANVSSDSEYIKEAGKNNLQDTSEGASRTKRARGKKSKKKLQSDSVAMGA

SEQ ID NO: 6798 - protein, 1160 aa, Ralstonia solanacearum
MTRNPTVLLVDDALWYKDAVIYQLHVKSFCDSDNDGVGDFPGLISKLDYIAELGVDAIWLLPFYPSPRRDDGYDIAEYRGVHPDYGTMADARRFIAEAHARGLRVITELVINHTSDQHPWFQRARRAKAGSALRDFYVWSDHDKKYAGTRIIFIDTEPSNWTWDPVADAYYWHRFYSHQPDLNFDNPRVLKAVLGVMKFWLNLGVDGLRLDAVPYLVEREGTANENLPETHAVLRKIRAAMDAEFKNRLLLAEANQWPEDTQEYFGNGDECHMAFHFPLMPRMYMAIAREDRFPITDIMRQTPEVPPTCQWAIFLRNHDELTLEMVTDAERDYLWEVYASDRRARLNLGIRRRLAPLLERDRRRVELMNSLLFSMPGTPVMYYGDEIGMGDNIHLGDRDGVRTPMQWSPDRNGGFSRADPEQLVLPAIMGSLYGYESVNVEAQTRDAHSLLNWTRRLLATRKRHRVFGRGSIQFLQPANRKVLAYARALEGEAPILCVANLSRASQAVELDLAAYAQRVPVELIGGTAFPPIGQLPYLLTLPPYAFYWLELRENEPGPSWAQPAAEQLPEFTTLVLRAGLDALADTRQREAHRQLVEREILPTYLPKRRWFAAKDSVLRGAHFAWGTELPVDAASTNRPLAGATRPEVFINEIAVTLGDADGTERTERYLLPLSIAWESATLPALPIQLALARVRRGRHVGYLTDAFTTETFARVLLANLVRGVTLEASDGRVHFEPEPHLAELAEPPVAAETAAVRPAPLPLAPDAPVQWLAAEQSNSSLVIGESVIVKLIRRVAAGVHPEVEMTRHLTRIGYANTAALIGEIAHEGADGERSTLAVLQSFVPNQGDAWTWALDYLRRTIDELAVLTEAVSAGDGDAAPTAVSEARTDTDEALAGYLAFIGAIGTRLGELHVALAGPSDDPAFGTRAADADDAAFWTARVDEELARALDHLAAWQAANGPRAEVGWLLSQRDALLEAARERAQGGLGAMLARVHGDFHLGQVLVAQGDAYLIDFEGEPSRPVDERRRKTSPLRDVAGLVRSLDYVVGAMRQGPEHVAGPAQERRDQLLERFRNASTERFLEAYAAAILASGSDDGACMLDLDLLDLFLLEKAAYEVNYEAANRPTWLPIPLAGLARVARRLLPADVAPPVARDPLGGPP

SEQ ID NO: 6799 - protein, 729 aa, Synechococcus elongatus
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGQPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYGHWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 6800 - protein, 962 aa, Unknown
  Shewanella sp. MR-4
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIDALFDVILGAGHGLDVAALDAQIVAQGSQSIPEALVRQDAILTHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGQAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 6801 - protein, 189 aa, Zea mays
  misc_feature (153)..(153): Xaa can be any naturally occurring amino acid
MDLPYAITPPIFHPVSNLITTVPPVPRLALHREAKEEEEEVMASSMLSSVDVVTSPAQATMVAPFTGLKSSASFPVTRKANNDITSITSNGGRVSCMKVWPPIGKKKFETLSYLPDLTDNELAKEVDYLLRKKWIPWWIPCVEIRCGSRNFVXREHGNTPRNTKRARYWTKWETFPLFRKALNSWLQGV

SEQ ID NO: 6802 - protein, 572 aa, Rhizopus oryzae
MLLVASIVLGPLGYVFYLLYLNYNHVYKKIQSMHKPVMIGNTPECQDRITLEKVSGQLPSWLNGVMYRVGPGVFNIKQKNGITYTIRHAFDGLPMVHRFQLNGSTQTITYNSRHTAKSLEKEISSGADKGLVFFGHVPEVSFLTWLINWIVRLNNLILRPKPIHLTKPDGKSVGVTVTPNYTLPAGVSMNNGLSKKSLVAKTDANVLQKLHAETLVPELVFSYKDYDPHLNGPFSAAHHQFDPETNELFNFSLHLFPKPKMTVFKTSKEGQTTLLAEITHRKSDHSEFRASYIHSFYLTKNYVIIPESPLVYGDQGLNALLQGAVLSSMRWIDQAPLYFHVIHRNEGGLVASIPAPAFYTFHVANAFEEVSLDGDLLLHLDSSAFSDGDIIYQVRNFGGTFLQDDLSLKRTKFNGFTFPPFQQTSFGHLTRHTLNLNQHTAVFAHILAENIEFPRFHQELIGKPYRFVYGCRIIHDKRSTGLAKVDVSNQSVIQHQESGYEYSEPIFIPHPQAKSEDDGVLLSLANHTECCYLVILNAIDMKELARFKIGQFTAITFHGSFVDYAFKSINLN

SEQ ID NO: 6803 - protein, 524 aa, Ralstonia solanacearum
MLDADVKAQLKAYLERLVQPIELVASIDDSEGSRDMMDLLRDVAAQSGMIALTEQRDDAERKPSFLIRRTGTDVGVRFAAIPTGHEFTSLVLALLQVGGYAPKLDDDVIEQIRNIEGDFRFETYMSLTCQNCPDVVQALNVMSVINPRIQHVAIDGALFQDEVEARKIMAVPTLFLNGEVLGQGRMGVEEILAKIDTGAAARDAEKLNARAPYDVLIVGGGPAGAAAAVYAARKGVRTGVVAERFGGQVLDTMSIENFISVPETEGPKFAAALEQHVRQYNVDIMNVQRAVKLTPADEPGGLAEVTLANGAVLKGRSIIVSTGARWRNVNVPGEQEYRNRGVAYCPHCDGPLFKGKRVAVIGGGNSGVEAAIDLAGIVSHVTLLEFGDQLKADAVLVRKLESLPNATILTNAQTTEITGNGEKVNGLRYRHRTNGAEHDVALEGVFVQIGLVPNTEWLDGVVERNRFGEIIVDARGHTSVPGVFAAGDSTTVPFKQIIIATGEGAKAALSAFDHLIRVPLAEAA

SEQ ID NO: 6804 - protein, 180 aa, Streptococcus thermophilus
MLEKDIKKILFSQEDIVTKTKELGQQLTKDYAGKNPLLVCVLKGAVPFMAELIKHIDTHIEMDFMVVSSYGGGTVSSGEVKILKDVDTNIEGRDVIFIEDIIDTGRTLLYLRDMFKYRKASSVKIATLFDKPEGRVVDIEADYVCYDVPNEFIVGFGLDYDEKYRNLPYVGVLKEEIYNK

SEQ ID NO: 6805 - protein, 363 aa, Lolium perenne
MVQPVFDAALLSGQSDIPSQFIWPADESPTPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 6806 - protein, 305 aa, Schizophyllum commune
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGL

SEQ ID NO: 6807 - protein, 431 aa, Colwellia psychrerythraea
MKNTYTSGELEQFFSSDLSSTDGAVQVAIDLEEARQNQQIELIASENIVSKAVMEAQGTVLTNKYAEGYPGRRYYGGCEHVDLVETLAIDRAKLIFKADFVNVQPHSGAQANGAVMLALVKPGDTILGMSLDAGGHLTHGAKPAQSGKWFNAIHYGVRKDDMRIDYDQVLALAIEHQPKMIIAGGSAIPRQIDFAKFREIADQVGAILMVDMAHIAGLVAAGAHQNPLPFADVVTTTTHKTLRGPRGGLILTNNPDVAKKINSAVFPGLQGGPLMHVIAAKAVALGEVLEPSFGAYIKQVLSNARVLASTLQQRGCDIVTDGTDTHLMLVDLRPKGLKGNTTEESLERAGITCNKNGIPFDSEKPMVTSGIRLGTPAGTSRGFGNDEFELIGQWIGDVLDGLVANPEDNSVAEQKVLQQVQQLCLRFPLYS

SEQ ID NO: 6808 - protein, 721 aa, Unknown
  Synechococcus sp. CC9605
MQGQTQSISFDGREIRLTTGRFAPQAGGSVLVECGDTAVLVTATRSGGREGIDFLPLICDYEERLYAAGRIPGSYMRRESRPPERATLTARLIDRPMRPLFPSWLRDDLQVVATCLSLDERVPADVLAVTGASIATLLAGIPFNGPMAAVRVGLLGDDFVLNPSYREIERGDLDLVVAGTPDGVVMVEAGANQLPEQDVIEAIDFGYEAICELIKAQEQLLKDLGITQVKPEKPDEDSTVPAYLEKQCSKAISAVLSKFDQSKDERDTALETVKGEVSETIAGLKEDHAVRQALASSPKLLGNSFKALTKKLMRQQILKDGKRVDGRGLDEVRQISAMAGVLPRRVHGSGLFQRGLTQVLSTATLGTPSDAQEMDDLHPNTEKLYLHHYNFPPYSVGETRPMRSPGRREIGHGALAERAILPVLPEKDTFPYVVRVVSEVLSSNGSTSMGSVCGSTLSLMDAGVPLKAPVSGAAMGLIKEGDEVRILTDIQGIEDFLGDMDFKVAGSEKGITALQMDMKITGLSVKTVAEAVNQARPARLHILEKMLEAIDTPRDNLSPHAPRLLSFRIDPELIGTVIGPGGRTIKGITERTNTKIDIEDGGIVTIASHDGAAAEEAQKIIEGLTRKVNEGEVFSGSITRIIPIGAFVEILPGKEGMIHISQLSEARVEKVEDVVKVGDEVTVRVREIDNRGRINLTLRGVPQAGDAADVEPQPTPVAPLS

SEQ ID NO: 6809 - protein, 364 aa, Solanum tuberosum
MDRVKGPWSPEEDELLQQLVQKHGPRNWSLISKSIPGRSGKSCRLRWCNQLSPQVEHRAFTPEEDETIIRAHARFGNKWATIARLLNGRTDNAIKNHWNSTLKRKCSSLSADEGNELADQIFENQQPPLKRSVSAGSAMPVSGFHFSPGSPSGSDSDSSLHVTSSSQSHVFKPVARTGGVFPQSIDISSPPVDPPTSLSLSLPGVDLAEFSNRSADSTQSKNPFQLLLPPMQIPPPPPPPPPPPPQATTVPFERVSAIQQSLQNPDFGKNAGGEQPDKVFVPFSQELLGVMQEMIKTEVRNYMMGVEQKQQFQQQQQHYQQQPQQFQQQNHQLPSGLGLGLCMQQASDGFRDRAANRMRLSKFD

SEQ ID NO: 6810 - protein, 405 aa, Arabidopsis thaliana
MALQAASLVSSAFSVRKDGKLNASASSSFKESSLFGVSLSEQSKADFVSSSLRCKREQSLRNNKAIIRAQAIATSTPSVTKSSLDRKKTLRKGNVVVTGASSGLGLATAKALAETGKWHVIMACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSESEAGKRLAQVVADPSLTKSGVYWSWNKTSASFENQLSQEASDVEKARRVWEVSEKLVGLA

SEQ ID NO: 6811 - protein, 265 aa, Arabidopsis thaliana
MSNAFLLCQLCTKKQAMVDENVETNASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNTRMYVLENTGDFVNAHGLQLGDFIMVYQDLYSNNYVIQARKASEEEDPAVLYKVGIIRKHCLSICCNEQVTISQNKSIICHPAAALARVSKSLMLHCTR

SEQ ID NO: 6812 - protein, 306 aa, Solanum tuberosum
RIKGPWSPEEDELLQTLVEKHGPRNWTLISKSVPRRSGKSCRLRWCNQLSPQVEHRAFTPEEDDTIIRAHAKYGNKWATIARLLSGRTDNAIKNHWNSTLKRKCPSMSEDLSFETPQPPLKRSSSVGPCTNFSSVMNPGSPSGSDLSDSSLSGFPQPLVYRPVPRTGGIFPLPPPVKQIEIPPSVPDPPTSLCLSLPGSGSIEKPTQSPKSPPLPPPPLPVVDKPIPPSAAVMGHLPRSNQSYDFCAAPKSGEKQFFTPEFLSVLQDMIRKEVKSYMSGFEQNGICMQTDAIRNAVIKRIGISKIE

SEQ ID NO: 6813 - protein, 311 aa, Prochlorococcus marinus
MIWSVDSIPNQEGRIVLVTGANSGLGFDTARFLLNKGAGVILGCRTMQKAELARQKLLEQTPSANIELLEIDLGDLNQVDRAADQIAIKYKKLDLLINNAGVMAPPFTLSKQGLELQFAVNHLSHMALTLKLLPLMSKQDGARVVTVSSGAQYMGKINWNDLQGNNHYDRWASYSQSKLANVMFALELHKRLKKSNCNVASLSSHPGLARTNLQIASVAANGSWQEGFAYKLMGPMFQSSAMGSLPQLLAATDPNAKSGEQYGPRFNFRGYPKLCRVAPLALNMELREKLWELSLKLIRNFIQINSFKEIL

SEQ ID NO: 6814 - protein, 255 aa, Solanum tuberosum
MDFFNRCSTSSSSSESSSSESSLSGKNPNKSERIKGPWSAEEDKILTKLVERYGARNWSLISKYIKGRSGKSCRLRWCNQLSPNVEHRPFSPAEDEAILAAHAKYGNRWATIARLLPGRTDNAVKNHWNSTLKRRYQQLIQQQNQNPIGFSDLKINGSGSGSGSGFGSCMEYLNADESPKGNSNNNNNNNYAVTNNCSGEFDDPMTTLSLAPPGMGGDELPEKKTESFPEGFWDVVRGVIAREVREYVASTGFPN

SEQ ID NO: 6815 - protein, 385 aa, Pseudomonas putida
MAIVIVGAGTAGVNAAFWLRQYGYKGGIRLLSRESVTPYQRPPLSKAFLTSETAESAIPLKPESFYTNNNISISLNTQIVSIDVGRKVVAAKDGEEYAYEKLILATGASARRLTCEGSELSGVCYLRSMEDAKNLRRKLVESASVVVLGGGVIGLEVASAAVGIGRRVTVIEAAPRVMARVVTPAAANLVRARLEAEGVGFKLNAKLTSIKGRNGHVNQCVLESGEKIQADLIIVGIGAIPELELATEAALEVSNGVVVDDQMRTSDTSIYAIGDCALARNLFFGTMVRLETIHNAVTQAQIVASSICGTSTPAPTPPRFWSDLKGMTLQGLGALKDYDKLVVAINNETVELEVLAYKQERLIATETINLPKRQGALGGSIKLPD

SEQ ID NO: 6816 - protein, 309 aa, Pseudomonas aeruginosa
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 6817 - protein, 254 aa, Hordeum vulgare
TGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKNWEDVLLELGVEGSEPGIVGKEIAPLA

SEQ ID NO: 6818 - protein, 398 aa, Unknown
  Mycobacterium sp. MCS
MTDNAYLVGLRLAGRKVVIVGGGTVAQRRLPLLIANGADVHVIARAATPAVEAMTGITLTLRDFRVGDLDGAWYVIAATDDPDVNAAVVAEAERRHVFCVRADVAREGTAVTPASFEYEGLSVGVLAGGEHRRSAAIRSAIHEALASGLISGDDPDTVTTGVALVGGGPGDPELITVRGRRLLAQADVVVADRLAPQELLAELPPHVEVIDAAKIPYGRAMAQDAINQVLIDRASAGKFVVRLKGGDPFVFARGYEEVLACVDAGIPVTVVPGVTSAIGVPALAGVPVTHRHVTHEFVVVSGHVAPDHPESLVNWDALAALTGTIVLLMAVERIELFTKVLIEGGRPAETPVLVVQHGTTTAQRTLRATLADAPERMSAEGIRPPAIIVIGPVAAFGG

SEQ ID NO: 6819 - protein, 545 aa, Wigglesworthia glossinidia
MCSIFGILNIKNNSISLRKKALKCSNLMKHRGPDSNGIYCDEDVILVHERLSIIDVKSGNQPLFNNSKTNVLIMNGEIYNYEEIKKNLIHDYSFNTNSDNEVVLALYKKFGLNFLNKLNGMFAFILYDIEKKIYLIGRDHIGMIPLYMGYDCDNNLYISSEMKALIPVCNYIKEFPIGSYLCNLNKKIIKYYKRNWFEFDSIKNCLLSYKKIKHSLKKSVLNHLKSEVPFGILLSGGLDSSIIASIASKELNYKNLNKKLKSFSIGLENSPDLHSSRICARYLNTDHCEVKFTEQDGLDVIKKVIYYVETYDITTIRASIPMYLISQKIKSSGIKMILSGEGADEIFGGYLYFHNAPSEKDLHDELVRKLKSLHIYDCARANKSMLAFGIEARFPFLDKKFLDVAMRINPKHKMCNKNRIEKYILRKSFINYLPNNILWRQKEQFSDGVGYKWIDSIKNFSKKIISDKKFNNAIHKFPYNTPLSKEEYLYREIFENFFPLPSAAECVPQEKSIACSSEIASKWSKYRNLNFDPSGRSLDIHISKN

SEQ ID NO: 6820 - protein, 233 aa, Triticum aestivum
  misc_feature (90)..(90): Xaa can be any naturally occurring amino acid
  misc_feature (159)..(159): Xaa can be any naturally occurring amino acid
  misc_feature (181)..(181): Xaa can be any naturally occurring amino acid
MHMKERNSVVMALSVVRPSQEEPTLPPAGKQFSNQLAAAVRSTNWSYAIFWSISTSRPGVLTWKDGFYNGEIKTRKVTSSADLSADQLVXQRSEQLREHYESLLSGQCDHRARRPAAALSPEDLGDAEWYYTVCMSYAFRPGQGVPGRSFASNEHVWLXNAQCADTKTFQRALLSKDGAYXTVACIPLMGGVLSSGHTYTVLEERDMVTRITTSFWDLKFPTSEEQNSSPLAE

SEQ ID NO: 6821 - protein, 250 aa, Triticum aestivum
  misc_feature (191)..(191): Xaa can be any naturally occurring amino acid
MANDAFGCDSLCWRCHQGGPDTSPCSVFLSPGENRVQWWRLCRHYFVGSIALESSLVLEASAWWWCGGSGAGSVLVAMVGEWQPQNGQVHDEIDLSIPVDDKDLIWSNTGTMNDDEDVATADEGITDAGSASHMRKRGRHANRQIQELGAMFQQCPHPDENLRIPLSKKVCMDPLPVKFWFQNRRIAKKEXNDRPQNMVLPTENIMLEEENRAMNAALLKKTCPTCKSPMVFFRSLTPDLRRLHMENARP

SEQ ID NO: 6822 - protein, 311 aa, Unknown
  Shewanella sp. MR-7
MFFEGAEKKLEIRLTPKLASLRLREYGFWSTLVACANAEILSTSSNHACDAYLLSESSLFVWDDKILILTCGNSTLIEAASYFINALGTEHIAALCYQRKNEYQAQLQSTSFADDIAKLRLLIPGEAFRMGHLDSHHHYVFCAENQSVSSSETSLELMMYHIRGELAEYLKLPTQTEQGIYQQLGLQQLFGDFQLDMHCFQPAGFSLNAIRGADYFTLHITPSMGQGDNSYISFETNLDLAVYPHPVVARLLDLFSPISWDLINFNQPINTAGFPAHICLGQGLVTTGSGSQISFRHYQQLEPQILQPEFI

SEQ ID NO: 6823 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 6824 - protein, 358 aa, Nicotiana tabacum
MATMASTLASSVVTKTNFLDTHKSSFSGVPLFSQARLKPVKSAQQNMTISMSADSSPPPYDLNAFSFNPIKESIVSREMTRRYMTDMITYADTDVVIVGAGSAGLSCAYEISKNPNVQVAILEQSVSPGGGAWLGGQLFSAMVVRKPAHLFLNELGIDYDEQDNYVVIKHAALFTSTIMSKLLARPNVKLFNAVATEDLIVKNGRVGGVVTNWSLVSQNHDTQSCMDPNVMEAKIVVSSCGHDGPMGATGVKRLKSIGMINHVPGMKALNMNAAEDAIVRLTREVVPGMIVTGMEVAEIDGAPRMGPTFGAMMISGQKAAHLALRALGLPNALDGTAESSIHPELILAAADDAETADA

SEQ ID NO: 6825 - protein, 145 aa, Bacillus cereus
MSMSLYYKKIREQLGHELIFMPSVAAVIKNEQGEILFQYPGGEYWSLPAGAIEPGETPEEAVVREVWEETGLKVQVKKQKGVFGGERFRHIYPNGDQVEYIVVVFECEITSGKLKSIDGESLKLQYFSFSEKPTLALPYPVNIFL

SEQ ID NO: 6826 - protein, 593 aa, Arabidopsis thaliana
MDTPEKSETQIGTPVSKLKVEDSPVFSYICNLSPIKTIKPIPITCPLSSLNYASPPSVFTSPHAVSHKESRFRSQKDVSASKEVGEEEALVGSEPEQSYKNDCNTPRVTNDVKDNGCGKDLQVMMDNVKKKSDTPDWETLIAATTELIYGSPRESEAFSCLLKKTSNSEARLRGSITATSVAVTNTDVVNNESESVDALSILHRGVRRRCLDFEVKGNNQQTLGESSSSCVVPSIGLHLNTIAMSSKDKNVANEYSFSGNIKVGVQSSLTPVLHSQHDIVRENESGKDSGQIIEVVPKSLASVDLTPISPKKKRRKSEQSGEGDSSCKRCNCKKSKCLKLYCECFAAGFYCIEPCSCINCFNKPIHKDVVLATRKQIESRNPLAFAPKVIRNSDSIIEVGEDASKTPASARHKRGCNCKKSNCLKKYCECYQSTQFLAGSLFEQDEENETSGTPGTKKTQQNVELFKPAAPPSTPIPFRQPLAQLPISSNNRLLPPQSHFHHGAIGSSSSGIYNIRKPDMSLLSHSRIETITEDIDDMSENLIHSPITTLSPNSKRVSLSHLDSPESTPWRRNGGGRNLIRSFPTFPSLTPHH

SEQ ID NO: 6827 - protein, 420 aa, Pyrococcus horikoshii
MVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 6828 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINFHGVLEEVIELIKPIASVKKLPITLILAPDLPDNAIGDEKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 6829 - protein, 229 aa, Aster tripolium
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 6830 - protein, 426 aa, Unknown
  Polaromonas sp. JS666
MDMTEIHVIKQHLIDPEICIRCNTCEAICPVQAITHDSRNYVVDAEKCNLCMACISPCPTGSIDNWRTMPRIKAYSLTEQLGWDELPPELTPEELAAEGVVPGAMPEIEPVAPSLPAAVSGETAFNSAQYGATMPPWSAAHGYTNLYGAKAAEKFITATVVGNVRVTEVGKEYDTHHIVLDFGSMPFPVLEGQSIGILPPGTDEASKPHYARQYSIASPRNGERPGYNNVSLTIKRVLQDHQGNAVRGVGSNYMCDLQIGDKVQVIGPFGTSFLMPNHPRSNIVMICTGTGSAPMRAMTEWRRRLRQSGKFEGGKLMLFFGARTKEELPYFGPLQTLPKDFIDINFAFSRTLEQPKRYVQDAMRERAADLGVLLKDPNTYFYVCGLKSMEEGVVLALRDVAQQAGLSWETVGAALKQEGRLHLETY

SEQ ID NO: 6831 - protein, 386 aa, Cucurbita maxima
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGSSFSHHGKAYQECGIALNELGTKIVELLGLSLGISREYFKNFYKDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPACNTLEAFKTWVQEGKALDTGSTITAPSA

SEQ ID NO: 6832 - protein, 462 aa, Borrelia garinii
MFSSIKDILENPILNSNVTINGWIRTKRSNGKIGFIEINDGSTLKGIQAVINEEENQFTEKDLKKLTTGASISLTGLLVESPAKGQNYEIKIYSFNVIGEADSKTYPLQKKRHTFEFLREIPHLRIRTNTFGAIARVRNKISYKIHEYFQKNGFFYINTPIITSNDGEGAGEMFRVSTLKFNKPNNSLSNIDFKDDFFGKEAFLSVTGQLHGEAYAMALSKIYTFGPTFRAENSNTTRHASEFWMIEPEMAFYKLNDNISLAEDLLKYLLSSILNECSQDMDFLENYIEKGLIKKLENVINSNFEVITYTKAIEILESSKKNFEIKPCWGIDLQTDHERYLTEEIFKKPIAVIDYPKNFKAFYMKINKDNKTVKGMDILVPRIGEIIGGSEREDDLQKLENRIKELNLNIEHLNWYLDLRRFGSTPHSGFGLGLERLVQYTTGISNIRDSIPFPRTPKNLYF

SEQ ID NO: 6833 - protein, 198 aa, Escherichia coli
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNANWKSWRRESKHKAFARMSFRLAVLMLLAR

SEQ ID NO: 6834 - protein, 159 aa, Corynebacterium glutamicum
MTSIHDISVTLNDGTETTMADWAGHLLLIVNVASKCGLTPQYEGLQKLYEEYQDRGFFVIGVPCNQFNGQEPGTDAEVCAFAQNQYDVTFPLLSKTEVNGEGAHPLYKVLKEATDGSEIEWNFEKFLVDAEGNTIKRFAPRTEPSAAEVVEAIEENLPI

SEQ ID NO: 6835 - protein, 112 aa, Unknown
  Polaromonas sp. JS666
MKQITAILKPFKLEEVREALAECGVTGLTVTEVKGFGRQKGHTELYRGAEYVVDFLPKVKVEVVVKTDDVERCVDAIVRAARTGKIGDGKIFITAVERTVRIRTGEEDEAAV

SEQ ID NO: 6836 - protein, 761 aa, Solanum lycopersicum
MLRTLASALLVLSFFVSLSAADNGFPRCNCDDEGFWSIESILECQKISDLFIAIAYFSIPIELLYFVSCSNFPFKWVLFQFIAFIVLCGMTHLLNFWTYYGQHPFQLMLALTIFKVLTALVSFATAITLITLFPMLLKVKVREFMLKKKTWDLGREVGLIKMQKEAGWHVRMLTQEIRKSLDRHTILYTTLVELSKTLDLHNCAVWKPNENKTEMNLIHELRDSSFNSAYNLPIPRSDPDVIQVKESDGVKILDADSPLAVASSGGSREPGAVAAIRMPMLKVSNFKGGTPELVPECYAILVLVLPSEQGRSWCSQEIEIVRVVADQVAVALSHAAILEESQHMRETLEEQNRALEQAKQDALRASQARNAFQMVMSHGLRRPMHSILGLLSLLQDEKLGNEQRLLVDSMVKTSNVVSTLIDDVMDTSTKDNGRFPLEMRYFQLHSMIKEAACLAKCLCAYRGYNISIEVDKSLPNHVLGDERRVFQVILHMVGNLLKDPNGGLLTFRVLPESVSREGIGGAWRTRRSNSSRDNAYIRFEVGTSNNHSQPEGTMLPHYRPKRCSKEMDEGLSFTVCRKLVQLMQGDIWVIPNPEGFDQSMAVVLGLQLRPSIAIGIPEYGESSDHSHPHSLLQGVKVLLADYDDVNRAVTSKLLEKLGCSVSAVSSGRDCIGVLSPAVSSFQIVLLDLHLPDLDGFEVTMRIRKFGSHNWPLIVGLTATADENVTGRCLQIGMNGLIRKPVLLPGIADELQRVLLRGSRMM

SEQ ID NO: 6837 - protein, 72 aa, Passiflora serratodigitata
GEVMPGQWEYQVGPSVGIDAGDHIWCSRYILERITEQAGVVLILDPKPIEGDWNGAGCHTNYSTKSMREDGG

SEQ ID NO: 6838 - protein, 414 aa, Xanthomonas campestris
MTIKSLALQCRDAAQVLSQLSADAKQALLLAMANALDTDATQILQANQRDVDAAREKGTGAAMLDRLTLTPARLSAVGAALREVAVLPDPVGQVTRDDVRPNGIRVQKVRVPLGVIAMIYEARPNVTADAAALCIKAGNGVILRGGSEAIHSNTAIARALQGALREANVPEAALTLVEDLRRETMLELLQLSDIVDLAIPRGGEGLIRFVAEHARVPVIKHYKGVCHLFVDASADVDLAVRLLVDGKASRPSACNSLETLLVHADIAERFLPAAAAALRARNVELRGDAATRAVLPEIAAASDDDYAAEFLDLILAIRVVPDLDTALAHIRQYGSDHTEVIATQTPANAETFVQSLRSAVVMVNASSRFSDGGELGLGAEIGISTTRLHSYGPMGLEALTVERFVVRGEGQVRH

SEQ ID NO: 6839 - protein, 314 aa, Rhodospirillum rubrum
MAEHRTKVLILGSGAAGCTAAIYAARANLAPILVAGLQPGGQLTITSDVENYPGFAEAISGPWLMEQMQAQARAVGTEMIDDLIISADLSKRPFVCQGDSGDTYIADTVVVATGASARWLGLQSEKRWSGLGVSACATCDGFFFRGKEVVVVGGGNTAVEEALYLTNHASKVTLIHRRDSLRAERIMQDRLFKNPKVGVVWNSTVEEILGGGDPPGVTGVRLRDTQTGALSELSCDGVFIAIGHTPNTALFAGQLDCDDNGYLITAPDSTATNVPGVFAAGDVQDHIFRQAVTAAGTGCMAAIEADHFLALTQE

SEQ ID NO: 6840 - protein, 767 aa, Solanum lycopersicum
MLAMLRLLFLVLLISLVIISVSANDGEFFNCCDEDGFWSIHTILDCQKVSDFFIAVAYFSIPLELLYFISRSNLPFKWVLVQFIAFIVLCGLTHLLNGWTYNPHPSFQLILSLTVAKILTALVSCATAITLLTLIPLLLKIKVRELFLAQNVLELDQEVGMMKKQTEASMHVRMLTHEIRKSLDKHTILYTTLVELSKTLKLQNCAVWMPNESRSQMNLTHELSPSSAAESHRSLSINDPDVLEITKNKGVRILRQDSVLAASSSGGSGEPCAVAAIRMPLLRASDFKGGTPELVDTRYAILVLVLSSVDERVWSYDEMEIVEVVADQVAVALSHATVLEESQTMREKLEMRNRVLQQAQENAMKASQARTSFQKVMNNGMRRPMHSILGLLSIFQDEKASSDQRMIVDTMVKTSTVLSTLINDAMEISAKDDGRFPVEMKPFQLHLLVREASCLVKCLCVYKGFGFSTDVPTSLPNQVMGDEKRTFQVLLHMVGHLLNVSIGKGSVIFRVVLETGAETGNDKVWGTRRPSTTDEYVTIKFEIEVSLEGSQSDSSISTIHFGGRRHNSKEVTEGLSFNMCKKLVQMMQGNIWMSSNAQGHAQGMTLILRFQKQSSFRKRMFEYRNPLEQPISSTMFRGLHVLLTDDDDVNRLVTRKLLEKLGCQVTAVSTGFQCLSALGPSLTTFQVLILDLQMPEMDGYEVALRVRKFRSRSWPLIIALTASSEEQVWEKCLQVGMNGLIRKPVLLQGLADELQRLLQRGGGGDGL

SEQ ID NO: 6841 - protein, 298 aa, Leptospira interrogans
MFGADTAVEIQMLELEAAIPAAKGVIMELEDCAFPLLQKVTVSSDLDTAFKEINWALLVGSVPRKAGMERGDLLKINGGIFVNQGKAIEKNAASDVRILVVGNPCNTNCLIAMNNAKGISQDRWFAMTKLDENRAKSQLASKAGVPVKEVTHLGIWGNHSATQYPDFYNTKISGKPVTDVISDHEWLKGDFIKNVQQRGAEIIKARGASSAASAANGVVDTVRGIITPTAPGDCFSAAVVSDGSYGAEKGLIFGFPLKSDGKKVEIIQGISLNDFAKEKFKITHEELVSERNEVKEML

SEQ ID NO: 6842 - protein, 497 aa, Solanum lycopersicum
MAHAHANKASLNMLMLCFTLLNLSHNFAFAFTSQDYSNALDKSTRFFEGQRSGKLPANQRLKWRADSGLSDGSGYHVDLVGGYYDAGDNVKFGLPMAFTTTLLAWSVIEFGSSMHSQLNNAKAAIRWSSDYLLKAATASPDTLYVQVGDPNQDHRCWERPEDMDTPRNVYKVSPQNPGSDVAAETAAALAAASIVFKDSDPSYSSSLLRTAQKVFAFADKYRGSYSDSLSSVVCPFSCSYSGYNDELLWGASWLHRASQDSSYLAYIQSNGQTMGANDDDYSFSWDDKRPGTKIILSKDFLEKSSQEFQAYKVHSDNYICSLIPGSPSFQAQYTPGGLLYKGSGSNLQYVTSSSFLLLTYAKYLRSNGGDVSCGSSRFPAERLVELAKKQVDYILGDNPAKISYMVGFGDKYPLRVHHRGSSLPSVHAHPGHIGCNDGFQSLNSGSPNPNVLIGAIVGGPDSRDNFEDDRNNYQQSEPATYINAPLVGALAFLSAPN

SEQ ID NO: 6843 - protein, 507 aa, Unknown
  Synechococcus sp. RS9916
MADLQAQPQLVWFKRDLRTVDNRPLLEACAHGPVLPLYIVEPEYWRQPDASARQWEFCRESLEHLRRELAALGQPLVVRCGEAVTVLERARRSLGIAAIWSHEETGNGFTYDRDRAVLAWTRDRGIPWIQIPQFGVTRGLKRREGWARRWEERMAEPLAPEPPKLLPLSDLALGEIPTAEALQLSPDPCPLRQRGGRESGLQELSDFLTSRVQRYARSISSPVVAFRGCSRLSPYLTWGCLSMREVVQASRTLTGRGVSSFGSRLHWHCHFIQKLESEPAIEFHDFHPFMRGIRPMDSERFQAWKEGRTGVPFVDACMRALLAHGWINFRMRAMLMSFASYHLWLPWRESGLHLARQFVDYEPGIHWSQCQMQSGSTAINTIRIYNPVKQGQDHDPNGRFIREWCPELASLPNVYLHEPWKLDARRAEQLGCRLGVDYPAPVVDPTAAAREAKDRIWEIRRAAGFDRIADGIQQRHGSRRAGLSPVTTRRRSRSEQKGGDQQLQLEL

SEQ ID NO: 6844 - protein, 691 aa, Prochlorococcus marinus
MNPEEIIQQQQAAVKAYQSKDLDAAEAICIQILSVNPKEPNSLHLLGCIYKDRGNLQQAFDLIQASIREDDSTPIPFINLGNILVMVGQHEEAARIFQQSLQRNQQIPESWFCFGNALREIGNVQEAKQAYRNTLQLNAAHAGAASILGALLADEEKLDESEEIFSKAIEASPQDVNLRINYGKLLEDKYEYNAALEQYRFALLLAPESPELHLNFASALKKEGKVEEAIASCRNAIELRPDFEAAYFGLGIVLKENGEFEEAKASYRKAIDLKPDFADAYLNLGHVFKDHGEAEEAKASYRTAIDLKPDFADAYLNLGNILKEEGDVEEAIASYRKAIELKPDFVDAYLNLGTVLNDEGEVEEARQIVSALYNLNVIEESSLLVTSSSNLVLDWHQRKVLNLSLEVESASLFYGFKPFSAFEVVKTVDAWHFPPLFLKGEGDRANEKHLYRNGYLVEDEILPEDLCAEFVNGFEGANAMSAALIRAVSEKGVLGSVLGKIFKHTDFPHLVWNCIYFAKGPDDQAISDAWHYDNHYNVWTPKLMIYLNSQREEGGATEFVDASLSRRLSEETDYMGLIWQRESYADRVKGSVKDLGLDPATLDPDHYTFSPDHAGSGVWFCPSRVLHRGVSPKKGVRHVLSFSLTPLPHDCGWSIDQCVDKSIEILQDKINKGMQKSDVNPYWIPAEAGYA

SEQ ID NO: 6845 - protein, 447 aa, Nitrosomonas europaea
MKYNSIEEFKNYVSERNPGQPEFLQAVSEVIESLWPFIVDHSRYAEQGLLDRLIEPERMIIFRVAWVDDRGEVKVNRGYRIQYNSAIGPYKGGTRFHPSVNLSILKFLAFEQTFKNALTTLPMGGGKGGSDFDPKGKSPGEIMRFCQAYAAELFRHVGADTDVPAGDIGVGGREVGYMAGMVKKLTNRSDCVFTGKGLTFGGSLLRPEATGYGLVYFAEEMLNHSGCSLKGMRVSVSGSGNVAQFAIDKAMSLGAKVVTVSDSSGTVVDEAGFTPEKLAILAEVKNRLYGRVNEFAERVEAQFLPGEKPWHVPVDVALPCATQNELNENDAAILIRNGANCVAEGANMPCTAGAVERFHHAKVLFAPGKASNAGGVATSGLEMSQQAMRLSWTSGEVDMRLQEIMRAIHHSCTEYGKKPDGTVNYVDGANVAGFVKVAEAMLAQGVI

SEQ ID NO: 6846 - protein, 367 aa, Beta vulgaris
MQALLTVPTPVPEFNTSILKHEHNIPTQFIWPDDEKPGSQTPPELQVPPIDLGGFLSGDPVAVSNSTRLANEACKKHGFFLVFNHGVDSKLLAKAHEAMDVFFEQPFSQKQRALRKQGDHCGYASSFVGRFATKLPWKETLSFPYSADHKSSNMVEDYFFNKMGSEFQEFGKVYQEYCKAMSNLSLGIMELLGMSLGVERSHFRDFFEENESIMRLNYYPPCLKPDLTLGTGPHCDPTSLTILHQDHVGGLEVFVDQKWYSIRPNSEAFVVNIGDTFMALSNGIYKSCLHRAVVNSETPRKSLAFFLCPRGDKVISPPNELMEDLKSLRVYPDFTWQLFLEFTQKHYRADMKTLDTFTKWLQNRREQ

SEQ ID NO: 6847 - protein, 606 aa, Zea mays
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEEHGEEFVDMLDGVFSFVLLDTRHGDRAGSSFFMAARDAIGVTPLYIGWGVDGSVWISSEMKALHDECEHFEIFPPGHLYSSNTGGFSRWYNPPWYDDDDDEEAVVTPSVPYDPLALRKAFEKAVVKRLMTDVPFGVLLSGGLDSSLVATVAVRHLARTEAARRWGTKLHSFCVGLEGSPDLKAAREVAEYLGTLHHEFHFTVQDGIDAIEDVIYHTETYDVTTIRASTPMFLMSRKIKSLGVKMVISGEGSDELFGGYLYFHKAPNKEELHRETCRKVKALHQYDCLRANKATSAWGLEARVPFLDKEFINAAMSIDPEWKMVQPDLGRIEKWVLRKAFDDEEQPFLPKHILYRQKEQFSDGVGYSWIDGLKAHATSNVTDKMLSNAKFIFPHNTPTTKEAYYYRMVFERFFPQKSAILTVPGGPSVACSTAKAIEWDAQWSGNLDPSGRAALGVHLAAYEHQHDPEHVPAAIAAGSGKKPRTIRVAPPGVAIEG

SEQ ID NO: 6848 - protein, 478 aa, Rhodospirillum rubrum
MTIPVLVWFRDDLRLADNPALCAALDSGAPVIPFYLLDDSTSDGHRPLGGATRWWLGRSLTSLAESIAQRGGRLVLRRGEALSAVPELAAETDAAALFANRLYGMDSLRDDDLFMVLRVAGLTVRLFDSGLLHRPEAVTTKTGRPFRVFTPFWKTLSATLDPGLPLAAPDSFPPVDDPPPASDSLADWSLEPTTPDWAGGLRDTWQPGEAGAQARLEAFFNGPVADYASGRDRPDKPLTSKLSPHLRFGEISPRQVWTAARHHPPGGGMDAFLRELGWREFCHHLLFQAPTMAEEPLKAEFLAFPWTEAKEIGPALAAWQSGETGYPIVDAGMRELWHTGWMHNRVRMIAASFLIKDLLIPWQHGERWFWDTLVDACPANNAAGWQWVAGCGADAAPFFRIFNPVTQGERFDPEGAYVRRWLPELADLPSSLIHRPWEAPPLILRQAGVTLGKTYPPPLIDHAHARVRALEALAVVNR

SEQ ID NO: 6849 - protein, 187 aa, Unknown
  Fragaria x ananassa
MRKPCCEKTETTKGAWSIQEDQKLIDYIQKHGEGCWNSLPKAAGLRRCGKSCRLRWINYLRPDLKRGSFGEDEEDLIIRLHKLLGNRWSLIAGRLPGRTDNEVKNYWNSHLKKKILKTGTTLRPNKPHENNHAPNNKLVKLFNKMDDEVVDEVSSADSAAGCLVPELNLDLTLSIKTSTGMADPQVA

SEQ ID NO: 6850 - protein, 686 aa, Oryza sativa
MDETAGAEQVRGRNGGGQSGPAERGGRSRAGRRWAAGGAERGRWSGGGRSGSGKKRGTAPSSRRQPAAAHLSAARRDALPGGGRRLASLLPRSSSLAARRLLPLSRRRSTPPLPRRPSPSPALPMLSSSPTAPVVASTSLAAPTTPPSFTPSLPCVPAHRRCPVTTPAPHRQKVERWKKRGVRVTCRSIRRASPPLSSSAAAHWSEKLPLPLPPIDAAAAVAEAPLPMPPLLWRTRMRTGTPWPWPRTTSTSTSASSATPRTPAPPPLPGGSSAWRTSSSSCHRHASQHGRIFSSSGDHRCTPPFLPAGHRPSPGRHCRILIAGTAPGGPAIARVDLFRPPPSPIPLYCPGFLLQLAALAGGRWSRRPSSSPLSPEEERKGERDEERETGRKEEEEERLYACTEETTFISNSTWKSEKIPKPLNPRLMIRNPPRSVPFRSQLAVPGVTGSTPSDLGDSANHFTFHPLPSVLPEKRNISVQALPSSMAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINRCLEEGADEFFLKPVRLSDMSKLKPHILKSRCKEHYQQEQHLQSNSESNNSSNPTSENSSSSTSTNSHKRKAVDEEILPHTIRPRHS

SEQ ID NO: 6851 - protein, 108 aa, Thermosynechococcus elongatus
MTKRDHNKVYNVTLVNEERGLNKTIRVHADEYILDAAEAQGIPLPYSCRAGACVNCAGRIIKGTVDQSDHSFLKPKELDAGFVLLCAAYPTSDCVISTHEEDNLLNLA

SEQ ID NO: 6852 - protein, 108 aa, Pinus pinaster
PSLKICIDHHSCSTYHGGVIPTTRLKSHWMSVIIRTCRVISTLIVALSIPVFGLVMALIGSWLTMLVAVSLPCAGFMSIAGKKITKLELILCIVIMVVGLVSAIIGTY

SEQ ID NO: 6853 - protein, 482 aa, Yersinia pestis
MPCNRLKTEGLPMDYFPIFCQLQHKACLLVGGGEIAERKARLLLDAGALVTVNACEFTPQFHHWADQGQLSLISGEFVPELLADKWLVIAATDQLSVNALVYQSANQQRIFCNVVDDPKRTSFIMPSIIDRSPIMIAVSSGGKAPVLARLLREKLEALLPQHLGQLAGNLRQRVKQHFTVMTERRRFWEKLLTHDRLAQSLANNDHVQADQHVEQLFSAPLTDRGEVVLVGAGPGDAGLLTLKGLQQIQQADVVVYDRLVSDEVMNLVRRDAERIFVGKQSGHHCVPQEQINQILLQQAQSGKRVVRLKGGDPFIFGRGGEELEELAGYGIPFSVVPGITAASGCSAYSGIPLTHRDHAQSVRLVTGHAKKEGQLDWANLAAEKQTLVFYMGLSQAGEIQQQLIQHGMPATTQVALVENGTSRHQRVVSGELSQLALLSQQVSSPSLIIVGSVVSLREKLNWFSSRHHDDQPKVTECVAHVG

SEQ ID NO: 6854 - protein, 548 aa, Wigglesworthia glossinidia
MKNINPTKTKSWNLLKKHFNNMKKVNIKDLFEKDKNRFSSFSICFDDIILIDYSKNIITKETIKKLIQLAKECDLNNAILSMFCGKKINYTENRAVLHTALRNHKNISIEIDGINIIPKIKKVLNKMKNFCSDLIDGNWKGFTGERITHIVNIGIGGSDLGPYMVTEALKFYKNHLNVYFVSNIDGTHITEILKYLSPKNTLFLIASKTFTTQETITNAYSAKDWFLKYAKDKKYLSRHFIALSSNIDEVKKFGINTENIFELWNWVGGRYSLWSCMGLSIALSIGFNNFEKLLRGAYAMDQHFLKQPFEKNIPIILGLISIWYNNFFNFETESILVYDQYMHLFSSYFQQVNMESNGKSIDRNGNLVNYQTGSILWGGYGTNSQHAFYQLMHQGTKIVPCDFIVPIISHNPVSDHHQKLLANFFAQTKALAFGKKSENNHIKLYKYDSNKIKILPFKILPGNRPTNSILIKEINPYNLGSLIAMYEHKIFTQGVVLNINSFDQWGVELGKQLSKKLFSILRKEKILNTSSYDSSTNGLINFYKLWKK

SEQ ID NO: 6855 - protein, 298 aa, Unknown
  Fragaria x ananassa
MGDTFEYNYQNNSSCSSSAPASSVSVAQSHSSTDEISLFLQQILVRSSSLTGQQFLFSSSPAGYALPENLGSPSNDSFVGGVIRGVDVSTAVVTASGPNVSSSSVGASENEADEYDCESEEGLEALVEEAAVKSGGRSSSKRSRAAEVHNLSEKRRRSRINEKMKALQNLIPNSNKTDKASMLDEAIEYLKQLQLQVQMLSMRNGMSLHPMCLPGASQFSQIRMDFGGEENRPVHLNMSGILNMNQDPSTQNLYNPNQSLCTRFVKCSQFRRCIWIGSIYSGSLGTLSAPKLIQGNLQ

SEQ ID NO: 6856 - protein, 243 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSTIFGGVLLALIEGAGIMLNKVLAQPQNMMMEDPGMQGMPGMQGMQGMPGMPGMQGMPGMQGMQMGQMQSQAQIRSESQNQNTASSSSSSSWFGGLFDKKKEEVHPGSESKTEVLESFDAPPVPSFEFK

SEQ ID NO: 6857 - protein, 402 aa, Synechococcus sp.
MYGITSTANSTGNQSYANRLFIYEVVGLGGDGRNENSLVRKSGTTFITVPYARMNQEMQRITKLGGKIVSIRPAEDAAQIVSEGQSSAQASAQSPMASSTKIVHPKTTDTSVPVNITRPKTPFLGKCIENYELVDEGGSGTVRHVTFDISEGDLRYLEGQSIGIIPPGEDKNGKPHKLRLYSIASTRHGDMEDNKTVSLCVRQLEYQDPESGETVYGVCSTYLCNLPVGTDDVKITGPVGKEMLLPDDEDATVVMLATGTGIAPFRAFLWRMFKEQHEDYKFKGKAWLIFGVPYTANILYKDDFEKMAAENPDNFRLTYAISREQKTADGGKVYVQSRVSEYADELFEMIQKPNTHVYMCGLKGMQPPIDETFTAEAEKRGLNWEEMRRSMKKEHRWHVEVY

SEQ ID NO: 6858 - protein, 236 aa, Physcomitrella patens
MKQKSWNINLEEMMQAGVHFGHQARKWNPKMASYIFTERKGIHILNLTQTARFLSEACDLLANASSKGKQVLIVGTKYQAADLVASASIKARCHYINQKWLGGMLTNWSTIEKRLQRFKDLENKEKTGVLNQLPKKEAATLKRQLVQLRKYLGGIKYMTSLPDIVIIIDQQKEITAINECITLGIPTICLVDTDCDPDLTDIPIPANDDARASIRWILNKLTLAISEGRYNSIKTE

SEQ ID NO: 6859 - protein, 122 aa, Emericella nidulans
NDTTGTLIASSYTDPAMKIGCIFGTGVNAAYMENAGSIPKLAHMNLPPDMPVAINCEYGAFDNEHIVLPLTKYDHIIDRDSPRPGQQAFEKMTAGLYLGEIFRLALVDILDTQPGLIFKDQD

SEQ ID NO: 6860 - protein, 225 aa, Triticum aestivum
  misc_feature (208)..(208): Xaa can be any naturally occurring amino acid
MASSQPTRWAALARDTNETKIQLALNLDGGDFPPDTDSRLLDNDDSHASQASKSQKIAVNTGIGFLDHMLHALAKHAGWSLALNCKGDLHIDDHHTAEDVCIALGYAFAQALGTPAGLARFGYAYAPLDEALSRAVIDLSNRPYAVVDLGLKREWLGQLSTEMVPHCLQSFAQGARVTLHVHCLHGDNDHHRAESAFKALAIAVKAAXHRIPGKEGEVPSTKGTL

SEQ ID NO: 6861 - protein, 420 aa, Pyrococcus endeavori
MVEQDPFEIAVKQLERAAQYMKISEEALEFLKRPQRIVEVTIPVEMDDGTVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREARKVLGWGDLKGKTIAIQGYGNAGYYLAKIMSEDYGMKVVAVSDSKGGIYNPDGLNADEVLKWKQEHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDADYVVAVQRVYQAMLDRGWVKH

SEQ ID NO: 6862 - protein, 419 aa, Thermococcus litoralis
MVEQDPFEIAVKQLERAAQYMDISEEALEFLKRPQRIVEVSIPVEMDDGSVKVFTGFRVQYNWARGPTKGGIRWHPEETLSTVKALAAWMTWKTAVMDLPYGGGKGGVICNPKEMSDREKERLARGYVRAIYDVISPYTDIPAPDVYTNPQIMAWMMDEYETISRRKDPSFGVITGKPPSVGGIVARMDATARGASYTVREAAKALGMDLKGKTIAIQGYGNAGYYMAKIMSEEYGMKVVAVSDTKGGIYNPDGLNADEVLAWKKKTGSVKDFPGATNITNEELLELEVDVLAPSAIEEVITKKNADNIKAKIVAELANGPTTPEADEILYEKGILIIPDFLCNAGGVTVSYFEWVQNITGDYWTVEETRAKLDKKMTKAFWDVYNTHKEKNINMRDAAYVVAVSRVYQAMKDRGWIKK

SEQ ID NO: 6863 - protein, 151 aa, Agrobacterium tumefaciens
MERNKMRYLHTMVRVKDLGESLKFYVDLLGLTEIRRIENEKGRFTLVFLSARDDIAAAKENKAPCLELTYNWDTEDYTGGRNFGHLAYEVDNIYDFCARLQQSGIVINRPPRDGHMAFVRSPDGISFEILQKGESLAPAEPWISMQNTGSW

SEQ ID NO: 6864 - protein, 566 aa, Streptomyces coelicolor
MIVNEPVPDTFEDTPAKDRDPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRRNPDGPYGDYYVWADDDKQFQDARIIFVDTEASNWTYDPVRKQYYWHRFFSHQPDLNYENPVVQEEMISALKFWLDLGIDGFRLDAVPYLYQEEGTNCENLPRTHDFLKRVRKEIDAQYPDTVVLAEANQWPEDVVDYFGDYAAGGDECHMAFHFPVMPRIFMAVRRESRYPVSEILAKTPAIPSGCQWGIFLRNHDELTLEMVTDEERDYMYAEYAKDPRMRANIGIRRRLAPLLDNDRNQIELFTALLLSLPGSPILYYGDEIGMGDNIWLGDRDAVRTPMQWTPDRNAGFSSSDPGRLFLPTIMDPVHGYQVTNVEASMASPSSLLHWTRRMIEIRKQNVAFGLGTYTELPSSNPAVLAFLREHEDDLVLCVHNFSRFAQPTELDLSAFDGRHPVELFGGVRFPAVGDLPYLLTLGGHGFYWFRLRKDAA

SEQ ID NO: 6865 - protein, 78 aa, Physcomitrella patens
MKKQNLIDMEGVVTESLPNAMFRVCLDNGCEVLTHISGKIRRNYIRILPGDRVKVELTPYDLTKGRITYRLRAKSSNS

SEQ ID NO: 6866 - protein, 261 aa, Pediococcus acidilactici
MSVISMKQLLEAGVHFGHQTRRWNPKMKPFIFTERNGIYIIDLQKTVKLIDNAYNFVKDVAANDGVVLFVGTKKQAQTAIEEEAKRAGQFYVNHRWLGGTLTNWNTIQKRIKRLKDLKKMEEDGTFDRLPKKEVALLNKQKDKLEKFLGGIEDMPHIPDVLFVVDPRKEQIAIKEAQKLNIPVVAMVDTNTDPDQVDVIIPSNDDAIRAVRLITSKMADAVVEGRQGEDDEAVQQEEVAEGVSKDSLEDLKKTVEEGSNEE

SEQ ID NO: 6867 - protein, 510 aa, Arabidopsis thaliana
MATSDQDRRHRATRNRPPIPRPSNSSSRPVVPPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLTSEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAITYSVPYALISIRIESLGLGQGLSLGVLNLAIVIPQVIVSVGSGPWDQLFGGGNSPALAVGAATGFIGGIVAILALPRTRIQKPIPLP

SEQ ID NO: 6868 - protein, 60 aa, Passiflora sexflora
VMPGQWEFQVGPSVGIDAGDHIWCSRYILERITEQAGVVLSLDPKPIEGDWNGAGCHTNY

SEQ ID NO: 6869 - protein, 71 aa, Passiflora sprucei
GTNGEVMPGQWEYQVGPSVGIEAGDHIWCSRYILERITEQAGVVLTLDPKPVEGDWNGAGCHTNYSTKSMR

SEQ ID NO: 6870 - protein, 1053 aa, Musa acuminata
MAFLIVLALSFSLLAPSSPSPGPASTDQAALLAFKSSVALDPASLLSGWSPVARRHCTWRGVTCDAVSGRVTALNLTGTPSSPLSGRLAAALGNLTELRVLSLPHNAFSGDIPAAAIGSLCRLEVLDLRRNNFSGKIPDEISRLPSLSVLDLSHNSLSGAIPESLIGSSNLQSVDLSFNQLSGKITVDPLGSCSCLTHLRLSSNLLVGRIPPAIGRCTKIQTLLLDRNILEGRIPAAIGQLLDLRVLDVSRNSLTDRIPRELALCQKLSVLRLTNLMDFDSTGGSSNVEEFNAFIGSMPAEIFSIPSLEILWAPRANLDGSLPDSRNGSCSLGILNLGQNYIAGVIPEWLGTCRNLSFLDLSSNYLQGLLPASLGIPCMAYFNISQNSVTGSLPGFLDLDCSYNLASLSKSGDLLVEDNLLIAYSADLLQSTQRDNPFALVLDNSFVVLHDFSQNRFIGPLPSFVMPLDDSFPYGLSLNNNGFNGSISGKLFGSCQVGSGFAVNLTVNKMSGGVNDILTDCWLLKSFEAANNRLHGSIPSEIRNLNLLRHLDLRNNYFNGSTPDKLRGLKSLGQVLLGGNNFSGGIPTQFDGLSSLTVLDLSRNSFTGSIPPSLANATNLEVLLLNNNQLSGTIPPSFSALHRLIELDVSFNNLSGDIPHLEHSTDCKFFLGNSFLKPCQDPSMSAPSGIPFKTEIPDQGHRKSRLKYFTIAAVASASVLVSVLLVLTFVLVSGRRKFVRITSLRKKLVVTFTDVPAELTYENVVRATGNFSIQNLIGTGGFGATYKGELVPGFLVAVKRLSIGRFQGLQQFDAEIRTLGRVRHKNLVTLIGYHMGEIDTFLIYNYLSGGNLETFIRHMSNRNVTWYEVHKIALDVAQALSYLHYSCVPRIVHRDIKPSNILLDEKLNAYLSDFGLARLLEVSQTHATTDVAGTFGYVAPEYATTCRVSDKADVYSFGVVLLELMSGKRSLDPSFSEYGNGFTIVAWGRLLIQENRAGELFSQLLWENGPKDKLVSMLKLALSCTVESLSVRPSMKQTYTENGWHGLMLAGCQ

SEQ ID NO: 6871 - protein, 343 aa, Alkaliphilus metalliredigenes
MTHSSITVLGAGSWGTALSLILAKKGHEVKLWMRNQEQYEEMNRQRENTKYLPGTQLHENIKLYVDIEKAVKGTDVVLLTISSQAVRGVLKNIRSIITREQIIVNAAKGLEANTLLRISQVVEEELGSHPFAVLSGPSHAEEVSKDIPTTVVVAAYERSVAECIQDLFMSSYFRVYTNPDVIGVELGGALKNVIAFGAGISDGLGYGDNAKAALMTRGIREIARLGSAMGGKLETFAGLTGIGDLIVTCTSMHSRNRRAGILTGQGKSLEETLSEIGMVVEGIKTTKAAFELAKQYQIEMPITEEIYSILYKDIPPRVAVSNLMSRDRTHEIEDIVDAEKINW

SEQ ID NO: 6872 - protein, 307 aa, Unknown
  Acinetobacter sp. ADP1
MNTVEPNFLADEFLLDHYVGKTPLVRLQRLACHTQSVVLAKLEGNNPAGSVKDRPAYNMIMQAEKRGKIRPGDTLIEATSGNTGIALAMVAAMRGYKMKLIMPNNMSQERKDAMLAYGAELIEVTQQQGMEGARDLALKMQSEGQGLVLNQFGNPDNVEAHYLTTGPEIWQQTNGKITHFVSSMGTTGTIMGVSKYLKEQNPDIQIVGLQPSEGSSIAGIRRWPQEYLPTIFEPSRVDRIIDIPQIEAEKTMRRLAREEGISAGTSSGGAVWASLKIAEEQPDAVIVCIICDRGDRYLSTGLFSVQD

SEQ ID NO: 6873 - protein, 932 aa, Unknown
  Acinetobacter sp. ADP1
MSNFNKKLSKRLQLNHAYGQLIALIFVPIMVLASVGTVLVLNETSAAAKSQQRHTAAALLTRYEHTASNLLELVERRPEQYDQAQRIMQNMFNERYLKRAAIIDQQGRVYLSIGYRDTRFWPQIPNMVFFGPVTHNHNNIYGQRIQSPLHQAAWLVVEMDNQPLQIAHYRVFLVLIVTGLITLLLLLLCLNFYSRRWIAPMYEIRMQLQRLNADTLDQHMVINSTGELRLLQRDIANVVKRLHFSFLELKEHTEQTEDDLRRTLDTLEVQNITYRQARDQAISANQAKSVFLANISHELRTPLNSIDGFIHLMLRQQNLSNEQRLYMQTIRKSSAHLLALINDVLDFSKIDAGKLELETAAFNLEEAIFDVMDMLSPLAAQKHIDMAFYYGDNIPEIVIGDALRVKQILTNLISNAIKFTPDGEIIVRVRMEHDDIDQCLLHFSVQDSGIGLSGTDRKKLFESFSQGDASVTRQFGGTGLGLAISKQLVQLMHGHIGFEDNQERAPTEKGSTFWFTAQFKTQEAHIIDHPEFPQLQVVSYLAHPATANILRHYLENYEVQHTEITSILELFSRLNHLSSKENTWLIVDHSGDTEALLKEIRQRYTGNLAVYGYQMALEPNMLNEYRARPLYQPLSRSALIQLLSNQPIFEQPPEQFNGRGLHVLAVDDHLPNLIVLEALLSELNVTTSKALSGQEALNIIEQRIEQNEKPFDVVFMDIQMPVMSGIDTTRAIRSLESTLDTQMRLPIIALTAHALADEKQKLLKVGMDDYVTKPIQMEQIIHILNQWSKADFDHPPQNDHQILIDALDPTILDWQQSLQLAANKEDLAYDLLKMLVDSFETELGEMEQLIELEDFPQLEHVLHRLYGATRYVGTPKLQHVTGEFEQFVSTLRKERRKADADFVQNVLKRFEELHLTIREVEGAAKHILSEQQ

SEQ ID NO: 6874 - protein, 456 aa, Desulfitobacterium hafniense
MKVLLIQPPSSTAFMDKVYMYEPLGLEYLGAGLQEDGHEVLLLDARLEPDFEKAFHSFQPDIVGITGYTNHLNIVKAIAARFKEINLDVFIIVGGHHATVKPADYNDQAIDLIVIGEGVFTLRQILKHKESRLPFEDIPGLAIPGAVMKFTAERPYTPLDDLPFPDRSLTARYRSHYFSDWMKPIASIRTSLGCFGRCNFCALWSITNGKYLQRSPERIVAELQGIQEEIVFFCDDESMCDTRRMDQLADLIQEAGIRKKYFLYGRVDTIVKHPELFAKWKNIGLIQVFVGFESFSDERLQGLNKNITVAQQEEAVKILNDLNIDIYASFVIDPSFTRPEFAQLIAYTRKLNIAYAALSVLTPLPGTALYEQNKDRLLTHDPKFFDFMHTVLPTALPLQQFYSEYARTLMKATPIPRYFRFIAKFDRQRRLSTMKELYGVVGDVRKGYQWHQAKES

SEQ ID NO: 6875 - protein, 281 aa, Yarrowia lipolytica
MSIYHDYKRFSKHESAFGGFAASMSGNQMPFSPMLTPKHEAVGEFGKTGHAHAQTAAPQQPQQIDPLVASLTPATGTISPQELMGHSFGNDDFDASPIFGDADLGDCNNWESLFNDDAAAPQASPAPQVAPVAVKAEPDAELMPFPMAFTQNIDSFAPTTVSASVSPASSSVGPESLGGMDVNPLKRPRDGSESPSFENKKDQHGLTAYNRKPRQAPLSPIVVEEGADSVAVKRARNTEAARRSRARKMERMSQLEERVEELLTRNKELEAEVARLRAMQK

SEQ ID NO: 6876 - protein, 198 aa, Herminiimonas arsenicoxydans
MSTSRTAEITRNTNETQIRVAINIDGTGQQKLNTGVPFLDHMLDQIARHGLIDLDIEAKGDLHIDAHHTVEDVGITLGQAFAKAIGDKKGIRRYGHSYVPLDEALSRVVIDFSGRPGLEFHVPFTRSMIGAFDVDLTREFFQGFVNHALVSMHIDNLRGANAHHQCETVFKAFGRALRMAIELDPRSAGTIPSTKGSL

SEQ ID NO: 6877 - protein, 281 aa, Oryza sativa
MAAVVFDAAILSKQEAIPAQFVWPADEAPAADDGVVEEIAIPVVDLAAFLASGGIGRDVAEACERHGFFQVVNHGVDPALLAEAYRCCDAFYARPLAEKQRARRRPGENHGYASSFTGRFDCKLPWKETMSFNCSAAPGNARMVADYFVDALGEEYRHMGEVYQEYCDVMTRLALDVTEVLAVALGLGRGELRGFFADGDPVMRLNHYPPSLTFFLNPGLDRVVSPPPALVDAAHPRAFPDFTWREFLEFTQRHYRSDTNTMDAFVAWIKQRNGYESLDKY

SEQ ID NO: 6878 - protein, 55 aa, Passiflora talamancensis
WEYQVGPSVGIEAGDHIWCSRYILERITEQVGVVLTLDPKPIEGDWNGAGCHTNY

SEQ ID NO: 6879 - protein, 741 aa, Unknown
  Fragaria x ananassa
MEACNCIEPQWPADELLIKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTALELQLSYTLRQQNPVGHTVPIHLPVINQVFSSNRAVKISPNSPVARLRPLVGKHMPGEVVAVRVPLLHLSNFQINDWPELSTKRYALMVLMLPCDSARQWHVHELELVEVVADQVAVALSHAAILEESRRARDLLMEQNIALDLARREAETAIRARNDFLAVMNHEMRTPMHAIIALSSLLQETELTPEQRLMVETILKSSNLLATLINDVLDLSRLEDGSLQLDIATFNLHSVFIEVHNLVKPVASVKKLSVTLNLAADLPVYAIGDERRLLQIILNVVGNAVKFSKEGSISITAFVAKSESLRDFRAADFFPVQSDNHFYLRVQVKDSGSGINPQDLPKLFTKFAQNQSLATRNSGGSGLGLAICKRFVNLMEGHIWIESDGLGKGCTTTFIVKLGYPERSNESKLPFVPKMHTTHVQTNFPGLKVLVMDDNGVSRSVTKGLLEHLGCDVTTVSSSDEFLQVISQEHKVVFMDVCMPGIDGFELAVQIHEKFTKRHERPVLVALTGNINKMTKESCMRVGMEGVILKPVSVDKMRSVLSELLEHRVLFEAM

SEQ ID NO: 6880 - protein, 753 aa, Fulvimarina pelagi
MTIHITPNTKASHQRGAVRPAWRVREGRPYPLGATWDGLGVNFAIFSAHATKVELCIFSPDGKTEIERIELPEYTDEIYHGYLPEARPGLIYGYRVHGPYEPDVGHRFNPNKLLIDPYAKQLRGEVKWDHALFGYTIGHKDEDLSYDERDSAPFMPRCVVVDPAFTWGEERKPNVPWDRTIFYETHVKGFTQRHPSVTDFDRGKFAGLMNRDVVNYIRSLGVTSVEFLPIHALVDDSYLVDQGLRNYWGYNTIGFFAPDPRYLASPIVNEFKELVATYHNAGLEVILDVVYNHTAEGNEKGPTLSFKGIDNAAYYRLLPNQPRYYINDTGTGNTVNTSHPRVMQMVTDSLRYWAGEMRVDGFRFDLATILAREPSGFSQESSFLHACMQDPLLSQVKLIAEPWDCGPGGYQVGRFPPGWAEWNDTYRDIVRAYWRGDEGFIPKLAGKLSASADLFDSRGRKPWASVNFITAHDGFTLKDLVTYNEKHNEANGENNQDGHDHNLSYNYGVEGETDDEEIKDIRLRQMRNFFATLLFSRGTPMILAGDEFARSQGGNNNAYAQDNKIGWIDWNAPEESRQLARFVQQLIRLRQSLPILRRGTFLHGTYDDELGVKDVAWIRPDGEEFEDDDWEDPAAKCFGVLLDGRAQSTGIRRLGTDATMLLVMNSHDDVVNFKLPEAAGGLRWQRVFDTNTPDEFEFEPLDFGHDYMVTGRSFLMFLVEPDRNEEGQEEAIRSFAYIREALAKAAGDPLPLR

SEQ ID NO: 6881 - protein, 259 aa, Echinochloa crus-galli
AGPIFNDYSSVGYSFLLKKDKAIIVQPERVIVGNGPAFGCVMMKEFLSELAKRLKKNTTAYENYKRIFVPEGSPLESEPNEPLRVNVLFKHIQKMLTGDSAVIAETGDSWFNCQKLKLPEGCGYEFQMQYGSIGWSVGALLGYAQGANDKRVIACIGDGSFQVTAQDVSTMLRCAQNSIIFLINNGGYTIEVEIHDGPYNVIKNWNYTGLVDAIHNGEGKCWTSKVKCEEELTAAIETALGEKKDCLCFIEVIVHKDDT

SEQ ID NO: 6882 - protein, 501 aa, Actinobacillus pleuropneumoniae
MLQIRPLVTNQNQQEKTMSVKGDIGVIGLAVMGQNLILNMNDNGFKVVAYNRTTSKVDEFLAGAAKGTNIIGAYSLEDLAAKLEKPRKVMLMVRAGDVVDQFIDALLPHLEEGDIIIDGGNSNYPDTNRRTAALAEKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDTDGTPLVEKILDTAGQKGTGKWTGINALDFGIPLTLITESVFARCVSSFKDQRVAASKLFNKTIMPIEGDKKVWIEAVRKALLASKIISYAQGFMLIREASENFGWDINYGATALLWREGCIIRSRFLGNIRDAYEANPDLVFLGSDDYFKGILENAMADWRKVVAKSIEVGIPMPCMASAITFLDGYTSDRVPANLLQAQRDYFGAHTYERTDKPRGEFFHTNWTGRGGNTASTTYDV

SEQ ID NO: 6883 - protein, 454 aa, Deinococcus radiodurans
MRWCGAASGSRFGRWHRTDATPYTVPHMTLPPAARPAAALPHSPLPSPPLPSPWVLSAFWFGTAFLWLMLLTIYMPAHVVGFMGAAHKGTYLGLLGAIGAAIALVVPPLVGAHSDKTGRRLPYLRLGVGINVAGLAVMGAAVGLLAGSTGFWVYVLGFVLVQFGNNYATAPYSALIPQLVPPEQRGRYSGAMGTLQALGQLLGAAAGVAIGSHYGASLPFVLMAALLLVAAVITIRGVVEQAEAVAPAAPGEVLPWRELFAYAPFKWVFITRVLFALGQYSVQPFLQFYAGDVLRQKDPVMSSSLLLACIVIASIISAVVGGRLSDRIGRKPVIYFAGTVMTVTALLLLVAPSFTFALLLAFCFGLGFGAFTSVDWALGADAMPSRSSYARDMGIWHVAFVAPQFVNLPMGALLDWGNRHGDNFGYVLVFGSAALFFLLGVVLVRNVPEVRKAG

SEQ ID NO: 6884 - protein, 425 aa, Nitrosomonas europaea
MRIAIIGSGCSGLTAIKNLLDAGLKEIICFEKSDQIGGNWVYTAAPSHSSVSEATHIISSKALSQFSDFPMPDDYPDYPSHQQILAYFQAYTRHFHLDHYIRFNTAVLRAEKIEKERWCLHLDDGTQAEFDYLLVANGHHSVPRHPDWKECFTGKYLHAHEYKTNQGLEGKRILVVGAGNSGCDCAVEASRVAARVDISLRSPQYIIPKFIMGRPTDTFAATFHWLPQSVQDGLQRISLRLQIGRYHDYALPEPDFSPTRAHPTINSALFDKIRHGKVHPRPGIQKVSGQTVYFADNATAQYDVLIAATGYKISFPFFDRDFLDWEEAAHIPLFLRIFHPDHPSLFFVGLIQPQGCIWPLAEIQARLIGQLLTNKIQLPLNWRKLALSEGRNRAQQFIARPRHSIEVHYYPYLKQLQRMIQGQIK

SEQ ID NO: 6885 - protein, 316 aa, Legionella pneumophila
MSISNHHRLIILGSGPAGYTAAVYAARANLNPVLITGMQPGGQLTTTTDVDNWPGDIEGLQGPALMERMQKHAERFDTQVIFDHIVKADLAQAPFTLQGDSTTYTCDALIIATGASARYLGLPSETAYQGRGVSACATCDGFFYRNKSVCVIGGGNTAVEEALYLSNLASSVTLIHRRDSLRAEKILQDKLFEKAHSGNIKIIWNSTLDEVLGDEKKVTGAMIRNLKTGETDQLAIDGIFIAIGHTPNTAIFQDQLAMRDGYILIKSGLDGMATSTSVPGVFACGDVADHVYRQAITSAGFGCMAALDAEKYLDSI

SEQ ID NO: 6886 - protein, 570 aa, Aspergillus oryzae
MANMSPLRGYITSYSPRVRQYGNALLTPVIPPSQTGPTPRMTKRGTAAINYAEDGFDDDDFEDSEGPRRPTGLRSLRREESTIDKVPLAEKLGKEVHAPVEVQGVFRDWMIKRMLRPVCADQLQIQAQLPLTLIPIRIDLEVPAHQPLEPFQLPRTVLDPGINPALPGYRRPEPLPAYRIKDTFLWNLHEALATPEEFATGFVRDLDLPNPQAMTMAISNQIRQQLEEYAGVALHPLFQSTLPKPPSASQAGVSRDVSATPVPTHAATPDSRSNTVTVTKEPFVNDSFLNPDDAYRCMINLNINLQNKLYTDKFEWSLLHPPGMAEEFAKITCADLGLSGEWVGAIAHGIYEAVLKLKKEVCESGGLVSGIGGYGNEIDNQAANGTEAGWRYDPEGLGDEWEPKVETLSKEEIEKREGDRERQIRRLRRETARFSSTAGITPDVSRQGSGGYFDVDSETPLGRGERSKRKRRFRSLSPLGRGGTPGGRGTPDTSSGAGYGGGGGTLSDWERQNWRCSNCMVWGTAVWAVRDGPAGPRTLCHNCGLLYERDKVAPEWSRDLHRHDIPIGRA

SEQ ID NO: 6887 - protein, 367 aa, Ipomoea purpurea
MTTVSTLTALAGETALRSSFVRDEDERPKVGYNEFSDEIPVISLKGIDDVLGRRVQIRKEIVKACEDWGIFQVVDHGVDAGLIGEMTRLSKDFFSLPPEEKLRFDMSGGKKGGFIVSSHLQGEAVKDWREIVTYFSYPVRARDYSRWPDKPEGLRAVTEKYSEKLMDLACKLLEVLSEAMGLEKEALTKACVEMDQKLVVNFYPKCPQPDLTLGLKRHTDPGTITLLLQDQVGGLQATKDGGKTWITVQPVDGAFVVNLGDHGHFLSNGRFKNADHQAVVNSEHSRMSIATFQNPAPEAKVYPLKVREGEKAILEEPITFAEMYRRKMSKDLELARIKKFAKEQQMIKAAAAADTNLETKPIDQILA

SEQ ID NO: 6888 - protein, 528 aa, Anabaena variabilis
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDKILTHLRNNLASTLVLVISKSGGTPEPRNGMIEVKKAYAGQNLDFAQYAVAITSTGSNLDKVAQAEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGKTVYQGIAVYGNKGSTDQHAYVQQLREGVPNFFATLIEVLEDRNGASPEIDPGVTSGDYLSGFLLGTRQALYENQRDSITVTIPQVNARTVGALIALYERTVGLYASLVNINAYHQPGVEAGKKAAAVILDLQTKVVGLLQKEKTALSLEQIAEKIGAADQVEAIYKILRHLQANQRGVVFQGNLGQPSSLKVSIS

SEQ ID NO: 6889 - protein, 710 aa, Herminiimonas arsenicoxydans
MFNKVTKTFQYGQHTVTLETGEIARQASGAVLVSIEDTVVLATVVARKDAKPGQDFFPLTVDYVEKTYAAGRIPGGFFKREGRPSEKETLTSRLIDRPIRPLFPEGYLNEVQIIIHVMSVNPEIDPDIAAMIGASAALSVSGIPFAGPLGAARVGYIDGQYILNPTATQLKTSQMDLVVAGTEAAVLMVESEAQQLSEEVMLGAVVFGHDQMKAVIDAIHDLVRDGGKPEVQWAPPAKNEALIARVAHFAEEKLRAAYQTKDKQARTAKLKDAFAEVNAEVAAEATSVGGAAPDTSEVGNILFDLEAKIVRSQILDGEPRIDGRDTRTVRPITIRTGVLPRTHGSALFTRGETQALVIATLGTARDEQKIDALMGEYSDRFMLHYNMPPFATGETGRVGTPKRREIGHGRLAKRALIAALPAPEDFSYSVRLVSEITESNGSSSMASVCGGCLALMDAGVPMQAHVAGIAMGLIKDGGKFAVLSDILGDEDHLGDMDFKVAGTANGITALQMDIKIQGITKEIMQVALAQAKEGRIHILGEMEKAVPSGTTGELSDFAPRLITIKINPEKIRDVIGKGGAVIRALTEETGTQIDISDEGVVTIASVDAAAGQEAKRRIEELTASVEVGKVYEGTVLKLLDFGAIVQVMPGKDGLLHISQIANERVNAVADYLKEGQQVRVKVLETDDRGRLKLSMKAALAEDNPEAAPQE

SEQ ID NO: 6890 - protein, 503 aa, Unknown
  Acinetobacter sp. ADP1
MQQATINATQTTKIAIIGAGFGGLAMAIRLLQHHIRDFVIFEKAQDIGGTWRENQYPGAACDVQSHMYSLSFAPKTNWSKRYAEAGEIFSYIQDISEQFQLRQYCKFEHEVTRAEYDEQNFIWNLEFKNHPAVQAQFVIFASGPLHVPQIPHIKGIENFKGKVFHSSQWDHGYDLSNKVVASIGTGGSAIQYIPEIAQQVKQLYVLQRTAAWVIPRDERAYSGLSKLLFKKSDFYRQIHRIRLYWSNESRVVPIVQPQIMKYGQKLAEAFIRFQVKDKTLAKKLTPDFVMGCKRILISNKYFPTFNRKNVELVTDGIQEITENAIVTKDGKQRHIDCLIYGTGFITDPRIYLKHFECFGKNHQELKEAWKNGPESYYGITTAGFPNLFQLLGPNTVLGHNSVIFMIESQVNYILQLIKLVDTTKTQAVEVKVQVQNNFNETIQKQLQGTVWQAGGCVSWYQTSEGKNFSLWPTYTWKYWLETRKINVSDYHFLGDIQAKKIAV

SEQ ID NO: 6891 - protein, 463 aa, Anabaena variabilis
MTTTAVNPYLEGNFAPVHEEITTDTLKVIGELPPDLSGMFIRNGPNPQWTPIGQYHWFDGDGMLHGVRISNGKATYRNRYVRTQRWQIEHEAGQAIWTGFMEPPQPELPSRNTGNTALIWHAGQLLALWEGGAPHAIQVPDLETIGEYTYNNQLSSAFTAHPKVDPATGEMMFFGYSFAPPYLHYSVVSATGELVRTIPIDLPMGVMMHDFAITANYTIFMDLPLTFSVERMQRGEPMLMFESDRPSRFGILPRHGDNSHIRWFTAPSCYVFHTLNAYEDKDEVVLFACPMRSTTVLASPDSQTDPEADIPRLHRWRFNLKTGKVHEEMLDDVASEFPRINENFLGQATKYGYTSRLAKGSIPLFEGLIKYDLSNAKSQNYEYGQGRYGSEAVFVPRPGATVEDDGWLITYVYDIGEDSSELVVINAQDINSEPIARVLLPQRVPYGFHGIWVTEEQLNFGRI

SEQ ID NO: 6892 - protein, 196 aa, Unknown
  Dehalococcoides sp. BAV1
MTKRTASIKRQTTETTISLSLNLDGTGQADMCTGVRLFDHMLSQLAKHGLFDINISANGDDIHHLVEDVALTLGKAFNEALGERKGIVRMADATVPMDDSLASVALDLSGRGYAVMDLSFAKNDLTGFPTDLVRHFLETFAIEGRFNLHARILYGSNDHHKAEALFKALARALDKATSIDPRREGVAPSTKGMLEN

SEQ ID NO: 6893 - protein, 782 aa, Streptomyces coelicolor
MGRTTRRGAAAGTPCALLPDVVPRAVGGRQVSSAAEREAVPGERAAADGRPAVVVNGARRAAPPPAVPARPGTPVPLGARFRTGPDQVAGTNFALWAGGAEAVELCLFDGPGPGARESRVRLTELTHEIWHGFVPGVRPGQRYGYRVHGRWDPWTGARWNPAKLLLDPYARAVDGDFGLPPEVYGHVRDWPEQRVADTVRDDRDSAPHVPKGVVVHDDDDWSDDRRPKTPWADSVIYELHVRGFTKLHPEIPPELRGTYAGLAHPAAIAHLTRLGVTAVELLPVHQFAHESHLLERGLRNYWGYNSVGYFAPHAGYTASGTTGEQVGEFKRMVRALHAAGIEVILDVVYNHTAEAGELGPTLSLKGIDNRGYYRLQPDARRYADYTGCGNTLHVVQPHVLRLITDSLRYWVTEMGVDGFRFDLAAALARSMHDVDMLSPFLAVIAQDPVLRRVKLIAEPWDVGSGGYQVGAFPPLWTEWNDRYRNAVRDFWRHALPDVREMGYRLSGSSDLYAWGGRRPYASVNFVTAHDGFTLRDLVSYERKHNEANGEGNRDGTDDNRSWNCGTEGETDDAQVRALRRRQLRNLLTTLLLSTGVPMLVAGDEMGRTQRGSNNAYCQDNETGWVDWSLRDDPEWAPLFALASRLIGLRHRHPVLRRRAFFSGRAHSADGLRDLAWFTAGGTEMTERDWYAPAATLGMYLSGRDIPGRDEHGDPVVDDSFLAVLHAGGEPAGFVLPGAPWAERYEVVVDTGQEEQGEAPGTAHPAGAEITVPARTVLLLRAG

SEQ ID NO: 6894 - protein, 292 aa, Saccharomyces cerevisiae
TLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAGALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 6895 - protein, 262 aa, Borrelia garinii
MAIITMKSLLEAGVHFGHQVKRLDPRMKRFIFSERNEIHILDLQKTLQGIKDSYELVQRVIKDGKKVLFVGTKKQASEIIEQEARRSDMPYVNNRWLGGMLSNFNTIRKSVQKLKKLEKMEVDGTFDMISKKEISQLNREKFKLAKNLTGIKDMETLPGAIFIIDPKREQIAINEARKLKIPIISVVDTNCNPDVIDCPIPGNDDAIRSVALFTKIISDAILESDKEVGIQIIENLNEEDLMKEIEIKNDKSDSIEEGRSNL

SEQ ID NO: 6896 - protein, 292 aa, Saccharomyces cerevisiae
TLVHVASVEKGRSYEDFQKVYNAIALKLREDDEYDNYIGYGPVLVRLAWHISGTWDKHDNTGGSYGGTYRFKKQFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAGALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 6897 - protein, 58 aa, Passiflora tetrandra
WEYQVGPSVGIDAGDHIWGSRYILERITEQAGVVLSLDPKPIEGDWNGAGCHTNYCTK

SEQ ID NO: 6898 - protein, 765 aa, Unknown
  Fragaria x ananassa
MLKALASGLSISLLLVCVSASDGGFPRCNCDDEGSFWSIDSILECQRVSDFLIAVAYFSIPIELLYFVSCSNVPFKWVLFEFIAFIVLCGMTHLLNGWTYGPHPFQLMLALTVFKILTALVSCATAITLITLIPLLLKVKVREFMLKKKTWDLGREVGIIMRQKEAGMHVRMLTQEIRKSLDRHTILSTTLFELSETLGLQYCAVWMPNEIKTEMILTHELKGKNYSNMYNFSIPIGDPDVVLIKGSDGVNILRPDSALVCGSSGDSGEPGPVAAIRMPMLRVSNFKGGTPELIQTCYAILVLVLPGGEPRSWSSQELEIIKVVADQVAVALSHAAILEESQLMREQLAEQNRALQQAKMNAMMASHARNSFQKVMSDGMRRPMHSVLGLLSMMQDESLNNDQRVIVDAMVRTSNVLSTLINDAMDNPAKDSGRFPLEMRPFRLQPMIKEAACLAKCLCVYRGFGFAIEVDKSIADHVIGDERRVFQVILHMVGSLLNGNQGGGLVVFRVSSENGSQGRNDQRWAAWRQNSSDSGDVYIRFEIGISNGGSQSDMTSPIMQLVGSRYNSEGVEENLSFNICKRLVQLMQGNIWPIPNPQGFPQSMALVLRFQTRPSIAIAISEPGGSSEHSHSNSIFRGLQVLLTDEDDVNRLVTRKLLEKLGCNVTAVSSGFECLSAIGPSGASVQVVFLDLQMTELDGLEVAMRIRKFRSRTWPLIIAVTASADDDIWDRCMQIGINGVIRKPVLLQGIASELRRVLVQANKIV

SEQ ID NO: 6899 - protein, 316 aa, Oryza sativa
MMSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRFAYREGIRFAKINDESEYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 6900 - protein, 332 aa, Prunus persica
MAKGPVRVLVTGAAGQIGYALVPMIARGVMLGADQPVILHLLDIPPAAEALNGVKMELVDAAFPLLKGVVATTDVVEACTGVNIAVMVGGFPRKEGMERKDVMSKNVSIYKSQASALEKHAAANCKVLVVANPANTNALILKEFAPSIPEKNITCLTRLDHNRALGQVSERLNVQVSDVKNVIIWGNHSSSQYPDVNHATVKTPSGEKAVRELVADDAWLTGEFITTVQQRGAAIIKARKLSRALSAASSACDHIRDWVLGTPEGTWVSMGVYSDGSYNVPSGLIYSFPVTCQNGEWKIVQGLSIDEFSRKKLDATADELSEEKALAYSCLS

SEQ ID NO: 6901 - protein, 1240 aa, Oryza sativa
MAPTAAAAGPSDDGLRKLEYLSLVSKVCSELETHIGVGDKVLAEFITELGRDSASVADFDTKLKANGADLPDYFVRTLLTIIHAILPPPSDSRNPSSASQPAAGGSKFPGLSRPDDPDRARNLRLELERDAEEAAATAAPAPARDDRGRRRDERGRDRGRDDRGRDDRGRDRDYERGGRDHDRSRGRDRDHGRDRDRDRACDGDRQRGRDYGRDRDQDRDHDRDREGEWRRDRDKDRGRDIDRDMDRDHRRGRRYDDEEEPEQFGGRKEGALVNSSGEPELYQVYRGRVTRVMDTGCFVRLEDVRGGREGLVHISQMATRRVANAKEMVKRDQEVYVKVVSVKGQKLSLSMRDVDQDTGRDLLPIQRGGDDAPRANPSGGSASGVGVGSGKRLGLSGIMIAEEDEVAPPSRRPLKRMSSPERWEAKQLIASGVLDVRDYPMFDEDGDGMLYQEEGAEEEQEIELNEDEPAFLQGQSRFSIDMSPVKIFKNPEGSLSRAAALQTALIKERREVREQEQRAMLDSIPKDLNRPWEDPMPDTGERHLAQELRGVGLSAYDMPEWKKEAYGKALTFGQRSKLSIQDQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLIKRRSDMRLIVTSATLDAEKFSGYFFNCNIFTIPGRTFPVEILYTKQPESDYLDAALITVLQIHLTEPEGDILLFLTGQEEIDHACQCLYERMKGLGKDVPELIILPVYSALPSEMQSKIFDPAPPGKRKVVVATNIAEASLTIDGIYYVVDPGFAKINVYNSKQGLDSLVITPISQASAKQRAGRAGRTGPGKCYRLYTESAYRNEMSPTTIPEIQRINLGSTVLNMKAMGINDLLSFDFMDPPAPQALISAMEQLYSLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVSAGRNFTKIRKAITAGFFFHAARKDPQEGYRTLVENQPVYIHPSSALFQRQPDWVIYHELVMTTKEYMREVTVIDPKWLTELAPRFYKSADPTKMSKRKRQERIEPLYDRYHEPNSWRLSKRRA

SEQ ID NO: 6902 - protein, 55 aa, Passiflora trialata
WEYQVGPSVGIDAGDHIWCSRYILERITEQAGVVLSLDPQPIEGDWNGAGCHTNY

SEQ ID NO: 6903 - protein, 211 aa, Unknown
  Thiobacillus sp. KCT001
VGRHYYAERAVFEGHHAGIAEIDRANHRLMINGLVDKPLVFTMADLKRFPRENRVYFLECAANTGMEWRGSQLNGCQYTHGMIHCVMYTGVRLKHILEEAGVKAAGSWVLAEGADASAMTRSIPMEKALDDCMVAFAMNGEALRPEQGYPIRLVVPGWEGNMWVKWLRRLEVGDQPWQQREETSKYTDLLANGKARRFTWKMDVKSVITSP

SEQ ID NO: 6904 - protein, 557 aa, Unknown
  Acinetobacter sp. ADP1
MTESFAALFEESELNLNVEKGAVIQGVVVNIDSDWVTVDTGLKSEGVVDRAEFLNEQRELEVQVGDTVDVVVEALDNGMGQTVLSREKAKRAETWTKLEKIFEDGEIVTGVISGKVKGGFTVDIGPVRAFLPGSLVDTRPIRDTTHLEGKELEFKVIKLDAKRNNVVVSRRAVMEAESSADREALLAQLEEGQTVTGTIKNLTDYGAFVDLGGIDGLLHITDMAWKRIKHPSEVVEVGQEVTVKVLKFDRERNRVSLGLKQLGEDPWLAIMSRYPKGSIVKARVTNLTDYGCFAEIAEGVEGLVHVSEMDHTNKNIHPSKVVQIGDEVDVMVLEVDEERRRISLGIKQTRANPWEEFAKAHEKGEKVSGTIKSITDFGIFIGLPGGIDGLVHLSDISWNEQGEEAIRRYKKGDTVEAVILSVDAEGNRISLGIKQLNSDPFNDFLAANERGALVKGTVTAVDAKGATVKLGDEIEATLKASEINRDRVEDATKFLEVGQEVEAKIINVDRKSRSINLSIKAKDEAEEKEAVANLRTTSVSQDNGPKTIGDLIKAQMK

SEQ ID NO: 6905 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYIMLPTDYSLIQDPKYLSIVKEYANDQDKFFKDFSKAFEKLLENGITFPKDAPSPFIFKTLEEQGL

SEQ ID NO: 6906 - protein, 52 aa, Thermoanaerobacterium thermosaccharolyticum
MEKWQCTVCGYIYDPEVGDPTQNIPPGTKFEDLPDDWVCPDCGVGKDQFEKI

SEQ ID NO: 6907 - protein, 55 aa, Passiflora trifasciata
WEYQVGPSVGIDAGDHIWCSRYILERITEQVGVVLTLDPKPIEGDWNGAGCPTNY

SEQ ID NO: 6908 - protein, 359 aa, Spiroplasma citri
MAKELTREMLWEAGAQFGHQTKRWNPKMKPYIYGEKNKIHIIDLQQTLWRLEDVKKLMANIAARKGKILFVGTKKQAKWIVKDAAERCECFYVNQRWLGGTLTNLKTIHLRVKRLWNIERQEKNGELKLLPKKEQMLIKKEKDKLEKFLGGIKGMKELPQALFVVDPKEEHIAVREARKLRIPVIAICDTNVDPDPIDYIIPANDDTSRSIAIITHHIADLYGDAMGIKMPEPQFKPSEFTRRDGDENRNSRGGQYDNRRMSGRNERGRDTHYSHKAPNSGKEEAPVGTEPVATTSAPSFNFNTINVVDNDLEKTLSKLKVDELEILSEGFALPKAKKAEMVSELSKHLTIVDNKIVKK

SEQ ID NO: 6909 - protein, 766 aa, Oryza sativa
MGSETNKEGARGGGQFEVVATTCEVTIVVGCMKEMSAGQFYCKGEERVDGGAGIKRRGAPQRKGKSPKKVEGKTYKYKGFVIEGCELDSTIIMIKSSDLVHIPSIFTPPEVNSQKGSKTSICIDRSLSQAYHDSPDNASILPTNLAQRIQLSSDTLGSDKRHGIAGKTDHETAQKHAKLSCFDQRCLDKMKQLTSGMNVQKRDLAKTHNDEITACDWDYLGTQYDSSVVPESDLRFETAELLLETPKNGDAMPGKSFLPIVEANLENSRRKLFQGSADCYSQSAVDNIHAYCTSRGKEVATNHVSGILPCPRESQLIPDHHFSDSLEVPSDYMAMNPSAVSQHLRGLHRRSLFNDKVRDPTMGVQSVSNLGASTCATRHRSIPDDNYSKLVGSPVCALPNVDLHLVRMTEEMVPYNMTCTVNSTLSISEHNTEISDYSSQATMPTSAGNSGQENPKRKRQKCQNDNVDSCKRCSCKKSKCLKLYCECFASKVYCSESCSCRGCFNDHSHEETVLSTRNRIESRNPLAFAPKVIRTCGPGLEFGEDSNATPASSRHKRGCNCKRSYCVKKYCECFQSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 6910 - protein, 68 aa, Passiflora tripartita
GTNGEVMPGQWEYQVGPSVGIDAGDDIWCSRYILERITEQAGVILSLDPKPIEGDWNGAGCHTNYSTK

SEQ ID NO: 6911 - protein, 349 aa, Kluyveromyces lactis
MLLVRNSTLGRLSSLRGFFRNINESNIFYRMVHHKVTIIGSGPAAHTAAIYLARAEIKPTLYEGFMANGIAAGGQLTTTTEIENFPGFPDGLTGSELMDRMKAQSIKFGTDVITETVSKVDLSSRPFKFWTEFNEDQEPETTDAIILSTGASAKRLHLPGEETYWQQGISACAVCDGAVPIFRNKPLAVIGGGDSACEEAQFLTKYGSKVYMLVRKDHLRASQIMQRRAEQNEKIEILYNHVTLEAKGDGKYLNALKVKNVKTNEEYDLPVNGLFYAIGHTPATNIVAGQVDLDEAGYVKTVPGSTLTNVPGVFAAGDVQDARYRQAITSAGSGCMAALDAEKYITELE

SEQ ID NO: 6912 - protein, 422 aa, Unknown
  delta proteobacterium MLMS-1
MSRRLDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRTYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPQAVVRDSILFHDCRVAAGATVDLAILDKRVQVGEKAVVGQGEDKTVANRANPKHLYSGISLIGKQARIPAGAVIGRNCIIAPGCRDDDFPTATLASGESL

SEQ ID NO: 6913 - protein, 520 aa, Kluyveromyces lactis
MFTRDANGRHKEVDALVDDMVNFSFDTDAKVMLDPPSTPTRIRGSPSPTRSIVKNPENSLMDIDDDTQGDLTADITKSPKKLPKDFYKKSSKTKSKRLVSVCQMYFLDYYCDMFDYVISRRERTRQVINYLEEQRRSNLMGTEQITNEWQGYLTKETNILRKRRLKPKHKDFEMITQVGQGGYGQVYLARKKDTKEICALKILNKKLLMKLEGTDHVLTERDILTTTRSEWLVKLLYAFQDPQSLYLAMEFVPGGDFRTLLLNTKFLQAPHARFYISEMFCAVNALHQLGYTHRDLKPENFLIDSKGHIKLTDFGLASGTVSMERIESMKIRLQEVKNLEFPEFRERSMDDRRRMYNKLREEEVRYAHSTVGSPDYMALEVLEAKNYDFTVDYWSLGCILFESLVGYTPFSGNSTNETYENLRNWKHVLQRPKCDNGRYAFSDRTWELITRLIADPINRLKSFEHVKRMRYFSEIDFNTLRTIHPPFIPQLDNEEDVGYFDDFTNEEHMARYVDVFKRQD

SEQ ID NO: 6914 - protein, 446 aa, Unknown
  delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPDSLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEEAVISNSLVYNGCQVEGRVENSVLFPGVQVKPGAVVRDSVLFFDNVVGRDCHLEKVVSDVNVTVGDGVVIGVPAPSPAAGGATGTGRASGAENLAGGESGGDATTVTVLGWNNQIPAGMVIGAGCTLYPSLGPEKMARQRVADGEVLR

SEQ ID NO: 6915 - protein, 255 aa, Hordeum vulgare
TGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKNWEDVLLELGVEGSEPGIVGEEIAPLAT

SEQ ID NO: 6916 - protein, 420 aa, Xanthomonas campestris
MSISPDSASAPAPGRRRAALIFIFITVLIDVLSFGVIIPVLPDLVRQFTGGDYAAAAGWIGWFGFLFAAIQFVCSPLQGTLSDRYGRRPVILLSCLGLGLDFILMALAHTLPMLLLARVISGVCSASFSTANAYIADVTPADKRAGAFGMLGAAFGIGFVAGPLIGGWLGSIGLRWPFWFAAGLALLNVLYGWFVLPESLPPERRTARLDWSHANPFGALKLLRRYPQVFGLASVVFLANLAHYVYPSIFVLFASYQYHWGPREVSWVLAGVGVCSIIVNAVLVGRIVRWLGERRALLLGLGCGVIGFVIYGLADSGHTFLLGVPISAFWAVAAPAAQALITREVGADAQGRVQGALTSLVSLGGIAGPLLFANVFAWFIGSGAPLHLPGAPWLLAGLLLAAGWFMAWKRAGRSPALAQG

SEQ ID NO: 6917 - protein, 112 aa, Unknown
  Shewanella sp. MR-4
MKLVSAIIKPFKLDDVREAIAGIGIEGMTVTEVKGFGRQKGHTELYRGAEYQVDFLPKVKLEIATKAENLDMLIEAITSAAHTGKIGDGKIFVIDLEHAIRIRTGELDTEAL

SEQ ID NO: 6918 - protein, 329 aa, Nitrosomonas europaea
MNIAVLGAGAWGTALAICLSARHRVTLWTRNVEHLAELAALRTNQRYLPRQPLPDSIHLVSALSEALERAELVFVVVPVAGLRTTLQQMVALNPSLPLILACKGFETGSAKLPCQVVEEVYPASITCGVLSGPSFAREVAQGLPAALTLASHDEIFARSVAGEIRTASLRVYSGNDVIGVEVGGALKNVIAIAAGISDGIAFGNNARAALITRGLAEITRLGMALGGCRETFTGLTGIGDLILTCTGNLSRNRRVGMMLAAGRQLAEILPEIGHVTEGVYTVREAYGLGQRLQIDMPVTQAVYSILYEQVPVEIAIQDMLDREPGAETD

SEQ ID NO: 6919 - protein, 177 aa, Unknown
  endosymbiont of Polyrhachis foreli
RGSHQTRYWNPKMKPFIFGVRNKIHIINLEKTLPMFNHALSELNKISSNKGKILFVGTKRAAREAIKNTAISCNQFFVNHRWLGGMLTNWKTVRQSIKRLKDLEIQYKDGTFTKLTKKEALILKRELEKLEKSLGGIKNMNGLPDAIFIIGAAHECIAIKEANNLGIPVFSIVDTCS

SEQ ID NO: 6920 - protein, 226 aa, Medicago truncatula
MERIYWRHFSSQAKAIGTIVSMAGAFVVILYKGPPILKIHSSISYNTLQFSPNLNWILGGFLCAGDSLLSSMWYIYQVSVTKKYPAVIVIVFFQVVFITIQTGVYALIVVRDPSAWELKLDMGLIVILYQAVAAIGIRYFLQTWSVQRAGPLFCAMFKPIGIIFTVFLGSIFLGDDFYLGSLIGAVIIVVGFYAVQWGKASEEKVEKGIENLETQSNVVPLLQNKV

SEQ ID NO: 6921 - protein, 300 aa, Mycoplasma mobile
MNINDMNDAPEVSSSESQKNEIVSKQKLLEAGTYFGHKASLWNPKMKPFIHSKKMGTHIIDIAQTRKALEYAYKLIEKYAQKGASFIFVGTKKQAKDVVKAQALRTNSIYVSERWLGGTLTNSRTIMNQVRTLSDLEKLEESGYEGYTKKEGVEFSKKLAKLQRNLTGIRNMKHLPQVMIVADVNTDKIAIKEAQRKNIKIIGILDTNSDPSLVNFGIPANDDSVKSLNLIITILADAIVAAKNGKQLFAYQGDEAIVFPATSENVGKDGEERKPRKPYVKRRPDGDFQPRHNNNESETK

SEQ ID NO: 6922 - protein, 159 aa, Prochlorococcus marinus
MVIDVQNTPVLSADGKSKKLGEFSKDVILIVNVASYCGNTAQYEDLQKLHKIYSKKGLRILAFPCNDFGNQEPDSLSKIQNFCTTEYGVEFEIMEKVHAKGNTTEPYTTLNKVEPKGDVEWNFEKFLIGRDSNVIARFKPSVKPFDDNLIAAIEVALDS

SEQ ID NO: 6923 - protein, 316 aa, Haemophilus influenzae
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 6924 - protein, 405 aa, Arabidopsis thaliana
MRLVEQYDTHDPKGYCLVSLPNLLKRSKVIEIVAARDIVFALTLSGVCASFSRETNKKVCFLNVSPDEVIRSLFYNKNNDSLITVSVYASDNYSSLKCRSTRIEYILRGQADAGFPLFESESLKWPGFVEFDDVNGKVLTYSAQDSVYKVFDLKNYALLYSISDKNVQEIKISPGIMLLIFKRAASHVPLKILSIEDGTLLKSFHHLLHRNKKVDFIEQFNEKLLVKQENENLQILDVRNAELIEVSRTDFMTPSAFIFLYENQLFLTFRNRNVSVWNFRGELVTSFEDHLLWHPDCNTNNIYITSDQDLIISYCKADTEDQWIEGNAGSINISNILTGKCLAKIKANNGPPKEEDCSSSDLGNSSRRRSAVAEALEDITALFYDEERNEIYTGNRHGLLHVWSN

SEQ ID NO: 6925 - protein, 614 aa, Symbiobacterium thermophilum
MCGIAGWADWKRDLSREGPVLETMIAPLADRGPDAGGIWCSGHCAFGHRRLAVVDLVGGAQPMVRSRGDRTYVLVYNGQLYNTQELKEELTARGHAFSTQSDTEVLLVAYMEWGPECTRRLNGIYAFAVWDEAGQQLFLARDRFGVKPLFYKTMGSAILFGSELKALLAHPLVQPEVDAEGLAEVLYLGPSRTPGHGVFRGVREVLPGHWLLFDRAGVRTQPYWQLESRPHTDGPAETAERVRELLREAVRRQLVADVPVATLLSGGLDSSAITAFAAEAFRAQGRGPLHTWSIDYAENDRHFRAHAFQPDPDSAYAGTMAESLGTVHHEVVIDTPQLVDALEKAALIRDLPGMADVDAALFLFCREIKKGATVVLSGECADEVFGGYPWFHRPGPETGRTFPWIRSLEARTALLQPGVTGPIRAEDYVAQRYSNTVARVPRLPGEEPEEARIRELFYLNLAWFMATLLDRNDRMSMAVGLEARVPFCDHLLVEYVWNIPWRLKTYGGREKGILREALRGVLPEAVRTRRKSPFPKTHHPEYFRAVRDRVLALLDDPACRLHKIVRADRVRALARQDHEATDLPWFGQLMSGPQYFAWLIQLEAWLRHYKVVLV

SEQ ID NO: 6926 - protein, 148 aa, Glycine max
  misc_feature (3)..(4): Xaa can be any naturally occurring amino acid
  misc_feature (7)..(7): Xaa can be any naturally occurring amino acid
  misc_feature (16)..(17): Xaa can be any naturally occurring amino acid
  misc_feature (25)..(25): Xaa can be any naturally occurring amino acid
NDXXPVXEVVKDHKWXXEEFTEKVXKRGGALIQKWGRSSAASTSVSIVDAIRSLVTPTPEGDWFSSGVYSNGNPYGIAEGIVFSMPCRSKGDGDYELVKDVIFDDYLRQRIAKTEAELLAEKRCVAHLTGEGIAVCDLPGDTMLPGEM

SEQ ID NO: 6927 - protein, 247 aa, Galdieria partita
MVASKTDLEQKVRSRLVKLFEQTPCMPIMVRLAWHDAGTYDAQTGTGGVNGSIRFDPELRHGANNGLKIALDLLEPIKKEYPDIGYADLFQLASVTAIEFAKGPKIPFRMGRKDATGPDACPEEGRLPNAEDHMSQLRRTFHRMGLSDKDITVLSGAHTLGRCHKERSGYEGPWTHQPLEFDNSYFVEILKPNPDPGLIRLASDLSLLDDSYTRSLVETYAENKDIFFKDYTESHHKLSELGAVWEY

SEQ ID NO: 6928 - protein, 311 aa, Mycoplasma mobile
MHNEKIYDVIIIGGGPAAMSAAIYASRANLSTVFIEKGAPGGKMVTTSRIENYPGFTTIGGPDLAIEMLNHAKAYKAEYKFGNVLKINNHGPFNKEVLLERKNEIIKGKSIIIATGMVNRVPRDIEGIEEFNHKGVSYCAICDGPLFGKTPSAIIGGGNSAVEEAIYLASIASEVHVFVKDSKFNAEEKSVNDLKLLKNVKIHMNSSILKLKGSNKLEEADVLINGKKETIKLTSLFPYIGFIPSVDFAKHLGITNEQGFIQTNEKLETKLENIFAAGDIRVKDIRQVATAIGDGAIAGKEVANKINSEKK

SEQ ID NO: 6929 - protein, 134 aa, Oryza sativa
  misc_feature (101)..(101): Xaa can be any naturally occurring amino acid
GYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWXFIEVIAHKDDTSKELLEWGSRVSAANSRPPNPQ

SEQ ID NO: 6930 - protein, 316 aa, Pisum sativum
MWPFSSKKGVSGFSGSSTAEQVTHGIDATGLTAIVTGASSGIGAETTRVLALRGAHVIMGVRNMVAAKDVKDTILKDIPSAKVDAIELDLSSLDSVKKFASEFNSSGRPLNILINNAGIMACPFKLSKDNIELQFATNHIGHFLLTNLLLDTMKKTTRESKKEGRIVNVASEAHRFAYPEGIRFDKINDQSSYNNWRAYGQSKLANVLHANQLTKHLKEDGVNITANSLHPGTIVTNLFRHNSAVNGLINVIGKLVLKNVQQGAATTCYVALHPQVKGVSGEYFSDSNVYKTTPHGKDVDLAKKLWDFSINLVKQK

SEQ ID NO: 6931 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSNEIFKLLDNGAHIYFCGLKGMMPGIQDTLKRVAEERGESWEQKLTQLRKNKQWHVEVY

SEQ ID NO: 6932 - protein, 59 aa, Passiflora tripartita
MPGQWEYQVGPSVGIDAGDDIWCSRYILERITEQAGVILSLDPKPIEGDWNGAGCHTNY

SEQ ID NO: 6933 - protein, 378 aa, Anabaena variabilis
MFQILIIDDDISIQTLLKRILQKQGYQIVTASNGEEGITQALTSRPALIICDWIMPGLNGLEVCHRIKTNPNLSTTFFILLTSLDSVADRVKGLDAGADDFITKPIEQNELQARVRAGLRLHQLSRDLRTQKLLLEEELAEAAEYVRSLLPEPLNEPISINSRFIPSRQLGGDCFDYYWLDDDCLALYLLDTAGHGLKAALPSISVLNLLRSRALKNLNYYQPSDVLKNLNETFQMNYQNDKYFTIWYGVYHRIKRQLTYASAGHPPAILISGTSPASTEVQILRTPGMPVGMFPEAQYVDAYCDVEKLSSLYIFSDGAYEITKSDGKIWSLDAFIQILASVHHNDDYQLDQILNCLTALNPKDTFEDDLSILQVKFD

SEQ ID NO: 6934 - protein, 420 aa, Streptomyces coelicolor
MSLLNTPLHELDPDVAAAVDAELDRQQSTLEMIASENFAPVAVMEAQGSVLTNKYAEGYPGRRYYGGCEHVDVVEQIAIDRVKALFGAEHANVQPHSGAQANAAAMFALLKPGDTIMGLNLAHGGHLTHGMKINFSGKLYNVVPYHVGDDGQVDMAEVERLAKETKPKLIVAGWSAYPRQLDFAAFRKVADEVGAYLMVDMAHFAGLVAAGLHPNPVPHAHVVTTTTHKTLGGPRGGVILSTAELAKKINSAVFPGQQGGPLEHVVAAKAVAFKVAASEDFKERQGRTLEGARILAERLVRDDAKAAGVSVLTGGTDVHLVLVDLRDSELDGQQAEDRLHEVGITVNRNAVPNDPRPPMVTSGLRIGTPALATRGFTAEDFAEVADVIAEALKPSYDAEALKARVKTLADKHPLYPGLNK

SEQ ID NO: 6935 - protein, 124 aa, Cucumis sativus
GRGQFGTTYLCTEITTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENF

SEQ ID NO: 6936 - protein, 59 aa, Passiflora tripartita
WEYQVGPSVGIDAGDDIWCSRYILERITEQAGVILSLDPKPIEGDWNGAGCHTNYSTKS

SEQ ID NO: 6937 - protein, 742 aa, Magnaporthe grisea
MPSSSRNPSTWDEYDGGISPHRTGSMSSMGGRSGRSVQFRDQENEPLLGDDQERRGSDQDTEWAGGLRRRRSSVTMRLASIADIGGVNSMRSFTRSWARAAGFAEVIPQRPSFVFAQDQAPMQPGSTEDIVYSRSGTEGGFLRPTLENSGPSLLRQHLEAGSSVGSRSAEAVFDDRDESPSRPLQPQQSGDGIDFRERELKALDSEINNGFRIGSWSGGSGSGSGSAARSQSIFAIPPHLAAPSIGGDPGPYGTSYGSIGSQQSLNYGTVRSRGREESPARGVSVAPSARGSVWASAPEEGPDAEVQPILVKEVEQDGKMVLTVEGQSTLPQTIFNSINVLIGVGLLSLPMGIKYAGWLCGIGFLTFAAGVTMYTAGLLSRCMDLDPSLITFSDLAFISFGSKARVATSILFTLELLAACVALIVLFADSLDLLFPGLLTVTQWKVTCAIILMPLHFMPLSLLSYSSILGIFSCFSIVLIVVTNGLIKPDSPGSLIEPAATYLFPANWLTLPLSFGLLMSPWGGHSVFPNIYRDMRHPYKYKQALKVTFSFTYCLDAVTAVAGILMFGDNVADAITSNILRTEGYPRALTVLMCCFIAIIPLTKVPLNARPIITTLEVVMGVYHGAGGDPHAPVQISGEPAPQTGSRKVVIMRAAIRILTILSFLVIAILFPEFDRIMAFMGSALCFSICVTLPIAFYLKLFGPEISAREKVIAWIIMLTSFVMSLVGTVWAFLPKSLISSA

SEQ ID NO: 6938 - protein, 315 aa, Oryza sativa
MGGGGGGTPRSSIGHILPGAGFVAVGVWHLFNHVKLFSQRPDTYVAPAWFPVPGARYLELALIIAGSGVEFAMEMFVGHSTLLPFAADGSIPSDRLHNHEHAIICLSLAVYAAAALHLDRARAPARGTLGLLLVAAVFAQELLVFHFHSTDHAGVEGQFHWLLQVVVAACLATSLLGVGYPRSFAVGLARSACVAFHGLWLAVIGAMVWVPSLVPRGCELVREDGRDTVRCRSKESLHRAKALANLQFGWYLSFMTVFVVALYLYVSNRYPAAEEAAYAPLQKAGAGDGDDDGDDDAHKGGGAGVHGFAALEIEV

SEQ ID NO: 6939 - protein, 183 aa, Thlaspi caerulescens
KDVHPRFPNGGLMSQHLDSLTIGSVLDIKGPLGHIEYQGKGHFMVSGKPKFAKKLAMLAGGTGITPIYQIIQSVLSDPEDETEMFVVYANRTEDDILVREELEGWASKHKERLKIWYVVEIAKEGWNYSTGFITEAVLRQHIPEGLVGESLALACGPPPMIQFALQPNLEKMGYNVKEDLLIF

SEQ ID NO: 6940 - protein, 58 aa, Passiflora tripartita
WEYQVGPSVGIDAGDDIWCSRYILERITEQAGVILSLDPKPIEGDWNGAGCHTNYSTK

SEQ ID NO: 6941 - protein, 321 aa, Bradyrhizobium japonicum
MSAPVHAKVVIIGSGPAGYTAAIYAARAMLEPILIQGIQPGGQLTITTDVENYPGFADVIQGPWLMEQMEKQAVHVGTKIVTDLVTKLETGRRPFRLTCDSGDVYLAETVILATGAQARWLGLPSEGKFQGGGVSACATCDGFFYRGKEVIVVGGGNTAVEEALFLTNHASQVTIVHRRDHFRAERILQERLFKHPKIKVVWDSAVDEICGTENPNKVTHVRLKNVKTGKLTELKADGIFIAIGHAPATELVKDQVKLKPSGYVEVAPNSTATSVPGLFAAGDVADETYRQAVTAAGLGCMAALEAERFLALRASERAAAE

SEQ ID NO: 6942 - protein, 65 aa, Passiflora trisecta
GTNGEVMPGQWEYQVGPSVGIDAGDDIWCSRYILERITEQAGVVLSLDPKPIEGDWNGAGCHTNY

SEQ ID NO: 6943 - protein, 331 aa, Triticum aestivum
  misc_feature (203)..(203): Xaa can be any naturally occurring amino acid
  misc_feature (258)..(258): Xaa can be any naturally occurring amino acid
  misc_feature (278)..(278): Xaa can be any naturally occurring amino acid
  misc_feature (292)..(292): Xaa can be any naturally occurring amino acid
MRALPMAVSRGAVACATPAAAAAAVPRRSMLLSTAAAGAALQSDPIRLMSTPKLKLRASAGAAQAAATSFSSNDEAFTWAKKDNRRLLHVVYRVGDINKTIKFYTECLGMKLLRKRDIPEEKYTNAFLGYGPEETNFAIELTYNYGVDSYDVGAGFGHFGIATDDVAKTVELIKAKGGKVTREPGPVKGGKTVIAFIEDPDGXQFEILERSGTPEPLCQEMLRVGDLDRNISLYEKACGYELRLKRDNPEYNYTGAHXWGYGPEEQNAGREFTYTNGXVHEYEKGNAYSQIXAMGTPHFYRTTEVVKLSGGERGCGENFPLGGLAPKNKAI

SEQ ID NO: 6944 - protein, 260 aa, Brassica napus
  misc_feature (251)..(251): Xaa can be any naturally occurring amino acid
TRELGREVGIIMKQTETSLHVRMLTSKIRTPLDRHTILYTTLVELSKTLGLKNCAVWIPNEIKTEMNLTHELRPGHRDDNAGGGGGYGGGFSIPITESDVVRIKRSEEVNMLNPGSALASVTSRGKPDSQTVGIRVPMLRVCNFKGGTPEAIHMCYAILVCVLPSRSWTYQELEIVKVVADQVAVAISHAVILEESQLMREKLAEQNRALQVARENALRANQAKAAFEEMMGDAMRRPVRSTLGLLPMILXDGGLQENQR

SEQ ID NO: 6945 - protein, 478 aa, Bacillus anthracis
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 6946 - protein, 340 aa, Fulvimarina pelagi
MSGFADRAVSADQASIASTDTPFVRYRTKRDNPRRLLMIRNFTAEDVTDQSGRTFFVTGANSGIGLETARVLAAKGARVLLGCRTEAKALSAMADIRLEHPNADLGFVPLDLADLGSVRGAAAKVKAEERIDVLVNNAGVMVPPLGRTKDGFELQFGVNHLGTFALTGLLLDQLFARPYARIVITSSIAHRSGEIDFDDIDAQADYNRLKRYRMSKLANLLHMYELDRRLRDAKADAIALACHPGVAATNLMRFLPGPAKLLMMPGRLLLNSAAEGAWPTLAAATSPKLDGGAYVGPSKRGETAGPAAIAKSAERARNSEIAERLWAVSEEKTGVEYRFA

SEQ ID NO: 6947 - protein, 586 aa, Rhodospirillum rubrum
MCGIAGMVTKLGRSVPEGLADRFAQKLAHRGPDGKGVFEAPGVLLVQARLAIIDLLTGDQPLHGPDGLVLVANGEVYNYRELRAELGEGVFLTRSDCEPPLHLYARRGLAGFDVLRGMYAIALWDPPRRRLVLCRDPFGIKPLYYVETNDGVAFASEPQALIGAGLLPAREDAAAVDELLQLQFTCGARTIFQGIRRVLPGETLVFEDAQLVERHRRPALPAVRERVSPADPLALLDHVLEDSLDLHQRADVPYGLFLSGGIDSSSVLAMMARLNERPVLAFTAGFPGTEVADERADARAATRAVGARHVEVAVSEGDFLEHLPAIAAAVDDPVADYAIVPTWLLAREAAKSVKVVLCGEGGDELLGGYGRYRSAMRPWPLARPLRRKGLLDGLGLLRGGGGRNWRAGIARAEVEARAQGGSRLIRAQRVDCADWLPHDLLNKLDRCLMAHGLEGRVPFVDVDVARFCLPLADGLKVRDGMGKWILRSWLERTLPEARPFAPKRGFSVPVGEWMSRHGDRLGPLVAASPAVAARCHGEAVRALFTHPRKETALAAWILLYYALWHRRHIVGLAPEGDVFHCLSTAA

SEQ ID NO: 6948 - protein, 316 aa, Actinobacillus pleuropneumoniae
MTIYADNSYTIGNTPIVRLKNFGQNGNLLVKIESRNPSFSVKCRIGANMVWQAEKDGILTKGKEIVDATSGNTGIALAYVAAARGYKITLTMPETMSTERKRLLRGLGVNLVLTEGSKGMKGAISKAEEIVASDPNRYVILKQFENPANPAIHQQTTGPEIWNATEGKVDVIVAGVGTGGTITGISRYIKQDQGKQIISVAVEPKESPVITQTLNGEEVKPGPHKIQGIGAGFIPKNLDLSLIDRVEQVSSEEAIATARRIMAEEGILVGISSGAAVAAADRLAKLPEFADKQIVAILPSASERYLSTLLFEGVEV

SEQ ID NO: 6949 - protein, 491 aa, Cryptococcus neoformans
MSSELADVGLIGLAVMGQNLILNMNDKGFKVCAYNRTVAKVDHFLANEAKGTNVIGAHSVKELCSKLKRPRRIILLVKAGKAVDDFIAQLEPYLEKGDIIIDGGNSHYPDSIRRTHELEAKGLLFVGSGVSGGEEGARNGPSLMPGGSDAAWPHIKDIFQKTAAQAQGEPCCDWVGETGSGHYVKMVHNGIEYGDMQLIAEAYDILKRGLELDEDEIAAIFDKWNSGVLDSFLIEITRDILKFKDTDGVPMVRKILDKAGQKGTGKWTAIDALDNGMPVTLIGEAVFARCLSAIKDERVRASKVIPGPPKEAFKGDKQQFIDDLEQALYASKIISYAQGFMLMREAAKVNDWHLNNAGIAAMWRGGCIIKSVFLSDITAAYRENPALENLLLAPFFTKALEKAQAGWRRVIAQSTLWGIPVPAHTTALSFFDGYRTETLPANLIQGQRDFFGAHTFRVVPGMGNDHLKEDEDVHVRWTSTSGNVSSSTYNA

SEQ ID NO: 6950 - protein, 951 aa, Unknown
  Vibrio sp. Ex25
MKLVKRSDSVSKETNQLGVSRRAFMKNTSLAAGGAVVGASLFAPGMMKKAQAKSVDPEAKTEVKRTICSHCSVGCGIYAEVQNGVWTGQEPAFDHPFNAGGHCAKGAALREHGHGERRLKYPMKLENGKWKKLSWDQAIEEIGNKVMDIRKESGPDSVYFLGSAKHSNEQAYLFRKMASLWGTNNVDHQARICHSTTVAGVANTWGYGAMTNSFNDMHNCKSMLFIGSNPAEAHPVAMQHILIAKEKNNCKIVVADPRRTRTAAKSDHYVSLRPGSDVAFIWGVLWHIFENQWEDKEFIRQRVFGMDEIRAEVAKWTPAEVERVTGVSEEDVYQTAKLLSENRPGCIVWCMGGTQHTTGNNNTRAYCVLELALGNIGKSGGGANIFRGHDNVQGATDLGVLSDTLPGYYGLSEGAWRHWSKVWEIDYEWIKGRFDDNAYSGQKPMHSAGIPVSRWVDGVLENKDNIRQRENIRAMFYWGHAVNSQTRGVEMKKAMQKLDMMVIVDPYPTVAAVMNDRTDGVYLLPATTQFETYGSVTASNRSLQWRDQVIEPLFESKPDHEIMYLLSKKLGYSDLLFKNIRVENNQPVIEDLTREFNKGMWTIGYTGQSPERLKAHQQNWHTFHKTTLEAEGGPVNGETYGLPWPCWGTPEMKHPGTHILYDTSKTVAEGGGNFRTRFGVEFEGKSLLAEDSYSKGCEIKDGYPEFTDKLLKQLGWWDDLTAEEKAAAEGKNWKTDLSGGIQRVAIKHGCIPFGNAKARAIVWTFPDRVPLHREPLYTPRRDLVTDYPTWEDKDAIFRVPTLYKSIQEQDKSGEYPIVLTSGRLVEYEGGGEETRSNPWLAELQQEMFVEVNPKDANDLGFRDGDDVWVEGAEKGRIKVKAMVTRRVKPGLAFIPFHFGGKFEGEDLRPKYPEGTQPYVVGESANTATTYGYDPVTLMQETKVTLCNIRKA

SEQ ID NO: 6951 - protein, 538 aa, Methanococcus maripaludis
MESFKNLGLSDEILEALEKKGFTNPTPIQEQAIPILIEGKRDIVGQAQTGTGKTAAFGIPILETIDEHSRNTQALILAPTRELAIQVAEEIDSIKGSKRLNVFPVYGGQSIDRQIRELRRGVQIVVGTPGRILDHISRRTIKLENVSYVVLDEADEMLNMGFIDDVEEILKSVSTDKRMLLFSATLPDSIMKLAKNYMREYDIIKVKRQQLTTTLTDQSFYEIHSRDKFELLSRIIDTEKEFYGLIFCKTKADVDEVANRLNEKGYAAEGLHGDMTQAQREKTLDKFKGKKINVLVATDVAARGIDINDLTHVVNFDIPQNPESYVHRIGRTGRAGKQGYAITFVEPSEFRKFKYIQKIAKTEIKREEVPDVKDIISAKKIKIISGIKEVLESGKYADCEKMASDLLEDADPQEVLSAVLKYALKDELSESNYKKIGRGSQRSERSGRNDSRGRRSFAPGENVRLFVALGKLDKMNPKKLVDHISRKSDVKGRDIDDVKVFEKFSFVTVSSSDAEIILDSFKNERRGRRSIIEVASGN

SEQ ID NO: 6952 - protein, 465 aa, Glycine max
DAWAQQLASRQCVRASSSQIGVLLMGLCFLTIGSAGVRPCSIPFGVDQFDPTTDEGRKGINSYFNWYCTTFTMVLLVTHCELVYIQDSVSWRIGFGIPTVCMLCSIIMFFVGTRVYVHVKPEGSIFSGIAQVLVTAYKKRKLNLPMSEEKPDGVFYDPPLIGITVVSKLPLTKEFRALNKAALIMEGELNPDGTRVNQWRLVSIQQVEEVKCLARIIPIWAAGILSLISMTQQGTFTVSQAMKMNRHLGAKFQIPAGSVSVISLITIALWLPFYDRILVPKLRKMTKHEGGITLLLRIGIGMVFSILSMVVAGYVEKVRRDSANSNPTPLGIAPMSVLWLAPHLILMGLCEAFNIIGQIEFFNRQFPEHMRSIGNSFFSCSFGVSSYVSSIIVNIVHHSTRTHSHPDWLTDDINAGRLDYFYYLIAGLTSLNLVFFIYVARRYQYKGNVDLLDETHQVELGSHKA

SEQ ID NO: 6953 - protein, 386 aa, Aspergillus oryzae
MKLNPSLLTAAGLVSAQLASALPQASSSTVSPSPSPSATPGSFVTTSGLNFVIDGKTGYFAGSNSYWIGFQKNNDDVDLVFSHLQESGLKILRVWGFNDVNQKPTDGSVYYHLLADGTATVNEGEDGLQRLDYVVSSAEKHGIKLIINFVNFWDDYGGINAYVKAFGGSKEGFYTNDAMQAAYRAYIKAVISRYSDSTAIFAWELANEPRCQGCETTVLYNWIESTSQYIKSLDSKHLVCIGDEGFGLDTGSDGSYPYQYSEGSDFAKNLAIPTIDFGTFHLYPSSWGTTNDWGNGWVTSHGAACKAAGKPCLFEEYGVTSDHCAVEKPWQNTALNTTAISGDLYWQYGDQLSGGPSPDDGNTFYYGTDDFKCLVTDHIAAINSRK

SEQ ID NO: 6954 - protein, 621 aa, Dendrobium cv.
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPSRTGLNLQLSHTLSNQIPVGSVVSTNLPIVNQVFNSSRAVRIPHTCPLARFQHQTGRYVPPEVVAVRVPLLHLSNFQINDWPELSAKSFAVMVLMLPSDSARKWHVYELELVEVVADQVAVALSHAAILEESMRARDLLLDQNVALDLARQEAEMAIRARNDFLAVMNHEMRTPMHAIIALSSLLLETELTPEQRLMVETILKSSNLLATLINDVLDLSKLEDGSFELEATVFNLHTVFREVVNLIKPIAAVKKLSVFVSLSPDLPSLAIGDEKRLIQTMLNVVGNAVKFTKEGSISITATIAKSDSLRDSRDPEFHPIPSDGYFYLRVQVKDTGCGISPLELPRLFTKFAHTQNGSYKGYTGSGLGLAICKRFVNLMKGRIWLESEGIGKGCTTIFIVKLGISEDPTLRYQQKLLPPIPKDEKNSIPSKIRHQRSL

SEQ ID NO: 6955 - protein, 131 aa, Picea abies
DFQEVDHHAVEDRELKDHLLRKYSGYLSSLKQEFMKKKKKGKLPKDARQKLLDWWTLHYKWPYPSETEKIALAECTGLDQKQINNWFINQRKRHWKPSEDMQLMAMDGQSPHGATLYVERHLMTEGYHLDC

SEQ ID NO: 6956 - protein, 425 aa, Alkaliphilus metalliredigenes
MKRELKFVVSIMVILGLLISSLGCAREEEPGEPLTPEIEDERVEVPNVGEMILSSEAWQEEYPMIYESFIRTSRYKDGVIEDPELGGLMPLDYIQEYPEIEILYDGIGFAKEYYAARGHYYALTDVINTVRPKPGASCLACKTSEYERLYVENGDDLFRMDFHETVQEIENGISCYNCHRNEPGERVQVTSPHFADAVERLDLEIPPGNMACAQCHVEYYFEPETGTIVLPWDNGIGVDEIEAYFDERDFHDWKHPRTGTPLIKVQHPEFEMYTDSLHARLGITCIDCHMPTVEEDGETYTSHWAKSPLKTVNESCGQCHGPDGDAIIADTQAIQKEIKGELAELSSMIVKLIEDFAVLVEERDLDEETLHELWSLHRKAQYRWDFVFVENSTGFHNASKARRTLEDGKEYAQQALELLEGLNNQ

SEQ ID NO: 6957 - protein, 180 aa, Unknown
  Polaromonas sp. JS666
MPSSPQTITLGGGCFWCTEAVYVKVRGVTDVESGYSNGQAERPSYDDVCTGRTGCNEVVKLTYDPEEISLREILEIFFVIHDPTSLNRQGNDAGTQYRSGIYYSTPEQKQVADDFIRQASQDKLFGNPIVTEVLPLANYWPAEAYHQDYFENNPNQGYCAFVVGPKVEKFRKTFASRVKD

SEQ ID NO: 6958 - protein, 215 aa, Triticum aestivum
SADAWADAWADAWVDILEVGDGGAGGGVSLAGTWWGKEALALAEEVSASFDGDLKIYAFKATANLEIRVRIEKMSTRYGSPTIDDIEAYTIAYRAKLDDAESAGRIPKNVSLEVSSPGVERVIRVPDDLERFKERSMYVRYVMTSEDAATTQEGDGVFRLISYDVDLCECTWGIADVKINRQQTGKGRPLSKKQREWRLQTPFESLKLVRVYSEC

SEQ ID NO: 6959 - protein, 131 aa, Desulfovibrio vulgaris
MKEVIAIIRPNRINATKKAMVEAGLPAFTGARCMGRGRKPVEFELLKHLEGSGEDTADVLPALAQGGRLIQKRMLTIVVPDERVSAVVDVLMKANRTGQPGDGKIFVRPVIDVARIRTGETGATAIDEMKG

SEQ ID NO: 6960 - protein, 117 aa, Chlorobium tepidum
MKKIEAIIRTSQYEAVKKALHEIDIDFFTWWDVTGQGNDKKHRTEIYRGTVRDTSYISRRYLSIVVRDVNLQKTVDCLIKNARTGEVGDGKIFVSDIEQSYRIRTGESGDESLYNKD

SEQ ID NO: 6961 - protein, 55 aa, Passiflora tryphostemmatoides
  misc_feature (52)..(52): Xaa can be any naturally occurring amino acid
WEYQVGPSVGIEAGDHIWGSRYILERITEQAGVVLTLDPKPIEGDWNGAGCXTNY

SEQ ID NO: 6962 - protein, 253 aa, Unknown
  Synechococcus sp. CC9605
MSHVVSFVGAGPGAPDLLTLRAAERLNKADVLVWTDSLVCPAIADLAPASCERIRTSTTTLEDLIPLLIDRQRQGKRVVRLHDGDTALYSAINEQICALSDAEIPVEVIPGISAYQAAAAGLASELTLPGVVQTIVLSRAGGRTGVPEREQLDRLAALRASLCIYLSARHVEEVQTTLLQHYPADTPVAIGHRVSWPDQMLTVVPLREMAAVSRERNLIRTTLYVVSPALAGGPQRSRLYSPDHDHLFRPMAQ

SEQ ID NO: 6963 - protein, 166 aa, Zea mays
IQDSRQSCPGFVIDTKPDLQVAEIIKSSLYLGSQDVTQDLKLMKDCRITHIVSIGVPVPPLPHMSNLVYSFIPALDVPDEPIDNMLNKALPSMEEVIRKGGCVLVHCNAGISRAPTVVIAYLMTYCGLTFNDANALVKEKRPASKPNAGFVQQLLSLERKLMREKT

SEQ ID NO: 6964 - protein, 65 aa, Passiflora umbilicata
GTNGEVMPGQWEYQVGPSVGIEAGDHIWCSRYILERITEQAGVVLTLDPKPIEGDWNGAGCHTNY

SEQ ID NO: 6965 - protein, 319 aa, Unknown
  Synechococcus sp. RS9916
MTGTPGTVLVTGTTSGVGLNTVKALASQGWTVITGNRSPQRAAGAADALDIPKERLKHIQMDLGDLDCVRRAVASLDQPIDALVCNAAVYKPRLKQAERSPQGYEISMATNHLGHFLLIHLLMPALQASTHPSKRVVILGTVTANSKELGGKIPIPAPADLGDLSGFEAGFQEPITMANNKAFKPGKAYKDSKLCNMITTQELHRRLHGETGIVFSSLYPGCVADTPLFRNTPKAFQTIFPWFQKNITGGYVTQALAGERVAQVVSDPDFAVSGVHWSWGNRQKKDGQQFSQELSDKATDPQTAERVWDLSMKLVGLGG

SEQ ID NO: 6966 - protein, 158 aa, Bradyrhizobium japonicum
MSAIYDFKANSLLGEEVPMRRFEGQVLLIVNTASKCGFTPQYRGLEDLYRDLSPRGFAVLGFPCNQFGAQEPGQASEIQEFCSTNYDVTFPLFEKIDVNGANAHPLYEYLKRQQSGLLGASIKWNFTKFLVDRAGRVIARYAPTARPEGLRQQIETLL

SEQ ID NO: 6967 - protein, 128 aa, Brassica napus
MVSKESCRNEIRAAIGQLSERCLHSAAKWAGEQLVGIEQDPSNFTPSNTRFQRGSSSIRRRFSTNESISTPQPSVGFSQAATPLPEEDDVIDGDLYHLAKSYFNCREYRRASHVLRDQMSKKSVFLRC

SEQ ID NO: 6968 - protein, 374 aa, Arabidopsis thaliana
STLLSDEVLLNLTDATGKDRIIAEYIWIGGSGMDIRSKARTLPGPVTDPSKLPKWNYDGSSTGQAAGEDSEVILYPQAIFKDPFRKGNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILGEPTLEAEALAAQKLSLNV

SEQ ID NO: 6969 - protein, 48 aa, Passiflora vespertilio
SVGIEAGDDIWWSRYIIERITEQVGVVVTLDPKPIEGDWNGAGCHTNY

SEQ ID NO: 6970 - protein, 415 aa, Solibacter usitatus
MENVLAILLAGGAGERLYPLTRDIAKPAVPFGGAYRIIDFTLSNCINSDVRRILILTQYKSLELVRHIRDGWNILSPEMGEYVEVLPPMKRVHSDWYQGTADAVFQNFQSIEAESPEVTLILSADHIYKMNYREMIDWHRRHGADITLATLQAPPEEAPRFGVLEIDADYRVTGFEEKPQHGNPKRSQFDPNMVSVSMGVYVFNTEVLLRLLHEDAQDPNSSHDFGKDIIPRHLESTRVVAYDFRDINAKQSRYWRDVGTLDAFYEANMDLVSVTPEFNLYDQRWPIRTKATQQPPAKFVFAQEGRRMGLAVDSIVSAGCIVSGGRVLHCVLSPGVRVNSYCEVEYSILMPNVEVGRYSRIRRAIVSTGAKIPESSSIGFDVETDRANGYQVTEGGVTVVGNFEEGRTKALPYLA

SEQ ID NO: 6971 - protein, 482 aa, Oryza sativa
MCTLRPGRGLMHLLASSSSIPMATTRATSTLLLLLLLVSATWAASAPTTSRARNVITHVKGFQGRLPFHLETGYVEVDNTNTVELFYYFIQSERSPADDPLILWITGGPGCSALSGLLFEIGPLKFDVAGYTEGFPQLFYFQDSWTKVSNVIFLDAPVGTGFSYAREEQGYNVTLTQTGQQLVVFLTKWLGDHPEFASNPLYIGGDSYSGYTVPVTALQIANDDDARARLNLKGYLVGNAATDVKYDSGGKVPFMHGMGLISDEMYEAARSSCRGDYVSTPTNADCANALQAISMATFAINPVHILEPICGFALRGRAMPETTMDQRLRLGLPVECRDNGYRLSYLWADDPEVRATLGIHEGSIASWSRCTALPLFRHDVDSAIPYHAELTQRGYRALVYNGDHDLDMTFVGTQQWIRTLGYNVVTAWRPWYSNRQVAGFTTVYDHNLTFATVKGGGHTAPEYRPKECLDMLDRWTSPAGEL

SEQ ID NO: 6972 - protein, 511 aa, Ipomoea batatas
MMEAVTIKVPYRNLKQEVELVGADELHQRRLQIDSQSSPPRVSNGDSTDSSHHQSPVQSSLLTLILSCTVAAGVQFGWALQLSLLTPYIQVQPCVGIWSDKCSSKYGRRRPFILIGSLMISISGPARALLADLSGPDQRNTANAVFCSWMAVGNILGFSAGASGNWHRWFPFLMSRACCEPCGNLKAAFLIAVVILALCTLVTLHFAKEVPLTPNLSPRLADSSPLLDSPNPDFELAQAKDDMQPINFVSDNKSENGYMDNNPIHEDQKGVNDQADSFNDSPAAVLVNLLTSLRHLPPAMHSVLIVMALTWLSWFPFFLFDTDWMGREVYHGDPNGDVSEVKAYNQGVREGTTVISFVSLNESSEGVQHVIGASKATKVASLVVFALLGIPLAITYSVPFSVTAELTADAGGGQDDYLTWCGSMGRLIWRREHTSICPGLYIRTRGWYHRNTQTAKSLEKLIQINRLPFLITRDSAHTTDERRKLAIHNARQDCDGSVGTHNELPYKRVNL

SEQ ID NO: 6973 - protein, 256 aa, Unknown
  Synechococcus sp. PCC 7002
MRHFEKKRYVHYGYSFLSLVSGLRCGDRFGVLSPSVTWANPQLNALLEQGNEQLTNRNFAQAVQHYRQALTLEANNARIHGALGYALSQLGNYSEAVTAYRRATELEDDNAEFFNALGFNLAQSGDNRSAINAYQRATQLQPNNLAYSLGLATVQFRAGDYDQALVAYRKVLAKDSNNTMALQNSLTSLLQLGRNQEAAVLFPDLLRQRPNDAELRIKAAVTWFGLNDRDQAIAFLEEARRLSTRDSAMQIRVGKI

SEQ ID NO: 6974 - protein, 114 aa, Symbiobacterium thermophilum
MAQYTVPITDATFEAEVLQSELPVLVDFWAPWCGPCRMIGPVLEEYARDNGHRIKIAKLNVDEEQEWAGRFGVMSIPTMILFHKGKPVGQLVGFRPKHEMYQILDSALDQLESA

SEQ ID NO: 6975 - protein, 266 aa, Flavobacteria bacterium
MANNTEVKNLLDAGVHFGHLTRKWDPNMAPYIYMERNGIHIINLYKTKAKLDEANEALRKIAASGRKILFVATKKQAKDIVAQHAGDANMPYITERWPGGMLTNFVTIRKAVKKMALVDRMKKDGRYETLSKKERLQVDRMRAKLEKNLGSIVDMTRMPAALFIVDTVREHIAVKEALKLGIPIFAMADTNANPRDIDYVIPSNDDASKSIDIIVNSAAEAIKAGLEDRKNEKNNEAAAKTEKEAKAKAEKAAKAKKEAVKAEEEE

SEQ ID NO: 6976 - protein, 340 aa, Unknown
  delta proteobacterium MLMS-1
MAGGLTVLGAGSWGTALAGVLAGKGLPVYLCCRDPQHAARMAAERENSAYLPGFKLAPGIQPTTDLGVVAACRAVVMAVPSHGFRSVFKRVIPHLAPDTAIISATKGIENDSLLTMTAVMAEELAAADPSPACHLGCLAGPSFAREVAEGLPTAVTVAAASREEALFFQELFFTQRFRVYIGTDLIGQELGGALKNIIAIAAGISDGLGYGTNSRAALITRGLAEITRLGVAMGANPLTFSGLAGLGDLVLTCTGDLSRNRSVGLKLGQGMSLAEILAEMRMVAEGVKTTRSARALAHRQGVEMPILEEVYLVLYEDKPCRQAVYDLLAREGKEELEFGG

SEQ ID NO: 6977 - protein, 508 aa, Unknown
  Shewanella sp. MR-7
MQNHSNLNDIGVIGLGVMGKNLALNIADNQYRVSAFDLDPVKVNGVLQQEKQERVGQDLRITGCANLSEMLASLAQPRILVLSVPAGAPVDGVCHALISAGIEADDIVIDTGNSLWTDTVEREKRYQGKFIFFSSAVSGGEVGARFGPSLMPSGDLGAWQHVAPIWKAIAAKVDPQTGLPIERFEPGNPVTEGEPCTTYIGPAGAGHYVKMVHNGIEYADMQLICEAYQLMHDGLGMSASQVGEVFERWNKGSLNSYLMGISAEVLKQADPLTGLPLVEMILDKAGQKGTGLWTAVSSLQIGCPAPTIAEAVYARAVSTQKSLRVELSKKLAGPVSVAMDDAQKAVLIDALESALYCAKVCCYAQGFQLMAMTAQEQKWQLDFAEIAKIWRAGCIIRATFLQSITQAYQADADLSCLLMAGTFATTLSEKQTEWRSAVAAAVMQGIPVPCISSALAYYDSYRSETLPANLLQGQRDFFGAHTFERLDKPAGEKYHLDWSAPNRVLIKL

SEQ ID NO: 6978 - protein, 494 aa, Caulobacter crescentus
METPARRNTPMDAKVEDNIAGKCPMGHGRGPANRDWWPQSLRLEGLNQHAPRSNPMGEAFDYAEAFKSLDLDAVVSDLHALMTDSQEWWPADFGHYGGLFIRLAWHAAGTYRITDGRGGAGGGQQRFAPLNSWPDNTNLDKARRLLWPIKQKYGAKLSWADLYVLVGNVALESMGFKTFGFAGGRADQWEPEELYWGPESTWLDDKRYSGERELDSPLGAVQMGLIYVNPEGPNGNPDPLASARDIRETFARMAMNDEETVALIAGGHTFGKAHGAGDASLVGVEPEGGAIEAQGFGWASKHGTGKGPDAITGGPEVIWTQTPTRWSNHFFDNLFKYEWELTQSPAGAKQWQAKNAPADIPDAFDPNKTHVPRMLTSDLALRFDPAYEKISRRFYENPDQFADAFARAWFKLTHRDMGPIGRYLGPLVPKEELIWQDPIPAVDHPLADDKDIAALKAKILATGLSASDLVSTAWASASTYRQSDKRGGANGARI

SEQ ID NO: 6979 - protein, 357 aa, Oryza sativa
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQNTKSDLQAMEQKLQGTEQKQQHMMAFLSRVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSPQ

SEQ ID NO: 6980 - protein, 72 aa, Clostridium acetobutylicum
MSKEDVIEMQGTVLESLPNAMFEVELESGQKILAHISGKLRMNFIRILPGDKVTVELSPYDLTRGRITWRAK

SEQ ID NO: 6981 - protein, 332 aa, Triticum aestivum
  misc_feature (129)..(129): Xaa can be any naturally occurring amino acid
MAVAMAAAALRPHLSLLSAGGGIPNPTLQTLSFVAPLLLRRRCRRRSSVVLSNASSSPPSPPPSPEKEAEAAPTAESCVNLGLEFFSKGRVRDALEQFDNALELNPNPTEAQAAFYNKACCHAYREESXKAADCLRIALRDYNLKFGTVLNDPDMAPFRASPEFKELQEEGSRGGEDIGPGFRRDLKLISEVQAPFRGGRRSFYVAFMAAAGLSTFVTIPRLIFGLQGGDGAPDFLERAGNGAINIGGIVVLVALFFWENKKEEEQITNISCNETLSRLPVRLSTNRITELVQLRDISRPVILAGSKASVTQAMQRAERYRTGDPSRRNKLG

SEQ ID NO: 6982 - protein, 213 aa, Neorickettsia sennetsu
MKNKLHRVGRCTASSSRWLYRHVNDPFVKKAKAEQYRSRAAYKLLEIDEKFNLIRKGFVVLELGSAPGGWSQVIADILNGTGRLIAVDLADMDPISGVEVVKLDIELQRKELYEYISGVELDVIVSDLAPSASGSRVTDSISSIRLAELVLHYAKNSLKKFGTVVTKILRGSEDEYRFVNSLRKQFKKIEYFKPDASRKASREIYLILLGKLS

SEQ ID NO: 6983 - protein, 189 aa, Physcomitrella patens
MAARGASPGHVQELFVYEINERDRGSPVFLPFGGKKQPGTDAHVNSLGDLVPFSNKIYDGSLKTRLGITAGLCTLISHSDQKNGDRYEALYSFYFGDYGHISVQGPYITYEDSYLAITGGSGIFAGCYGQAKLHQIIFPFKLFYTFYLQGIKKLPEALCAPCVPPSPSVAPADEAKQCLPNHVAPNFTK

SEQ ID NO: 6984 - protein, 255 aa, Streptococcus thermophilus
MAVISMKQLLEAGVHFGHQTRRWNPKMAKYIFTERNGIHVIDLQQTVKMVDTAYEFVREAAANDAVILFVGTKKQAAEAVAEEATRAGQYYINHRWLGGTLTNWNTIKKRIARLKEIKQMEADGTFEVLPKKEVALLNKQRARLEKFLGGIEDMPRIPDVIYIVDPHKEQIAVKEAKKLGIPVVAMVDTNADPDEIDVIIPANDDAIRAVKLITSKMADAIIEGNQGEDASADFQEAAAADSIEEIVEVVEGDNN

SEQ ID NO: 6985 - protein, 273 aa, Brassica oleracea
MGKDDLGLSLSLGFAQNQHPLQLNLKPTSSPMSNHQMFPWNQTFVSSSNHQNHQSLRKIDVNSFPSTVELEEETGVSSPNSTISSTVSGKRRSERQGSGDDLDIALDRSSSRGTSDEEEEYGGEACRKKLRLSKDQSAVLEDTFKEHNTLNPKQKLALAKKLGLTARQVEVWFQNRRARTKLKQTEVDCEYLKRCVEKLTEENRRLEKEAAELRALKLSPGLYGKMSPPTTLLMCPSCERVGGPSNHSQRSVSLNPWLQMAHGSTFDVKHPRS

SEQ ID NO: 6986 - protein, 168 aa, Zea mays
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPIFDKVDVNGSNAAPIYKFLKSSKGGLFGDSIKWNFSKFLVDKEGRVVDRYAPTTSPLSIEKDIKKLLGSS

SEQ ID NO: 6987 - protein, 189 aa, Psychrobacter arcticus
MNNNDTFNNDHSIQEQPESSVKADGVQPISAQTTGYTFNHTMLRVKDPVRSLEFYTGVLGMTLLAVKKFPAMGFDLYFLAKLTESERENLPSGNDLEIFAFRQRGILELTHNYGTETKADFSYHDGNQEPQGFGHICFNVPDLNAAVAWFDENHVEFKKRPDEGSMKNIVFIKDVDGYWIEIVQADLMA

SEQ ID NO: 6988 - protein, 188 aa, Physcomitrella patens
  misc_feature (168)..(168): Xaa can be any naturally occurring amino acid
MGNKVDKLAGVQELSVYEINERDRGSPVILPFGGKKDENGAHANSLGDLVPFSNKVYDGSLQRRLGITAGICTLISHNAEKKGDRYEAQYSFYFGDYGHISVQGPYITYEDTELVVTGGTGIFAGCHGVAKLHQIIFPVKLFYTFYLQGIKKLPEELCASVVPPSPSXEPSEQAKKCHPSSVAPNFTN

SEQ ID NO: 6989 - protein, 1722 aa, Oryza sativa
  misc_feature (1424)..(1424): Xaa can be any naturally occurring amino acid
  misc_feature (1455)..(1455): Xaa can be any naturally occurring amino acid
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMGTPVNIIVGSHVWAEDPDDAWIDGEVVEIRGGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDCFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTISXAESSTELAYWLSTTSTLLYLLQNTLKSSSSXNARSSSLGSGISSGYSGMVGRPDTASKVEAKYSALRFKQQLTAYVEKIYGMIRDNLKKEINPFLIMCIQVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 6990 - protein, 888 aa, Glycine max
MLTWWGKSSSKETKKKANKESFFDTLHRKLRISSKGKVSIRSGGSRRHCNDTISEKGDHSPCGSRSPSPSKVARCQSFIDRPHAQPLPLPGLHPSSVGRVDSEISISSKSRLEKVSKPLSFLTLPTPGCIRCRPNPADLDGDMVTASVFSDCSADSDEPADSHNRSPLAIDCETGTRTAAGSPSSLMLKDQPPAVSQLNSTGVKKPGNILSNHMSSTSPKRRPLRNHVPNLQVPPHGAFYSAPDSSLSSPSRSPLRAFGTDQVLNSAFLAGKPYPEINFVGSGHCSSPGSGHNSGHNSMGGDMSGPLLWQPSRGSPEYSPVPSPRMTSPGPSSRIQSGAVTPIHPKAGGTPTESQTHRLPLPPLSVSNSSLFSHSNSAATSPSMPRSPARADNPNSGSRWKKGKLLGSGSFGHVYLGFNSERGEMCAVKEVTLFSDDPKSMESAKQFMQEIHLLSRLQHPNIVQYYGSETVDNKLYIYLEYVSGGSIHKLLREYGQFGELVIRSYTQQILSGLAYLHAKNTLHRDIKGANILVDPTGRVKLADFGMAKHITGQSCPLSFKGTPYWMAPEVIKNSNGCNLAVDIWSLGCTVLEMATTKPPWFQYEGVAAMFKIGNSKELPTIPDHLSNEGKDFVRKCLQRNPHDRPSASELLDHPFVKNAAPLERPIPAPEALDPVSGITQGAKALAIGQGRNLSSLDSDRLSVHSSRFLKTNPHESEIHIPRNISCPVSPIGSPLLRSRSPQHRNGKMSPSPISSPRTASGASTPLAGGSGAIPFGNHSKQSIYFQEGFGSIPKSSNGVYMNGHSHHDSNVDIFRGMQMGSHISPELVSSENDVLVKQFARHPHAEPYDFQSVLADRVGRQLLGEHVKINPSIDLSPNSSLLSRPNGL

SEQ ID NO: 6991 - protein, 62 aa, Passiflora vitifolia
GEVMPGQWEYQVGPSVGIDAGDHIWCSRYILERITEQAGVVLSLDPKPIEGDWNGAGCHTNY

SEQ ID NO: 6992 - protein, 397 aa, Debaryomyces hansenii
MASEGITEIDSGLIETNYDNVVYTFDDLNLKPNIVRGIFGYGYESPSAIQQRAILPITEGRDVLAQAQSGTGKTATFTISALQRIDENEKSTQALILAPTRELALQIQNVITHIGLYLNVTVHASIGGTSMKDDIEAFKSGVQIVVGTPGRVFDMIERRFFKTDKVKMFILDEADEMLSSGFKEQIYNIFRLLPETTQVVLLSATMPQDVLEVTTKFMNNPVRILVKKDELTLEGIKQFYINVEQEDYKFDCLCDLYDSISVTQAVIFCNTRSKVEFLTTKLKGENFTVSAIHADLPQADRDTIMNEFRSGSSRILISTDLLARGIDVQQVSLVINYDLPANKENYIHRIGRGGRFGRKGVAINFVTDQDVGMMREIEKFYSTQIEEMPADIGALFN

SEQ ID NO: 6993 - protein, 112 aa, Neisseria meningitidis
MKKIEAIVKPFKLDDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 6994 - protein, 179 aa, Alkaliphilus metalliredigenes
MVNDIKETLFSQEEIAQRVEELGKQITADYNHEEGLVVIGVLKGASIFLGDLVRKIDRPLSIDFMAVSSYGLSTESSGVVRILKDLDLEIEDKHILIVEDIVDTGLTLKYLTENLKSRNTKSIKVCTLLDKPARRKCDLPIDYIGFDIPDEFIVGYGIDYAEKYRNLPYIATLKSEVYR

SEQ ID NO: 6995 - protein, 181 aa, Yarrowia lipolytica
MPAVSPTLKTTASSELLTVAAGCFWGVEHMYRKHFADKGLVDAKVGYSGGNTEDPSYRKVCSGTTGHAEALQVSFEPAKVSYEQLVDFFFKIHDPTQANGQGPDIGSQYRSAIFTHSSEQQKIAEGVKQKLQDTWFKDPIATDIEPIQNWWDAEDYHQEYLFKEPGGYQCPTHFYRNTPQK

SEQ ID NO: 6996 - protein, 279 aa, Ustilago maydis
MASYLASIYGTEQDKVNCSFYYKIGACRHGDRCSRKHIRPPYSCTLLLSNVYRNPRHHEQDCTITDTELQAQFDAFYEDMFTELAKYGQLVEMHVCDNVGDHLIGNVYARYKYEADAQRAVDALNDRWYDAKPLFAELSPVTDFQEACCRQNETNECNRGGFCNFMHLRYASRPIRKELNHQLAVELRRRKEEGRDTAKGVKKRLGWKERLALEQGDTLADVEGDDGNREENGKAKRDWRSGKSGGDWRSQPRSTEVDQVDHQGHDSTPSITAADPEER

SEQ ID NO: 6997 - protein, 244 aa, Deinococcus radiodurans
MIKGKWRGVRGGPCLLCRPAFGRVGPGSGALTRARPSRAALHRRLYLRPMPRTAAVTRTTKETDITVRLDLDAAPYEQPATGHGFFDHMLDALARHSRLGISISGTGDLHIEPHHLIEDTGITLGQALSQALGDRKGIERYGSAFVPMDETLAHVVLDLSGRAHLAFEPETLDVYGDAGGMTHYHLREFLRGFCNHAGATLHVRLLAGREAHHVIEAVMKAFARALRDAVAVTSDALPSTKGSL

SEQ ID NO: 6998 - protein, 374 aa, Streptomyces noursei
MRRDIGAPRRRFNGDPDGTRLSSATKGTEVMSTVHTGVTQSGLTAELASLHAELVRRNPGEAEFHQAALEVLETLAPVLTARPEFADAKVLERIVEPERQIMFRVPWQDDSGTIRVNRGFRVEFNSALGPYKGGLRFHASVNLGIVKFLGFEQIFKNALTGLNIGGGKGGSDFDPHGRSDAEVMRFCQSFMTELHRHLGEHTDVPAGDIGVGGREIGYLFGQYRRITNRWEAGVLTGKGLAWGGSKARTEATGYGNVLFTEEMLKQRGEELDGQQVVVSGSGNVAIYTIEKAQALGANVLTVSDSGGYVVDEKGIDLALLKQVKEVERGRVGDYAQRRGSSAKYVAGGSVWDVACDVALPSATQNELDADAARI

SEQ ID NO: 6999 - protein, 519 aa, Oryza sativa
MQGIGRRYGRIKVYAVLGDDEAQHAKNNMRGALFHVDNPGPMAPIAKGNFLDVNQALEVVRFGIQYCDWRARQDLLTIMVLHNKVVEVLKSLAIEFKSNGTLRKELAELQEELAKAHNQVHLSETRASSALDKLAQADNLVNDRLLQDGGSSASIDNYVSLASRTSSASRFVNKKTLRPSLDVSGPVQPYNPNLKNFWYPVVFSGDLKDDTMVPIDCFEEQWVIFRGKDGRPGCVQNTCAHRACPLHLGSVSEGRIQCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLSTTGISKPGKLEGKSIKQCSTHLHQLHICLPSSRNKTRMLYQMSLNFAPWLKHIPFMHILWSHFGEKVLNEDLRLVLGQQERMINGANVWNWPVSYDKLGIRYRLWRDAIERGANRLPFNNQSESGS

SEQ ID NO: 7000 - protein, 504 aa, Medicago truncatula
MPNPTTTNPHRSRTRSSTSTSTSRPVQPVQPRTPLRQLLRVASVASGIQFGWALQLSLLTPYVQQLGIPHKWASIIWLCGPVSGLFVQPLVGHLSDRCSSRFGRRRPFILVGAASIVVAVVIIGYAADIGYLIGDDITQNYRPFAIVVFVIGFWILDVANNVTQGPCRALLADLTCNDARRTRVANAYFSLFMAVGNILGYATGSYSGWYKIFTFTLTPACSISCANLKSAFFLDVAFIVVTTYLSIVSAHEVPLSSSGAGESGSAEEAFMWELFGTFKYFSMPVWIVLSVTALTWIGWFPFNLFDTDWMGREIYGGDPEGGLIYDTGVRMGALGLLLNSVVLAVTSLLMERLCRKRGAGFVWGISNIFMAICFIAMLVLTYAANSIGYVSKGQPPPTGIVIAALAIFTILGFPMAITYSVPYALISTHIEPLGLGQGLSMGVLNLAIVVPQIVVSLGSGPWDQLFGGGNSPAFAVAAVAALLSGLLALLAIPRTRTQKPRVRI

SEQ ID NO: 7001 - protein, 82 aa, Oxalis peduncularis
GINISGTNGEVMPGQWEYQVGPSVGIEAGDHIWASRYILERITEQAGVVLTLDPKPIDGDWNGAGCHTNYSTKSMRDEGISL

SEQ ID NO: 7002 - protein, 95 aa, Oxalis flagellata
LYAGINISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 7003 - protein, 501 aa, Flavobacteria bacterium
MAFHVIKIIFAVLKKLRMQHQRIATLLQAEPSMQEITVKGWVRSFRNQRFIALNDGSTIHNLQCVIEPDNHDEDLLDQINVAAAVAVTGTLVESAGSGQRVELQATTIKILGTADREEVAKTILSPKRHKLETLREQAHLRVRTNTFGAVMRVRAALSFAVHKYFQENGFYQAHTPIITGSDAEGAGEMFRLSTLDPKNPPLDEEGNIDYKQDFFEKESNLTVSGQLEAETYAMGLGQVYTFGPTFRAENSNTSRHLAEFWMIEPEVAFNDLDANMDLSEDFIKSVVKYTIDNCKDDLEFLENRLIQEDKSKPQAERSPMELRKKLEFILKNNFKRVSYTEAIDILKSSKPNKKKKFKYLIEEWGADLQSEHERYLVEKHFECPVILFDYPADIKAFYMRLNDPDSEGRETVRAMDILFPGIGEIIGGSQREERYDVLKEKMDTMGIPEEELWWYLETRKFGSVTHSGFGLGFERLVMFVTGMSNIRDVIPYPRTPGNAEF

SEQ ID NO: 7004 - protein, 149 aa, Vitis vinifera
SYSGYHDELLWGASWIHRASNNASYLAYIQSNGQTMGADDDDYSFSWDDKRAGTKVLLSKDFLEKNTEEFQLYKRHSDNYICSLIPGTSSFQAQYTPGGLFYKGSESNLQYVTSTAFLLLTYAKYLSSNGGSASCGTSTVAAERLISLA

SEQ ID NO: 7005 - protein, 270 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTCDTQLVEHFFQSLVNTSGMTLHIRQLAGENSHHIIEATFKAFARALRQATETDPRRGGTIPSSKGVLSRS

SEQ ID NO: 7006 - protein, 520 aa, Glycine max
MEPFSSTKQNHNNNNTLTKPSLHVESPPLEPSPLRKIIVVASIAAGVQFGWALQLSLLTPYVQLLGIPHTWAAYIWLCGPISGMLVQPIVGYHSDRCTSRFGRRRPFIAAGSFAVAIAVFLIGYAADLGHSFGDDLSKKVRPRAIGIFVVGFWILDVANNMLQGPCRALLGDLCAGNHQKTRNANAFFSFFMAVGNVLGYAAGAYSKLYHVFPFTKTTACDVYCANLKSCFFLSIALLTTLATAALVYVKEVPLSPEKAVIDSDDNGGMPCFGQLFGAFRELKRPMWILLLVTCLNWIAWFPFLLFDTDWMGREVYEGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 7007 - protein, 709 aa, Gibberella zeae
MASPFRLMRPISQVARSGVVSFAARPFSSTAARFAVQDIKTTKEFKDLVSATDKAVLVDCFATWCGPCKAISPILSKLSEQPALSDNIEFVKFDVDELPDLTAELGVRAMPTFFVFKGGKKVDELLDFAIENCKAAKIGARDIDSGRSIKSGDIFTIVRDTEHIDKCQKMFDIQWAIICAIAISGGALTPDEFGDLDKSIFPWLWKKTKKKKKKKKKKKKKKKKKKKKKKKKKKKKKKKKKKKKKKKKKKKKKKYRKLYYVVSVRSGSANQLALIRPSTSSIDENKRRWKAVMYGITEDHTVSVICARETSKSWQGVSQSIRLVKYNLEIQTEPQSAADQASFVTTINMANTIIVVGAGVSGLTSAYLLSKNKGNKITVVAKHMPGDYDIEYASPFAGANVCPMATQENSRWERRTWVEFKRLCEQVPEAGIHFQKCHIARRKKDVEEAKSSTFPDALFQEEPWYKELFEDFREQNPNEVTRGYDSGCEFTSVCINTAIYLPWLAGQCLKNGVVLKRTSLTDISEAKKLSHTGKVPNIIVNATGLGSLKLGGVKDETMAPARGQIVVVRNESTPMLITSGVEDGGSDVMYLMQRAAGGGTILGGTYDVGNWESQPDPNIAQRIMQRIVEARPEVADGKGVKGLSIIRHAVGLRPWRKGGLRLEEEKLDDETWIVHNYGHSGWGYQGSYGCAEGVVELVDKVGKGAKAKL

SEQ ID NO: 7008 - protein, 92 aa, Oxalis andina
  misc_feature (41)..(41): Xaa can be any naturally occurring amino acid
GINISGTNGEVMPGQWEYQVGPSVGIEAGDHVWASRYILEXITEQAGVVLTLDPKPIEGDWNGAGCHTNYSTKSMRDEGGFEVIKKAILNLS

SEQ ID NO: 7009 - protein, 137 aa, Vitis vinifera
AAWLHKATRNPTFLSYIQVNGQTLVADDSDNTFGWDNKHVGARILLSKAFLLQRVQSLHDYKGHADNFICSLVPGTPFSQAQYTPGGLLFKMSDSNMQYVTSTSFLLVTYAKYLTSAHKVVNCGGTIITPKRLRVIA

SEQ ID NO: 7010 - protein, 506 aa, Symbiobacterium thermophilum
MSGIAGILGKPDKARIVRMLEQQAHRGPDGRGIWTATAGFGLGHVRLATVDVAGGGQPLSNEDGSLWLAMTGAIYNHGALRRELEGRHAFRTQSDAEVVVHLFEEYGPACVERLDGMFAIAIWGEEVGLFLARDPLGIQPLYWGEDEEGNVLFASEIKALVGETRFVREFPPGHRWRAGEPLEPYERLPAHTGELADPDQIVLALDRLLHAAVRKQLAADVPVGCLLSGGLDSSLVTAIARQHAEGELHTFAVGLEGSADLEQARMVAGELGTIHHERVLTEKEVTAVLPRVVDALESCDPALVRSAVATYYVAELAAGHVKVVLSGEGADELFAGYDYLAEFERDAGALGAELYEITAAMHNCNLQRVDRMTQVHGVEARMPFADQAVVDFAFRIHPRLKRRDGESKWILRRVAEQYLPPAIVWREKQKFAIGSGIAPLLEHYAAKAVPDAAFRRARSPKGVPFASKEEFLYWSLFRERYGREDVLALMGRSRSLNQGQRWVGAL

SEQ ID NO: 7011 - protein, 608 aa, Hordeum vulgare
MAALATSQLATSGTVLGVTDRSAPSMFRHAGFQGLRPRKPADGTFGMRTVGASAAPKQSRKAHRGNRRCLSVVVRATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 7012 - protein, 421 aa, Brucella suis
MTTENLLESALVRLDEAASHINIDADVIEKLKFARETMKVRLMIRMDDGSRKSFIAWRCRYDDTRGPTKGGIRYHPDSTVEEVETLAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHASNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 7013 - protein, 379 aa, Clostridium acetobutylicum
MKSTKILILGAGPAGFSAAKAALGKCDDITMINSEKYLPYYRPRLNEIIAKNKSIDDILIKKNDWYEKNNIKVITSEFATSIDPNNKLVTLKSGEKIKYEKLIIASGSIANKIKVPHADEIFSLYSYDDALKIKDECKNKGKAFIIGGGILGIELAQAIIDSGTPASIGIILEYPLERQLDRDGGLFLKDKLDRLGIKIYTNSNFEEMGDLIRSSCVITAVGVKPNLDFIKDTEIASKRGILVNDHMETSIKDIYACGDVAEFYGKNPGLINIANKQGEVAGLNACGEDASYSEIIPSPILKVSGISIISCGDIENNKPSKVFRSTQEDKYIVCMLKENKIDAAAVIGDVSLGTKLKKAIDSSKSFDNISSLDAILNNL

SEQ ID NO: 7014 - protein, 103 aa, Phanerochaete chrysosporium
MSGRGKGGKGLGKGGAKRHRKILRDNIQGITKPAIRRLARRGGVKRISGLIYEETRGVLKIFLENVIRDSVTYTEHAKRKTVTALDVVYALKRSGRTLYGFGA

SEQ ID NO: 7015 - protein, 400 aa, Clostridium acetobutylicum
MPAIKIKDNIFSVGVLNPSLRIFDIIMKTEYGTSYNAYLIKGKKNVLIDTVHGRFFDEYLENIKSVIDPSSIDYVIMNHCEPDHSGSLARLYEVAPQIKVIASNAGKIYLKNITNKETLDVKAVKTNDTLDIGNGKVLKFAIAPFLHWPDSMFTILEEDKIAFTCDFLGCHFCEPRMFDTKITYMPKYEKSFKEYYDAIFSPFKPYVVKGLDILDALDLDFIATSHGPILTREGLLAASKQKYRDLSSEIQSTTKYIPIFYCSAYGNTEILANEIASGIKSVLNDANIEMLDIINYDYSDLKEKINICDAFMLGTPTINKDALFPIWELIGGIDAVNCKNKPASAFGSFGWSGEAIPFVISRLKELKLKVFQDGFTCLFVPSEDDIKKAFKFGEDFAKSI

SEQ ID NO: 7016 - protein, 161 aa, Oryza sativa
HASIQKIHSNFAAKRSRERSINPSSMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 7017 - protein, 475 aa, Brassica oleracea
MGSGVALFTLSLLLVTHHAHSAIGVNWGTMSFHKLKPSTVVDLLKANKITKVKLFDSNPDALRALMGTGIQVMISIPNELLSTFSSDLFVQQNLSRFMGKGGADIRYVAVGNEPFLTSYGGAYQNYVFPAMVNLQQSLVKANLASYVKLVVPCNADAYESNVPSQGTFRPELTQIMTQLVSFLSSIGSPFVVNIYPFLSLYQNSDFPQDFAFFEGSSHPVLDGPNVYYNAFDGNFDTLVSALAKIGYGQMPIVIGEIGWPTDGAVGANLTAARVFNQGLINHLLSNKGTPLRPGSPPEDVYLFGLLDEGAKSTLPGNFERHWGIFSFDGQAKYRLNLGLGNRGLKNAENVQYLPSRWCVAHPAKDMTLVTDHLRLACSQADCTTLNDGGSCSQLGEKDNISYAFNSYYQLQMQNEKSCDFDGLGMVTFLDPSVGECRFLVGVTDKSSSAELMARWGIYHICIGLVVWALTRCYIL

SEQ ID NO: 7018 - protein, 183 aa, Pseudomonas fluorescens
MAMRWFAVPALLATLAGSAWAADCPPLLQGSLPKLHAKESIDLCQRFAGKPLVVVNTASFCGFAPQFKGLEALYQRYKDQGLEVVGVPSNDFKQEAKDGAKTAKVCYVNYGVTFTMTEPQKVRGADAVHLFKVLAQQSSAPKWNFYKYVVDRQGNVIASFSSLTKPDNPEFIEAVEKALASKS

SEQ ID NO: 7019 - protein, 200 aa, Glycine max
  misc_feature (174)..(174): Xaa can be any naturally occurring amino acid
MGVTQLNPTCSKPRLHSSQLSFLSRTLPRHRHCTFAPLHRTQQARISCSVAPNEVQVPTVKTQDPKSKPECYGVFCLTYDLRAEEETRSWKKLINIAVSGAAGMIANHLLFKLASGEVFGPDQPIALKLLGSERSIQALEGVAMELEDSLFPLLREVSIGIDPYEVFQDAEWAXLIGAKPRGPGMERADLLDINGQIYAA

SEQ ID NO: 7020 - protein, 403 aa, Desulfitobacterium hafniense
MDNYYDLIIIGGGPAGLTAGIYGGRAKLKTLIINKGTIGGMADNTREIVNYPGYVNTSGPELMEDFKRHAKSFGVEFLKDEVVSADLSQDLKKIMTKKKKEVYGKAVIVAVGTQPRLLNIPGEKELRGNGVAYCATCDAEFFEGEDVVVVGSGDQAIEEGMFITKFARKVTVIVLHDKGVLDCNKVSAEKAFQSEKMDFVWNSTLEAVLGDENVEGVKVKNLKTGTSSILPCQGVFFFVGMIPATEFLKDSGIEMDHRGYISVNDLMETNLSGVYAVGDNRIKYLRQVVSAAGDGATAAVAAERYIEELEAFQKNILNSEKKVLLVFFNAADTQSLEYSSLVEELHKEHSEEYTLVKVDMATKKSLAEKYGVINAPAVVVLDKGEKVKDMECSKDKATLAGQL

SEQ ID NO: 7021 - protein, 925 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKLLLVPVDLKLRSSLPSSLHSLSSFDSPPIFSDAGENNLLHQSPTARSRRPMVFPLFLSQPNSSSRSISIPHRKLHKSDSKSLPHSRMRLYDDLLINGYYTTRLWIGTPPQMFALIVDSGSTVTYVPCSDCEQCGKHQDPKFQPEMSSTYQPVKCNMDCNCDDDREQCVYEREYAEHSSSKGVLGEDLISFGNESQLTPQRAVFGCETVETGDLYSQRADGIIGLGQGDLSLVDQLVDKGMDVGGGSMILGGFDYPSDMVFTDSDPDRSPYYNIDLTGIRVAGKQLSLHSRVFDGEHGAVLDSGTTYAYLPDAAFAAFEEAVMREVSTLKQIDGPDPNFKDTCFQVAASNYVSELSKIFPSVEMVFKSGQSWLLSPENYMFRHSKVHGAYCLGVFPNGKDHTTLLGGIVVRNTLVVYDRENSKVGFWRTNCSELSDRLHIDGAPPPATLPSNDSNPSHNSSSNLSGVTQVGQINLDIQLTVNSSYLKPRIEDLSKIFSKELDVKSSQVSLSNLTSKGNESLVRMVVLPPEPSTWFSNVTATNIVSRFTNHQIKLPEIFGNYQLVNYKLEPPRKRTNNNIVVIAIGIIAVIVGLSAYGAWLIWKRKQTSIPYKPVDEAIVAEQELQPI

SEQ ID NO: 7022 - protein, 426 aa, Unknown
  Photobacterium sp. SKA34
MSVYSTLCFLAAAAMLIAFVNSKIGKMQTTIAITAGSLILSLLIIIAGHNGWFHLEDVAASQISKINFEDFLLKGILGFLLFAGGLGIKLPHLEDQKWEITVLALGATLFSTFFIGFSLWGICQLIGIQLDLIYCLLFGALISPTDPIAVLAIVKKMNAPRRISTQIEGESLFNDGFGLVIFVTMFTIAFGDTAPTVIGVTQLFLQEAIGGIAYGFVLGLIFHYLISSTNDHSMELLLTIGIPTAGYALAEVLHVSGPLAMVVSGIMIGNWTRYIGFSKESEEHLDHFWELVDEFLNGVLFLLIGMTMLDFSFHQEDWILMIIVVPLVLLSRYISVKLPYVSFNRYRQYNPMSVKILTWGGLRGGLALAMAMAIPAGVMVIPEKGIDVREIILVMTYSVVVFSILIQGLTITPLIEKAKLWELKNK

SEQ ID NO: 7023 - protein, 332 aa, Unknown
  Acinetobacter sp. ADP1
MSTDQEFKAPANLGIAVYSNNAEAIGNTPLVRINRIIKTGATVLGKVESRNPAFSVKCRIGAALIADAEKRGVLKSGMHIVEPTSGNTGIALAFVAAAKGYPITLTMPASMSLERRKVLKAFGANLVLTEPAKGMKGAVEEAVRLATEQPDIYFLPQQFENPANPKIHEQTTGPEIWDATNGQVDILVAGVGTGGTISGISHYFEKVQNKPIYSVAVEPAESPIITQTKRGEEITPAPHKIQGIGANFIPKNLDLDIVDEVMPITSDEALEWARKCATQEGILGGISCGAALAAAAKIAERPENEGKTIVVILPDSGERYLSSVLFEGMFEE

SEQ ID NO: 7024 - protein, 464 aa, Yarrowia lipolytica
MSMGDDDRAYHHQMSVIVTAANANLPGHGKGPLVSVSSELLTKESHLMYDFERYVARNPSRFNQKVLDNLRIHHTYTRSSLDTLVNEFLAEITPACANRDAPSMLPSKMGSLPNDSLTGSVLSIDIGGSTLRGSMVDLEKMTVTDSVQHLIPDTVKNYSGSDFFDWIVERIMPLVKDCTATIIPIGLSWSFPIFQPHISSGLIQTMGKGYGVADEIINQDLKELFETHFASHGKTVEVGAILNDSVASLVAANYISNAPLCLILGTGINVSALIPKDQLKKTEQDQDKYIVNCEASLFGQCVSKTCWDLELDQALERPGFQPLESLSSGRYLGEICRLILRDLSKTGFLSRPDVGPYELTTAEVADLETADSGELDYVQDIILATSDRSAALASAFITAIYKLTGSDCESPSIAYDGTMVQKYPNFRPRMQQRLREQGLNVTFVAVEEGTVYGSAIACASQLSQ

SEQ ID NO: 7025 - protein, 315 aa, Magnaporthe grisea
MTAFGSETTAEEVVSAFSSNVKGRTFLITGASANGLGAYMATSLARASPQALILIARSEVKVAPVIEEIASIDPAIRAIFVPVDLTDQESVRAAAATILDDRDMTKIDVVINCAGIMYVEEFTTDAKGNELQFSANHVGHFLLTNLLMPKILAAGEGARIVNITSHGHQLSDVWWSDPTFNKGKDYHGWSGYGQSKTANILFSVELARRLKDRGVVSLAGTGLFQHVPMERLDEGDMISRKNTGLPFGLDLPWKTSSQGSSSGLAAALDPELAAHSGSYIQNCQVGTPRQYALDGEKAKKLWIMTEELVGQKFDL

SEQ ID NO: 7026 - protein, 431 aa, Unknown
  Synechococcus sp. RS9916
MKRVLAIILGGGAGTRLYPLTKMRAKPAVPLAGKYRLIDIPISNCINSSITKMYVLTQFNSASLNRHLSQTYDLSAGFGQGFVEVLAAQQTPESPSWFEGTADAVRKYQWLFQEWDVDEYLILSGDQLYRMDYSLFVEHHRKSGADLTVAALPVDPQQAEAFGLMRTDEHGTIQEFREKPKGDSLKEMAVDTSRFGLSPESAQSKPYLASMGIYVFSRKALFDLLNDHPTYKDFGKEVIPEALSKGMSLKSYVFDDYWEDIGTIGAFYEANLALTQQPKPPFSFYDEDFPIYTRPRYLPPSKVGDSQIIDSIIGEGSIIKSCSVNHCVLGIRSRIENSVVVQDSLVMGSDFYESTQEREELRRNGGIPLGVGEGSTVKRAILDKNTRIGRNVTIINKDNVEEADRPELGFYIRNGIVVVCKNATIPDGMVI

SEQ ID NO: 7027 - protein, 236 aa, Acorus gramineus
MTKRYWNIDLEEMMEAGVHFGHGTRKLNPRMAPYISAKRKGIHITNLTRTARFLSEACDLLFDAASGGKHFLIVGTKKKAADSVASAAIRARCHYVNKKWLGGMSTNWSTTETRLQNFRDLRAEQKAGKIDRLPKRDAAMLKRQLSTLQTYLGGIKYMTGLPDIVIIVDQQEDYTALRECVILGIPTICLIDTNSDPDLADISIPANDDAIASIRLILNKLVFAICEGRSSYIRNR

SEQ ID NO: 7028 - protein, 175 aa, Vibrio vulnificus
MTTQLATFGGGCFWCTEAMFSQLKGVLDVKSGYSGGHVKHPCYREVCSGKTGHAEVIQVSFDPDIIRYEALLLVHLTTHNPTTLNRQGADRGTQYRSIILAHDEEQKRIAQQVIAEVAPYFDEPIVTEVVDFEQFYQAETHHQNYYSDNPEKQYCAVVIEPKLRRLRERYADLLG

SEQ ID NO: 7029 - protein, 223 aa, Gluconobacter oxydans
MISQTAAAPLPRNCTFEAADWDLLSRCWHPVALVRELEEKPLGVTLLDAPLVLYRASGTIVIADDLCPHRDVPLSMGTGNGETIACAYHGFRFGNGGKCVRVPAHPDSAIPSKLNLRTYPAVERYGLIWTCLNSDGTVTIPPMPHWDEPEYQQINCPWIDIAGFAGRQVEGFIDVAHFAFVHTETFADPDNPVVPSYMPRMTKDGFEAEYRSTVSNFPVGHED

SEQ ID NO: 7030 - protein, 472 aa, Unknown
  Synechococcus sp. RS9916
MSKAHFGLIGLGVMGENLVLNAERNGFSSVVYNRTYAKTEEFLAGAGAGKDIQGATDLQDFVNKLQHPRRILMMVKAGAPVDAVIQQISPYLEKGDLLIDGGNSEYHDTERRVAELESKSFGFIGMGVSGGAKGALEGPSMMPGGTKASYDAIESLVTKMAAQVEDGPCVTYIGPGGSGHFVKTVHNGIEYGIEQILAEGYDLMKRVGGMNGTQMADVFKHWNSTEELASYLVEITEVCLRTKDPETGSDLVELIQDKAGQKGTGLWTVVSALQMGASVPTIYAALNGRVMSSMKDQRVKAETILKGPAIAPFAMGTPADGMGPLMDAMVLACMASYAQGMELLRIASAEHNYNLHMPSIAQIWKGGCIIRARLLKRIQDAFNADPQLPNLLIDPWFADQVNRRLPGLAQVVAGAAQAGIPVPCLSSTLDYINSYRTSRLPQNLVQAMRDCFGSHTYERIDKDGIFHTEWLD

SEQ ID NO: 7031 - protein, 197 aa, Brassica napus
MALGDLSSSSSSSSSQELHVLAVDDSIVDRKVIERLLRISACKVTTVESGTRALQYLGLDGDNGSSGLKDLKVNLIVTDYSMPGLTGYELLKKIKESSAFREIPVVIMSSENIQPRIEQCMTEGAEDFLLKPVKLADVKRLTELIMRSGEPQEEDKAKHSYPNRILQNNTDSSSSSHDYVSSVYDDTPSSKRMKLES

SEQ ID NO: 7032 - protein, 949 aa, Bradyrhizobium japonicum
MNPVKELEKHGQAVWLDFLARGFIAKGDLKRLIDTDGVKGVTSNPSIFEKAIGSSDEYDAPIGKALKRGDRSVADLFEAVAVEDIQNAADVLRPVYDRLKGGDGYVSLEVSPYLAMDTTGTVAEARRLWKDVNRKNLMVKVPATPEGLPAIETLIGEGISINITLLFSRDVYLQVAEAYLAGLEKYVAGGGDPSHVASVASFFVSRIDSVVDKQLDEKIARANDPSEKERLAALKGKVAIANAKVAYQDYKRLFSGSRWDKLAARGAKPQRMLWASTGTKNKDYSDVLYVEELIGPDTINTVPPATLDAFRDHGKPRDSLEENIDDARRVLEELERSGVSLDAITEELVKDGVKLFADAADKLYGAVAHKRATVLGPALDRQQLSLGDGLGKAVAKSTEEWRASAKIRRLWQRDKSVWTGADEDKWLGWLDSAAKADVADYEDYASRVKGQKFSDAVVLGMGGSSLGPEVLAETFARKSGFPKLHVLDSTDPAQVRAMEAKIDIANTVFIVSSKSGGTTEPNAMKDYFHDRVAQAVGPKVKTGHRFIAVTDPGSSLEKSAKTLNYARIFHGEPSIGGRYSVLSPFGLVPAATAGIDVKTFVKHALAMARSCGPDVPPSENPGVQLGLAMGLAGLEGRDKVTILSSKKITDFGAWAEQLIAESTGKEGKGLIPIDGEPLGEAAAYGNDRFFIDIRTEGEADAAHDSKLAAIEAAGHPVVRIVMKSIDHLGQEFFRFEMATAVAGSILGINPFDQPDVEAAKIKTRELTASFEKTGALPAEQPVVSTDEADLYTDEANATALRAAGANGDLTSWLKAHLSRSGHGDYVALLGYIARDKATIDALQAMRLEVREKRHVATCAEFGPRFLHSTGQAYKGGPDSGVFLQITADDAKDLAVPGQKASFGVIKAAQARGDFDVLTERGRRALRVHLKGGLKKGLAALNAALNDALN

SEQ ID NO: 7033 - protein, 480 aa, Blastopirellula marina
MSEQCDFGLIGLAVMGENLALNVESRGYSVAVYNRTTEKTDEFISGRAAGKKFVGCHTLEDLVKSLKAPRKVMMLVKAGPAVDSIIDQLIPLMDKGDIIIDGGNTLYSDTERRTKYVEEQGLLYSGTGVSGGEEGALKGPSLMPGGSEAAWPELKEIFQAIAAKVGPNDDIPCCEWVGPRGAGHYVKMVHNGIEYGDMQMICEAYFLLKHGIGLTNEELYDVFDEWNRGFLQSYLIEITRDIFSVKDEKTGDFLVDKVLDAAGAKGTGKWMSQLALDLGVPSTLVTTAVYARSLSAVKEARVRASKVLAGPKESYTGDKKQFIEHVRDALYASKIISYAQGFVQLQAAAAEHDWPLNYGDCALLWRGGCIIRAQFLDRIKEAFDADPNLENLLLAPYFTDAIDKAQAGWRNVVTTAATLGVPAPAFAGALAYYDGYRRADLPANLLQSQRDYFGAHTFKRNDMEGTFHAEWLKLRKEPKA

SEQ ID NO: 7034 - protein, 328 aa, Prochlorococcus marinus
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGAIDVLVAGVGTGGTITGVSRYIKQEKGKNITSVAVEPSHSPVITQTLNGEEVKSGPHKIQGIGAGFIPKNLDLSIVDKVEQVTNDESIEMALRLAKEEGLLVGISCGAAAAAAVKLAEQDEYAGKTIVVVLPDLAERYLSSIMFTEVPSGIIEEPINA

SEQ ID NO: 7035 - protein, 128 aa, Geobacillus stearothermophilus
EQWQTLYEAIGGEETVAKLVEAFYRRVAAHPDLRPIFPDDLTETAHKQKQFLTQYLGGPPLYTAEHGHPMLRARHLRFEITPKRAEAWLACMRAAMDEIGLSGPAREQFYHRLVLTAHHMVNTPDHLD

SEQ ID NO: 7036 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKHGVDRVFIDHPSFLEKVWGKTGEKIYGPDTGVDHKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 7037 - protein, 339 aa, Desulfotalea psychrophila
MSNLTPSIAVIGAGSWGTSLAILLAGKGYPVRLWGHNKEHIDRLISDGENSRYLPGISLPESLYPTPSLEKAVLGAQLVLMVVPSHVFRTVFRDLIPFLPIDCQIVSAVKGIENSTLSTMHMVMAQELAAYPALALIELGVISGPSFAKEVAQKQPTAVTVGFASADTAKKVQDIFSTDYFRVYTSTDIDGLEISGAFKNVMAIAAGISDGLSYGSNARAALITRGLAEMQRLGAAMNADPATFAGLSGLGDLLLTCTGDLSRNRNVGLQLGKGHSIEHIESEMFMVAEGVKTTKSFYDLARKLDVETPILDEVYHIIYEGKDCSQAVQDLLGRKLKPE

SEQ ID NO: 7038 - protein, 509 aa, Alteromonadales bacterium
MREKINIVWFKRDLRLSDHQPLKSAFDTGLPTLLIYNFEPLLLEDAHYNERHWRFVYQSIVDLNSQLARFNAKVYTFNENMQTLLQKLNGQFEISYIFSHQEIGLNNTFERDLAIKAWCHHNHINWQESPTGAVIRGKKNRDNWNERWQKTMQAPLAIPNWKNVNSVKLKNYKNPELPETYTQDDDNFQQGGPLHAREVMQSFFTQRGKGYQKGISSPSLSRTHCSRLSPYLAWGNISLRQVYQTAIDAYHSNHPDKKGWKRPLAAFVSRLHWHCHFMQKFESECTMEFKALNPGYHSFPYRTDKHVKHDIERWAQGQTGVPIIDACMRCLKATGYINFRMRAMLVSFVTHHLNISWQQASFPLANYFLDFEPGIHYPQIQMQASVTGINTIRHYNPIKQSEDQDPTGAFIKKWCPELEKLPIEYLHEPWEQTPMEALFNDFKLGEDYPEPMLDLTLASKDARERLWQYRDRPEVKRAIGKILRKHVAITPNTSKVKNKNTAKNNTQVK

SEQ ID NO: 7039 - protein, 275 aa, Amborella trichopoda
MAWTMYQRSIPGIRFRRNNSIFQISGYLIPEKKEEVWVEMARRYWDINLEEMMGAGVHFGHGTRKWNPRMAPYISGKRKGIHITNLTRTARPLSEACDLVFDAASRGKHFLIVGTKDKAADSVASAAIRARCHYVNKKWLGGMSTNWSTTETRLHKFRDLRAEQKMGRFKRLPKRDAAMLKRQLSHLQTYLGGIKYMTGLPDIVIIVDHQEEYTAIRECLTLGIPTICLIDTNCDPDLADIPIPANDDAIASIQLILNKLVLAIREGHYSYLGSH

SEQ ID NO: 7040 - protein, 491 aa, Agrobacterium tumefaciens
MWLGRASSKRRLYFPSYPVFHKNICHFSPQRRSLTGKSRWPYCSCSGRALRRHRITVSGAFTMSNTDAFFSRPLAEVDPDIFGAIEKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVERKAKETRPKLILAGGTAYSRVWDWKRFREIADEVGAYLMVDMAHIAGLVAGGQHPSPFPHCHVATTTTHKSLRGPRGGMILTNDEDLAKKFNSAVFPGLQGGPLMHVIAAKAVAFGEALQPEFKDYAAQVVKNAKALAETLIEGGLDVVSGGTDNHLMLVDLRKKNATGKRAEAALGRAYITCNKNGIPFDPEKPFVTSGVRLGTPAGTTRGFKEAEFREIGKLIVEVLDGLKVANSDEGNASVEAAVREKVVGLTDRFPMYPYM

SEQ ID NO: 7041 - protein, 290 aa, Zea mays
MATGSEASKAAETVVDWHKQDSKRMLHAVYRVGDLDRTIKYYTECFGMKLLRKRDVPDEKYTNAFLGFGPENTNFAVELTYNYGVDKYDIGTGFGHFAIANDDVYKLAENIKSKGGKITREPGPVKGGSTVIAFAQDPDGYMFELIQRADTPEPLCQVMLRVGDLERSIKFYEKALGMKLLRKKDVPDYKYTIAMLGYADEDKTTVLELTYNYGVTEYSKGNAYAQVAIGTNDVYKSAEAVDLATKELGGKILRQPGPLPGINTKIASFVDPDGWKVVLVDNTDFLKELQ

SEQ ID NO: 7042 - protein, 473 aa, Burkholderia xenovorans
MKALFLQAPSYDGFDGGAGSRYQAKREVRSFWYPTWLAQPAALVPDSRVLDAPADGLSVGQTLDIAEQYDLVVIHTSTPSFPTDALFAEDLKKRKPSVLIGMVGAKVAVDPHNSLTATEAIDFVCREEFDFTCQEVAEGKPFAQIKGLSYRAADGSIEHNEARPILENMDELPFVAPVYKRDLKIDNYFIGYLKHPYVSIYTGRGCRSKCTFCLWPQTVGGHRYRTRSVENVLAEVKWIRDNMPEVREIMFDDDTFTDFKPRVEEIARGLGQLGVTWSCNAKANVPYPTLKIMKENGLRLLLVGYESGDDQILLNIKKGLRTDIARRFSDDCRKLGIKIHGTFILGLPGETQDTIQKTIEYAKEINPHTIQVSLAAPYPGTTLYNQAVDNGWLEENKVINLVSKSGVQLAAIGYPHLSRDEIYHQLENFYKRFYFRPSKIWEILREMLTSWDMMKRRLREGVEFFRFLRAHEA

SEQ ID NO: 7043 - protein, 345 aa, Crocosphaera watsonii
MVTQNTTTKDIGFTHEDFAALLDKYDYHFSPGDIVPGTVFSMEPRGALIDIGAKTAAYIPIQEMSINRVDDPDEVLQANETREFFILTDENEDGQLTLSIRRIEYMRAWERVRQLQAEDATVRSDVFATNRGGALVRIEGLRGFIPGSHISTREAKEDLVGEQLPLKFLEVDEERNRLVLSHRRALVERKMNGLEVGQVVIGSVRGIKPYGAFIDIGGVSGLLHISEISHDHIDTPHSVFGVNDELKVMIIDLDAERGRISLSTKQLEPEAGDMLKNRDLVFEKAEEMAEKYRQKLLAEAQGKEAPTEEVLEDVPSASETEEPQEELAATATADTDDTVATATEE

SEQ ID NO: 7044 - protein, 237 aa, Hordeum vulgare
MPSRPAPFIHRLRLLRSAVVSPSSAPLPCSRPRLAVPFAQPPIRAPAFAAAGSPLLRPVGARFSLSSNMAAAASSASSVHDFTVEDASGKDVDLSTYKGKVLLIVNVASQCGLTNSNYTELAQLYEKYKDQGFEILAFPCNQFGGQEPGTNEEIVQFACTRFKAEYPIFDKVDVNGDNVAPVYKFLKSSKGSLFGDNIKWNFSKFLVDKDGNVVDRYAPTTSPLSIEKDIKKLLASS

SEQ ID NO: 7045 - protein, 555 aa, Burkholderia pseudomallei
MAIVFTVLILLLAVALSGVATRVLPLRLPLPLMQIAIGAVLAWPRFNLHVTFDPEIFMLLFIPPLLFADGWRIPKRELYLQRRAILMLAFGLVFMTVLAVGYFAHGLIPGLPLPIAFALAAVLSPTDAVALAGIAGKGRIPPQLMHILEGEALMNDASGLVALKFAIAAALTGMFSLRDASISFVIVASGGLAAGAALAWLFSALSTRFLNAAQEGDPAPGIVMTLLVPFASYLIAEHLGLSGILSAVASGMMMNYTSFSKSSTVAARVRAESTWAMIEFVFNGMVFIMLGLQLPHIIGRALVDAHHTSDALVGAMIGYVAAMLAALYAIRFTWVWLLRWIASRRAAKQGLAGTMAGLRTIAVMTVGGVRGAITLAGVLSIPVALGDGTPLAGRDTAIFVASGVILGSLVVAVIALPLLLRGVRPMRNPHAEEERAARAAAAQAAIRAVDAAHDALAVDLDESAAARCADVTARVMDLYRRRLAGLAADGATPREEARQTEKMELALKIAAIRAERAVLYRLRGEQKINDETLAKLMREVDFSETALSTRKKGIV

SEQ ID NO: 7046 - protein, 171 aa, Hordeum vulgare
MGAAESSSKLGGSVHDFVVKDVRGNDVELSRYKGKVLLIVNVASRCGLANSNYTEMGQLYEKYREKGLEILAFPCNQFAGQEPDSDEKIVEFACDRFQAQFPIFRKVDVNGNNAAPLYKFLKSERGGLFGERIKWNFTKFLVDKEGHVMNRYAPTWSPLGIENDIKKLLEV

SEQ ID NO: 7047 - protein, 428 aa, Unknown
  Mesorhizobium sp. BNC1
MLQVREPSEHDIVTLMAELGRRGRAAARPLAVASTERKNAALLAMAEALEANTGRILAANKTDMEKGEAAGLSAAILDRLKLDEKRVRAIAEGIRAIADLDDPVGTVIAEWDRPNGLHIERVRTPLGVIGVIYESRPNVTADAGALCLKAGNAVILRGGSDSAASSAAIHSCLVEGLRKAGLPEDAIQRVPVTDREAVGEMLRGLGGNLDVIVPRGGRSLVERVQNEARVPVFAHLEGICHLYVDRSAKLDMAVALALNAKMRRTGVCGAAETLLVDRAVAGTHLVPILEALAAAGCEIRGGEDVRARFPSAISASEEDWRTEYLDAIISVKLVDGVFEAIEHIGTYSSHHTEAIVAEDPVAVQRFLNEIDSAILLHNASTQFADGGEFGMGAEIGIATGKMHARGPVGVEQLTSFKYRVHGSGQTRP

SEQ ID NO: 7048 - protein, 716 aa, Saccharum officinarum
  misc_feature (111)..(111): Xaa can be any naturally occurring amino acid
MATVDRTRTFMKDVKRVIIKVGTAVVTTHDGRLALGRLGALCEQVKELNALRYEVIIVTSGAVGVGKQRLKYRKLVNSSFADLQKPQMELDGKACAAVGQSGLMALYDMLXTQLDVSSSQLLVTDNDFENPNFRERLRETVESLLDLKVVPIFNENDAISTRKAPYEDSSGIFWDNDSLAGLLAIELKADLLVLLSDVDGLYNGPPSEPQSKIIHTYIKEKHHNGDHFFGGEVHVLVEEESQLKRRLLSWLQTVARLLLLQVDFASQSILRVLQGEKIGTLFHKDASLWEPSKDVSAREMAVSARECSRCLQNLSSDERKKILLDVADALEENEDLIKTENEADVAAAQDAGYEKSLIARLTLKPGKIASLAKSIRTLAHMEDPINQILKRTEVAEDLVLTCCPLGVLLIFFESRPDALVQRASLAIRSGNPLLLKGGKQPMRSNTVLHKVITGAIPSNVGEKLIGLVTSRDEIADLLKLDDVIDLVIPRGSNKLVSQIKTSTKIPVLGHADGICHVYIDKSADMNMAKRIVMDAKIDYPAACNAMETLLVHKDLIKAPGLEDLLLSLKTEGVTLYGGPVAQELLCIPKADSFHHEYSSMACTIEFVDDVQAAIDHIHRYGSGHTDCIVTTDDKVAETFLRQVDSAAVFYNASTRFSDGARFGLGAEVGISTGRIHARGPVGVEGLLTTRWIMRRSGQVVNGDKDIAYTHKNLPLQ

SEQ ID NO: 7049 - protein, 165 aa, Hordeum vulgare
MAAASSATSVHDFTVKDASGKDVDLSVYKGKVLLIVNVASQCGLTNSNYTELSQLYPKYKDQGFEILAFPCNQFGGQEPGTNDEIVQFACTRFKAEYPIFDKVDVNGNNVSPLYKFLKSSKGGFFGDSIKWNFSKFLVDKEGHVVDRYAPTTSPMSIEKDIKKLL

SEQ ID NO: 7050 - protein, 340 aa, Phaseolus coccineus
METLNDAYKAHPLDLGDIIPIDFSSSPAIPDSHSWSEPNDNRISSDDPPPVIDLLDPKAKDLISLACQNSGAFQLTNHGIPLGVIQAAEEEVEHLFSLPTEQKMKALRTPDGATGYGRARISPFFPKGMWHEGFTIIGSISQDVKKIWPDDHARFCDRMEDYEKKMKILAERVTEILFDLLNVSEEKRKWVDAEDKGTAIQLNFYPSCPEPNRTMGLAPHTDTSIITIVQSPSTGLQLYKEEKGWISVQPHPEALIVHLGDLAHIISNGRFCSPLHRVTLSETCKRYSIAYFYSPPIDHVLSPFVTEDDKSAAQFRPVTVKEYIAIKAQHFGNSISFVKI

SEQ ID NO: 7051 - protein, 84 aa, Glycine max
  misc_feature (58)..(58): Xaa can be any naturally occurring amino acid
MERWPATCYRLIKNKPYPKAMYCRAVPHPYSRIYYLGMNSLGVDVYRYSLHLATREKXKVPIDANEAALVVCITYLTKFKGEDC

SEQ ID NO: 7052 - protein, 105 aa, Anabaena variabilis
MTEKKQFNSFEEMLSGSDLPVLVDFYADWCGPCQMMATILQQVNNQLKDRIRIVKIDTEKYTELATQYQIYALPTLVLFKQGKPVDRIEGVLQTPDLVQRLQSFV

SEQ ID NO: 7053 - protein, 332 aa, Bradyrhizobium japonicum
MQLGMIGLGRMGGNIVRRLMRHGHSTVVYDKDAKAVAGLAADGAVGSATLEEFVAKLERPRTAWVMLPAGRITETTIDTIAGVMQEGDVIIDGGNTFWQDDVRRGKALKARGIHYVDVGTSGGVWGLDRGYCMMIGGEKQVVDRLDPIFAALAPGAGDIPRTEGREGRDPRIEQGYIHAGPVGAGHFVKMIHNGIEYGLMQAYAEGFDILKNANIDALPADHRYDFDLADIAEVWRRGSVIPSWLLDLTSTALADSPALAEYSGFVEDSGEGRWTVNAAIDEAVPAEVLTAALYTRFRSRKEHTFAEKILSAMRAGFGGHKEPKQPGASKPK

SEQ ID NO: 7054 - protein, 212 aa, Escherichia coli
MSLFDKKHLVSPADALPGRNTPMPVATLHAVNGHSMTNVPDGMEIAIFAMGCFWGVERLFWQLHGVYSTAAGYTGGYTPNPTYREVCSGDTGHAEAVRIVYDPSVISYEQLLQVFWENHDPAQGMRQGNDHGTQYRSAIYPLTPEQDAAARASLERFQAAMLAADDDRHITTEIANATPFYYAEDDHQQYLHKNPYGYCGIGGIGVCLPPEA

SEQ ID NO: 7055 - protein, 418 aa, Yarrowia lipolytica
MILEHHVNHQVAVDLDSAEAFEGPEKLLEVWFAPNQESLEGTNKSLRNVSTAQWEQLLNIVQCKVLSSVHTSVLDAFVLSESSMFVFPHKLVLKTCGTTTLLVGIPKMLEIARTIAGFGANATPYRVFYSHKTFNCPEKQAPPHKSWKDEVSYLDSQFDNGKAYLVGDTTSDHHWYCYVTGHDDHEEVAAHKDHVISSHDETMEILMTDLLPSRAQQFFTDRLPGDANNAGFQHKQELLVGVEHVVKAETDSATSSDSEGATPACSGTCKADPGHVLGAYVSTQSGIADIYPRNKASVAVDSFCFTPCGYSANAIVDSGYYYTIHVTPEQHCSYASFETNVPAKEYGMSNIDVIEKVLNVFRPGKLSVTLFEAENNSLQDCHQFARHLDGYKRTDKVLYEFDGYQMVYVCFEAIKGRK

SEQ ID NO: 7056 - protein, 129 aa, Silicibacter pomeroyi
MLKSKPKNIALIAHDLKKRSLATWVFNNQTKLKRHNILATATTGGIIQKHCPQLRIRVTKSGPLGGDQQIGAMIADDGIDLLIFFTDPLSPHPHDVDVKALSRLAVVYDVPMACSGATADLIAASGYLD

SEQ ID NO: 7057 - protein, 93 aa, Zea mays
  misc_feature (13)..(13): Xaa can be any naturally occurring amino acid
  misc_feature (22)..(22): Xaa can be any naturally occurring amino acid
  misc_feature (80)..(80): Xaa can be any naturally occurring amino acid
KPQGTCARVDIGXVLLFVRCKXESKANRAEEAFCRAKFKFPGRQKIIRSRKWGFAKFARAEYLKYKSEALLVVQGPLYKXLRAPGKAFFAENI

SEQ ID NO: 7058 - protein, 554 aa, Rhodospirillum rubrum
MEQMSILVIGGVAAGASFAARARRLSETARITVLERGPDVSFANCGLPYHIGGEIPDRGALAVQSAASLKGLLNLDVRVQTEAVAIDPKGKRVEVRDLASGQSAWLPYDKLMLAPGASPLRPPLPGIDDPRIFTLRNLQDMDRIIAATAPGQRAVVIGAGFIGLEMAEQLHRKGLGVDLVELQSQVLPPLDPPMAALVESELRRHDIGLHLGDAIARFESLGARLRCHLASDKTLDADIVILSIGVKPESDLARAAGLELGAKGHIVVDSFQRTSDPDIYAAGDGVETVDRILGGKTAVPMGGPANRQGRVAADHIFLADKARPYPGSVGTGIVRAFDAVVGITGWSEKRLAAAGHPYETVTVNDSHHASYYPGAKPMTLKILWEPDSGRLLGAQVSGSEGVDKRLDILSTAIIAGMTVEDLCHLELAYAPPFGSAKDLVNLAGFAACNRRDGLVSHTTELPTDPQVQVIDVRGKPLAEAYPAPGTTINIPFPTLRAHLDTLDKTRPVVTLCAFGKMSYFAARVLSQHGFTVKSFSGGLKANVDPRTPGKLPGA

SEQ ID NO: 7059 - protein, 334 aa, Prochlorococcus marinus
MASSQASPGTVLITGTTSGVGLYACKALVYRGWQVITANRHPLRAVAAAERVGIPAAQLTHLRMDLSDLQSVRDGVETLLGSLEQPLDALVCNAAVYQPRLRKPKRSAQGYELSMATNHFGHFLLIQLLLENLGKAKVFQSARGSYLSAARVVILGTVTANYKELGGKIPIPAPADLGNLSGFEQGFHAPISMASGKSFKPGKAYKDSKLCNMITTQELHRRLHEQSGILFTSLYPGCVADTPLFRYTPKIFRFLFPIFQRLITGGYVTQAKAGQRVAQVVTNPEFGVSGVHWSWGNRQKKNRESFRQELSERATDPITAKRVWELSMKLVGLT

SEQ ID NO: 7060 - protein, 1098 aa, Bradyrhizobium japonicum
MNVLSSVDTKKIEAAEVVDELWYKDAIIYQLHVKAFADSNNDGIGDFAGLTEKLPYLQELGVTALWLLPFYPSPGRDDGYDIADYGSVNPDFGTMKDFKRFIQEAQKRGLRVITELVVNHTSDQHKWFKRARRSHPGSSARNWYVWSDTDQKYQGTRIIFTDTEKSNWTWDHEAGAFYWHRFFSHQPDLNFDNPRVVSALIQVMKRWLDAGVDGFRLDAIPYLCEREGTSNENLPETHAIIKRLRQELDSYSKGKLLLAEANQWPEDVQEYFGRGDECHMAYHFPLMPRIYMAIAQEDRFPITDILRQTPDIPASCQWALFLRNHDELTLEMVTDVERDYLWTTYANDPRARINVGIRRRLAPLMDNDRRKIELMNSLLLSFPGTPIIYYGDEIGMGDNIYLGDRNGVRTPMQWSPDRNGGFSRCDPARLYAPLIMDPVYGYESVNVEAQSRSLSSLLSATKRLISVRKSTLAFGRGTMTFIRPANRAVLAYVRQYHDEVILCVANLSRAAQATELDLSPWKDRIPQEMLGRTRFPPIGELPYMITLGPYGFYWFHLMERDKSEPVTPRAVPEFETLVVPVNSTWVSLARERGVFEHDVLPGFLSRTRWYPEHDPKHIKPTLTSAVPFCDIGDNRPWIAFFEAAQQDAVATRYVLPMQIEWVRFDRERFNPKALAAVRQGAREGTLLDVATDQIFIGLFLRNLSQNLVVEENNLRLEFKATSRFADYTIKEPGRIRAIEQSNSTALVDNQYVAKIYRQLEGGTNPEIEIGHYLTEVARFANTPALLGSVELVEGDQRSTLGVLHAYVENQGDGWAVTTGYLDRYIDEQRVLSAGEAPRETQEQSPYLHFVMQIGRRLAELHVALAAARPDDLAPEPIGSAHIRHWVSDLKARAGRVFERLADSRDGLREADRPLIDQLTALRTSLPDRLNALLPSDIDGLNIRHHGDFRLGQILIVKDDICIIDFDGDPRLPLADKRRKLPAARDVAGLIRSIDLSVNVALGRALSGGTDEQSRLVAALSEWRERATTTFLSAYREAMTDRRLWPEDPQSAEGLLRFFLLDQAFDEVEYELSHRPEGLHAPLTGLLRILSNAESEAHA

SEQ ID NO: 7061 - protein, 188 aa, Aspergillus niger
CRDIVEAHYRACLYAGIKISGINAEVMPSQWEYQVGPCDGIEMGDHLWMSRFLLHRVAEEFGVKISFDPKPIKGDWNGAGLHTNVSSASMRAEGGMKVIEAAMKKLEARHVEHIAVYGEGNEERLTGRHETGNIDKFSYGVADRGGSIRIPRQVAKDGKGYFEDRRPASNACPYQITGIIVETLMGGN

SEQ ID NO: 7062 - protein, 919 aa, Neisseria meningitidis
MKRMLFNATQAEELRVAIVDGQNLLDLDIETLGKEQRKGNIYKGIITRIEPSLEACFVDYGTDRHGFLPFKEVSRSYFQDYEGGRARIQDVLKEGMEVIVQVEKDERGNKGAALTTFISLAGRYLVLMPNNPRGGGVSRRIEGEERQELKAAMAELDIPNGMSIIARTAGIGRSAEELEWDLNYLKQLWQAIEEAGKAHHDPYLLFMESSLLIRAIRDYFRPDIGEILVDNQEVYDQVAEFMSYVMPGNIGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHVACPRCAGTGVIRGIESTALHVLRIIQEEAMKDNTGEVRAQVPVDVATFLLNEKRAELFAMEERLDVNVVLIPNIHLENPHYEINRIRTDDVEEDGEPSYKRVAEPEEDESAKPFGGEKAKAARPEPAVKGVRHTSPAPTAAPEKKTSWWDSFKAWLKRIFGGSETQAAPAAETSEKRSTANRSGSRANNRRQNPRRSKREGSKVEVREVAGKTAGQEARADKAETRNNGNRRRNERGDRAAERANEAEIQSRNVQPAATVADAAPSETEVQTGKRRRNGSRSERGQTAPETATVAETTVQTAENTPSEPHTAEDKGSKPKSERNRRERDSRDAKERRERNNQRDRRQNGKKRNIPSAAKIEQYLNIHDTADKVRSAAAHVFGETDANAPITVSIADPVAERDLPTASPAVSNGDAPVYDAAEKIRRATAAILPEGATPKAEAQEMPSETATFTAAAEQARETAQTGGLVLIETDPAALKAWAAQPEVQAGRGLRRSEQPKPSEVATVPAEEMIQVETRQG

SEQ ID NO: 7063 - protein, 196 aa, Desulfitobacterium hafniense
MEMREAYIERQTKETRIRVKLNLDGAGTAQVDTGIGFFDHMLEALARFGYLDLEVAAEGDLQVDPHHTIEDCGLVFGQAIREALGERRGIERVGDTLLPMDEALVQVALDLSNRPYLVWDVECPEGMVGGFPVEMAEEFFRAVSVQAGITLHIRLFSGKNRHHILEAIFKGFGRALGLALRENPRFQGVLSTKGVL

SEQ ID NO: 7064 - protein, 72 aa, Brucella suis
MAKEEVLEFPGVVTELLPNAMFRVKLENEHEIIAHTAGRMRKNRIRVLAGDKVLVEMTPYDLTKGRITYRLK

SEQ ID NO: 7065 - protein, 370 aa, Kluyveromyces lactis
MSDIAAQFKLVKGSIYSHCFNQDRSLLAITYDTDCYVYKVSAAKQPQLVAVLPDHDKTVTAVDISVHGRIVTCSQDRNAIVWEPLSNGTYKPTLVLLRINRAATCVSWASSGYKFAVGSSARIIAVCYYEQENDWWVSKHIKKPIKSTINALSWHSNCVLLACGGTDGYARVFSGFIKGLDTKEQVAGSPWGEKFPFGSLVREWYQGAWIHDIKWRSSIDKVAFVTHDGSLNITDYTDDIKSVDNPEGLPFITLCWINDHEILAAGFSNHPVLYSEGSRGWEVSKILDSPVKSAGKLVASTGDDEEEGAFGMSALRKFKELDLKGKVSQQEEKSTHVNSITELAAYKESNNNVTQVSSVGLDGKLVIYKL

SEQ ID NO: 7066 - protein, 207 aa, Zea mays
KKKSIELATSSLDIHIHRPAYCIGIKTEFTMAHLISSAIAGAGNLVADGISGVTGVASQVVEGVEDTLGSIVEAIDQGVKDEDQLDLPKYVCFKGDNGLYLSARKVEGHPYLQFASGDIGDPSVRFITYNHKVNGKRVVRFKSNHLGKFWRRSPNWIWADTDDTSTNNSDTLFELIKIGEDGVYALRNLGNNYFCHRLDLRGQRRTA

SEQ ID NO: 7067 - protein, 107 aa, Haemophilus influenzae
MSEVLHINDADFESVVVNSDIPILLDFWAPWCGPCKMIAPVLDELAPEFAGKVKIVKMNVDDNQATPAQFGVRSIPTLLLIKNGQVVATQVGALPKTQLANFINQHI

SEQ ID NO: 7068 - protein, 202 aa, Rhizobium leguminosarum
MAETAASRTGSVSRKTNETSISVSVNLDGTGKSTISTGVGFFDHMLDQLSRHSLIDMEIDAKGDLHIDDHHTVEDTGIAIGQAISKALGDRRGITRYASIDLAMDETMTKAAVDLSGRPFLVWNVAFSAPKIGTFDTELVREFFHALAQNAGITLHILNHYGANNHHIAETCFKAVARALRTATEIDPRQAGRVPSTKGTLV

SEQ ID NO: 7069 - protein, 388 aa, Mycobacterium leprae
MAQREWVEKDFYKELGVSSDASPEEIKRAYRKLARYLHPDANPDNSAGERFKVVSEAHNVLSDPVKRKEYDETRRLFAGGWLGGRRFDSSFGDFGMGGDGAEFNLNDLFDAASRTGGTNIGDLFGGLFGRGASVRPSRPRRGNDLETEADLDFVEAAKGVAMPLRLTSPAPCTNCHGSGARPGISPKVCSTCNGSGVINRNQGAFGFSEPCTECRGSGSIIEHPCEECKGTGVTTRTRTINVRIPSGVEDGQRIRLAGQGEAGLRGAPSGDLYVTVHVRPDKIFGRNGDDLTVTIPVSFTELALGSTLSVPTLDGTVGVRVPKGTSDGRILRVRGRGVPKRSGGHGDLLVTVKVAVPLNLEGAAQKALEAYAAAERSSGFNPRAGWGR

SEQ ID NO: 7070 - protein, 977 aa, Arabidopsis thaliana
MISSKNGAAMISRPVFLSDRVDEVFSRKLDLSVSSSSSSSLLQQFNKTHEGDDDARLALAHQLYKGGDFKQALEHSNMVYQRNPLRTDNLLLIGAIYYQLQEYDMCIARNEEALRIQPQFAECYGNMANAWKEKGDTDRAIRYYLIAIELRPNFADAWSNLASAYMRKGRLSEATQCCQQALSLNPLLVDAHSNLGNLMKAQGLIHEAYSCYLEAVRIQPTFAIAWSNLAGLFMESGDLNRALQYYKEAVKLKPAFPDAYLNLGNVYKALGRPTEAIMCYQHALQMRPNSAMAFGNIASIYYEQGQLDLAIRHYKQALSRDPRFLEAYNNLGNALKDIGRVDEAVRCYNQCLALQPNHPQAMANLGNIYMEWNMMGPASSLFKATLAVTTGLSAPFNNLAIIYKQQGNYSDAISCYNEVLRIDPLAADALVNRGNTYKEIGRVTEAIQDYMHAINFRPTMAEAHANLASAYKDSGHVEAAITSYKQALLLRPDFPEATCNLLHTLQCVCCWEDRSKMFAEVESIIRRQINMSVLPSVQPFHAIAYPIDPILALEISRKYAAHCSIIASRFGLPPFTHPAGLPVKREGGFKRLRIGYVSSDFGNHPLSHLMGSVFGMHNRENVEVFCYALSANDNTEWRQRIQSEAEHFLDVSAMSSDAIAKIINQDKIQILINLNGYTKGARNEIFAMQPAPIQVSYMGFPGTTGATYIDYLVTDEFVSPLQYAHIYSEKLVHLPHCYFVNDYKQKNQDVLDPNSKPKRSDYGLPEDKFIFACFNQLYKMDPEIVNTWCNILKRVPNSALWLLRFPAAGEMRFRTYAAAQGVQPDQIIFTDVAMKSEHIRRSVLADVILDTPLCNGHTTGTDVLWAGVPMITLPLEKMATRVAGSLCLATGLGHGMIVNSLEEYEEKAVSLALNKPKLQALTKELRASRLTCPLFDTMRWVKNLERSYFKMWNLHCSGQQPQHFKVLENDLEFPHDR

SEQ ID NO: 7071 - protein, 575 aa, Unknown
  Nostoc sp. PCC 7120
MTIATSSRPRDVQVADIGEHTLILRSRTWERLKFEVEYSRQRGTTANSYLIQADKKALIDPPGESFTAIYLEQLAQYLDFTTLDYIILGHVNPNRRVTLQELLSKAPQATLICSRPAANALKTAFPEWESRIQAVRFEDILDLGQGHQLTFVTAPTPRWPDGLFTYDSATKILYTDKFFGAHICEDTLFDEDWKKLDAERHYYFDCLHAPQAKQVEAALDKVVMLGARSYAPGHGPVVRYSLSRFTYDYRQWCQGQKSQDLNVALLYTSAYGNTGILANAIAQGLVQNDVNVQSVNCELADTAEITRIVEACDGIIIGSPTLGGHAPTQIQTALGIVLSTAAKTKLAGVFGSYGWSGEAIDLIESKLKDANYRLGFDTIRVRFSPTPEILQQCQAAGATFAQTLKKNKKLRTPRQVIPEAKIDRTEQAVGRIIGSLCVVTTRDQESHKGILTSWVSQATFNPPGIMMAIAQEQNADLMSHTGDQFVLNILKEGRNVRRYFSRQSTLGDNPFANLKTKTADNGCLILTEALAYLECTVTNQLECGDRLLIYAVVDKGEVLANDGVTAVEHRKSGSH

SEQ ID NO: 7072 - protein, 576 aa, Unknown
  Nostoc sp. PCC 7120
MVALTEDTQANANIGRLTVQTVEIADETTAIRCLDWDRERFDIEFGLRNGTTYNSFLIKGEKIALVDTSHRKFEKLYLEIVAGLIDPNTIDYLIVSHTEPDHSGLVKDILQLAPNITIVGAKVAIQFLENMVHQPFKSLQVKSGERLDLGNGHSLEFVSAPNLHWPDTILTYDHKTGILYTCDVFGMHYCDDQTYDENFFAIEEDFKYYYDCLMGPNARSVLAALKRIENLAIKTVATGHGPLLQVHISEWLGRYKNWSLEQAKTETLVALFYAEDYGYSEHLVHILGHGCTKTGVAVELIDLNTAEPQEVRELVTQASGLVIAMPSQYSLTAQAALNTILAAVHHKQAIGLLESGGGEDEPVFPLRNKFQELGLVEAFPPILIKEAPAQTTEQLCEEAGTDIGQWLTRDRTIKQIKSINTDLEKALGRISTGLYIITTKKGEIQGAMFASWVTQASLNPLGVAIAVSKERAIESLMQVGDHFVLNVLEEDNYQGLMKHFLKRFAPGADRFAGIKTYPATDGSPILAESLAYTECEITSRMDCGDHWIIYSTVHVGRVANVHAMTAVHHRKVGNHY

SEQ ID NO: 7073 - protein, 289 aa, Oryza sativa
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAADLVAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLRHPWIVSRGGAAVMG

SEQ ID NO: 7074 - protein, 315 aa, Unknown
  Nostoc sp. PCC 7120
MSLTFVPPPIQKINSEIANNAGVEIYVLRLDLMHPWVNGNKWYKLKYNLLEAKEKSYTKLLTFGGAYSNHIFATAAAGNLLGFQTIGIIRGEETLPLNPTLSFATQQGMQLVYVDRETYRQRNSTTLHTDLRKRFGEVFIIPEGGSNLNGVRGCLEIISAATQVFDIVCVACGTATTLAGIALALEPQQRVIGFPVLKNGGFLAQDIAQLMKNYVAAGLPISSSSPASWELVCDYHFGGYAKVKDDLILFSHQFTQSYGVPLDYVYTAKMFYGVMDLLKQRYFTKGDGLRPTVGHRILMIHTGGLQGNIGMSERL

SEQ ID NO: 7075 - protein, 602 aa, Aspergillus oryzae
MATQHKTQSSPVNAAWWKEASVYQIYPASFKDSNGDGIGDIPGIISELDYLKALGIDLVWLSPILQSPQVDMGYDVSDYYRIHPPYGTVEDVDALIQGLHQRGMRYVMDLVVNHTSDQHEWFKQSRSSSDNEYRDWYIWKKPKYDANGVRQPPNNWGAYFGGSAWQYDETTDEYYLHLFAPEQPDLNWENPKVRSAVHQIMRYWLDKGVSGFRMDVINMISKDQSFPDAPITDPKAQWQHGAMHYCCGPRLHEYLQELGRVLKEYDAFSVGEMPNVYDPVEIGKAVGFDRGELAMAFQFEIMDIDHGPAGKFSPHKYRMSDLKHIVSKWQDFMYENEGWNALYLENHDQGRTISRFTSAGPEYRATAGKMLATFLGLQGGTPFVYQGQEIGLVNVPETWGIEQFRDIETLNYWNEITAAYPNDTELHKVTSQQFRVKSRDNGRTPMQWTSGKFAGFTAAHNGPWIDVHDDYEDWNAASQVGNPNSVFQHWAKVLALRKAHKRLFVYGSYKLIDEANNDLFTYLRVYGSQSALVLANFTGKEVSWVVPAETISILKNGAVLLESYQRHRPVRPDGTIAVMPFESFVMFLDSPNARVGAGGGKL

SEQ ID NO: 7076 - protein, 692 aa, Bradyrhizobium japonicum
MRLTAGSPARLGASWDGRGTNFALFSANAQKVELCLFDTQGRRELERVELPERTEDVWHGYLNDVSPGQLYGYRVHGPYEPEHGHRFNANKLLLDPYAKRLSGRLVWSDAHFAYRTGSPREDLSFDRRDNARGMPKAVVVDETFNWGRREIRPNIAWEDTIIYEAHVKGLTQKRDDVPPNLRGTYGGLSSPAMIEHLKKLGVTTIELLPIHSFVDDRILVEKKLANYWGYNTLSFFAPEPRYAQDNALDSFRTTVARLHDAGIEVMLDVVYNHTAEGNHLGPTLCYRGIDNASYYWLNRENPRYYDDFTGCGSSVNLTHPRVLQMVMDSLRYWVEVCHVDGFRFDLATTLARGPNGFDRGSSLLTAIRQDPVLAAVKLVAEPWDLGLGGYQVGAFPSQWSEWNDRYRSAMRRYWSGEGSLIGDISSRMTASSDLFNHDGRRPRASINHITVHDGFTLADLFSYNEKHNEANGEDNRDGSNDNHSNNCGVEGPTDDPGILGLRRQLRKNVLACLMLAQGVPLLLAGDEVGNSQSGNNNAYCQDNEVGWVGWGNLGKDGDDMVDFVAGLADIRRRFSQLRSHRWLDGRPKDGLSYGALWLTPAGEEMTENDWKFPEGRFLSYVMGPMEPGGAAIFIVLNAAPEEIAFKLPKMTEYKSWQQILNTTDAKLNTIDFQPGSDSKAPPRSVLAFAGAL

SEQ ID NO: 7077 - protein, 184 aa, Blastopirellula marina
MMRVLFSGGVFAAVFALASFASAADTLLEGEVNSLSGEKVDLSKYKGKVVLVVNVASKCGKTPQYKPLQALYEKYHDEGLEVVGFPCNQFGGQEPGTALEIQEFCTDKYNVSFDMMEKINVNGPETAAVYKKLKSFQQDPGDVKWNFEKFLIDRDGKVVARFRTKIEPDSPEVVQAIESQLKKD

SEQ ID NO: 7078 - protein, 220 aa, Corynebacterium diphtheriae
MGWLFGAPRLVEEKDALKGGPHPVLPNPQPHAVLGTLRGQPGTETIYIGIGCYWGAEKLFWETPGVVYTSVGFAGGITPNPTYRETCTGRTNHTEIVEVVYDPTQVTFDELVVKAMEAHDPTQGYRQGNDTGTQYRSAIYTAGPNAEQQAQRAREIVEHYAPKLAAAGLGRITTEILPLASTPAGEYYMAEDEHQQYLHKNPLGYCPHHSTGVACGIPEA

SEQ ID NO: 7079 - protein, 472 aa, Prochlorococcus marinus
MSKAHFGLIGLGVMGENLVLNAERNGFSSVVYNRTYAKTEEFLKGLGSDKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVLAQWNATEELSSYLVEITEVCLRTKDPDDGSDLVEKIMDQAGQKGTGLWTVVSALELGASVPTIYASLNGRVMSSMKPQRITAEQILHGSAIKPFDLGSSADGMAPLMDAVVLSCMASYAQGMELLRIASAEYNYNLHLPSIAQIWKGGCIIRSRLLKRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 7080 - protein, 179 aa, Blastopirellula marina
MAEATFGGGCFWCTEAIFQRLDGVTYVEPGYSGGKTANPTYEAVCRGTTGHAEVIRIEFDPAVVDYESLLEIFFQTHDPTTLNRQGADVGTQYRSVIFYHDAAQKEAAEQFLQQLDAAQAYPSPIVTEISPLTNYFTAENYHQNYFDSHPNQSYCAAVIAPKVDKFRRKFAAKLKEGGA

SEQ ID NO: 7081 - protein, 431 aa, Prochlorococcus marinus
MKRVLAIILGGGAGTRLYPLTKMRAKPAVPLAGKYRLIDIPISNCINSSINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESARNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGQGTTVKGAILDKNTRIGNNVTIVNKDHVEEADRADEGFYIRNGIVVVVKNATISDGTVI

SEQ ID NO: 7082 - protein, 633 aa, Bacillus licheniformis
MSIASFSEKTRAASAEEYPHNYAELLQKSLLFYEAQRSGRLPENSRLNWRGDSGLEDGKDVGLDLTGGWYDAGDHVKFGLPMAYSAAILSWSVYEYRDAYKESGQLDAALDNIKWATDYFLKAHTAPYELWGQVGNGALDHAWWGPAEVMPMKRPAYKIDAGCPGSDLAGGTAAALASASIIFKPTDSSYSEKLLAHAKQLYDFADRYRGKYSDCITDAQQYYNSWSGYKDELTWGAVWLYLATEEQQYLDKALASVSDWGDPANWPYRWTLSWDDVTYGAQLLLARLTNDSRFVKSVERNLDYWSTGYSHNGSIERITYTPGGLAWLEQWGSLRYASNAAFLAFVYSDWVDTEKAKRYRDFAVRQTEYMLGDNPQQRSFVVGYGKNPPKHPHHRTAHGSWANQMNVPENHRHTLYGALVGGPGRDDSYRDDITDYASNEVAIDYNAAFTGNVAKMFQLFGKGHVPLPDFPEKETPEDEYFAEASINSSGNSYTEIRAQLNNRSGWPAKKTDQLSFRYYVDLTEAVEAGYSAEDIKVTAGYNEGASVSELKPHDASKHIYYTEVSFSGVLIYPGGQSAHKKEVQFRLSAPDGTSFWNPENDHSYQGLSHALLKTRYIPVYDDGRLVFGHEPGY

SEQ ID NO: 7083 - protein, 934 aa, Campylobacter jejuni
  misc_feature (181)..(181): Xaa can be any naturally occurring amino acid
MSSVGENIKLTRRSFLKMAALSSLATPLLARSETLREASADELKEAYEGSKKVKTVCTACSVGCGIIAEVQNGVWVRQEIAQDHPVSSGGHCCKGSDMIDMVRSHVRLKYPMKKENGEWKRISYEQALSEIGEKLAAYRKENPESVMFLGSAKLNNEQAYYIRKFAAFFGTNNVDHQARIXHSATVAGVANTFGYGAMTNHLGDIQRSKCIIIIGANPAVNHPVGFRHFLKAKEKGAKLIVVDPRFTKSAAKADIYARIRPGTDIAFMYGMLKIIFDEGLEDTKYLDERVFGIDKIREEAAKWTVEEVENVTGISKELLVQITHEVAKNKPTTLIWAMGLTQHTVGTSNTRLAPIVQMVLGNIGKFGGGVNILRGHDNVQGASDMACLSENLPGYYPLNEATWRYYAKIWGVDYEWLLGNFVSKDWMHKTGLSLARWWAAALNGKDGNDAIDNAGTPLKALVVMGNGITSTAQQVKVKEGLEALELLVLADPFVNEAGIIAERKDGIYLLPAATQFETSGSVTATNRSGQWRFKVVDPLYESMEDQEILFELAKKLGFYEDFTKTLRDEKGEIVWPENATREIAKAVRSIGLNGWSPERLKKHTLYWDKFDEVTLEGKDEVAGEYYGLPWPCWSDKHPGSPVLYNTDIEVAKGGMGFRNNFGLEYEGESLLAKNAPLNSPIDTGYPQITKDNIEKVLGITLSAQEKEKMGSTWSYDDSNIIATKCIEKGIVPYGNAKARAVVWTFKDKIPLHREPLHSPRNDLVQKYPSFEDQKALYRVDTKFVSVQQAKDYSKEFPLNLVTARLVNLNGAGMENRASMYLTRLTPEMFCEINPELAKEQDIKAGDMIWVHSPEGTKIHVRVKVNPGVAKDMIFLPFHFTGVMQGVDLTHNFPEGTKPYASGESANTVTNYGYDIMCQIPETKGGLCRISKDGK

SEQ ID NO: 7084 - protein, 432 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKIRRSLTCCWLLTSSKLPMTTSRRCAMSSLMRYRTVSRFRPSPLRLPIMTATAPLFCLRT

SEQ ID NO: 7085 - protein, 156 aa, Mesembryanthemum crystallinum
MAASLTLMTSPPCSRSSKSPSPSPSPSLSCNQQQQYKPLLHHQWPPQISLKKEKSNESIVAKSPVIAAATKGGSPSVQEQKWIHEGVITESLPNGMFWVKLDNCEDLVLGYISGRIRRSFIRVLPGDRVKIEVSRYDSTRGRITYRLRNNKDATTT

SEQ ID NO: 7086 - protein, 704 aa, Oryza sativa
MDASAGSSAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 7087 - protein, 156 aa, Solanum lycopersicum
MASLSWWNPAPATAAMAACSPTPTSCKTSNSLALPRSVFVSKQEELMKQAKSLLVKTQQQSKKKKNNSTNSRRTTSIQCLSQEQKWTHEGSITESLPNGMFRVKLDNADVVLGYISGKIRKNFIRLLPGDRVKIEVSRYDSSKGRIIYRLRGGREG

SEQ ID NO: 7088 - protein, 398 aa, Desulfotalea psychrophila
MGTQKEKKSVFALLKSNSIGGILLMLATALALIMANSPGHYLYSMLITTPVEVRFGPLEIAKPLLLWINDGLMAGFFFLVGLELKREIFEGGLSQRSNIILPAIGALGGMVVPSCIYLAFNYQDPVALRGWAIPAATDIAFALGILSLLGSRVPTSLKILLTTLAIFDDIGAILIIACFYTNDIYLPGLLIALLCMLILFIVNRCKVERTTVYIFIGSIMWIAMLKSGVHATLAGVILAMFIPMYSRKHPGQSPLKNLEHDLQGTATFIILPIFAFANSGINLTNISMDFFTHAVPMGIALGLFIGKPLGIISFLWVGVQLRLTKLPVDLNWSTVTGMSALAGIGFTMSLFVGSLAFDQAITGLIFDERLGIIMGSLFSGLLGYLLLNKTLPGDKHEM

SEQ ID NO: 7089 - protein, 599 aa, Streptococcus suis
MLYPIQTKTRSVYSLNGIWKFKQGNNDVHTLLDTDEVMVVPSSFNDLVVDKDKRRFVGDNWYELMVALPVVSADEELVVRFGSVTHQAKVYADGQLIGEHKGGFTPFECLIPSNLYDADQFRLTVCANNELNYTTLPVGNYSEEVDENGQIVKTVKENFDFFNYAGIQRTVHLYKRPQNRIEDIVIRTELNQDLTQAVVNVDVKTVGQYDSIRMSILDQEGQEVGLLENGQMVIEHPRLWEVLDAYLYTAKVELFDGENLLDTYSEQFGIRSVAVENGQFFINGKPFYFKGFGKHEDTFINGRGFNEAANLMDLNLLKDIGANSFRTSHYPYSEEMMRLADRLGIVVLDEVPAVGLFQLFNAALNLTGDSEEVKSTWEVMQTKDAHELVIDELIARDKNHPSVVMWVVANEPAGHEKGARAYFEPLIQRMRDRDPSKRPVTLVNIMTATPDKDEVMDLVDVVCLNRYYGWYVAHGDLKAAEKGLRQELETWQKLYPDKPILITEYGADTLQGLHSMWDIPYTEEFQVDYYDMNHRVFDSIPNLVGEQVWNFADFETTVGIIRIQGNHKGLFSRNRQPKQIVREIKKRWTAIPNYHYKRK

SEQ ID NO: 7090 - protein, 199 aa, Desulfotalea psychrophila
MVVIEKNRKSAISRKTTETDIQLELNLDGAGQHLIDTGVPFLNHMLTLFSVHGFLDLSLRAEGDIDIDDHHTTEDIGIVLGQAIAQALGNKGGISRYASVYLPMDEALVRIVIDLSNRPYLHYNAPVIEQKLGTFDSCLVKEFFRAVSQQAGMTLHIDMIHGENGHHIVEAIFKGFGRALSLAIEPLGTDGALSSKGCL

SEQ ID NO: 7091 - protein, 552 aa, Sarcina ventriculi
MKITIAEYLLKRLKEVNVEHMFGVPGDYNLGFLDYVEDSKDIEWVGSCNELNAGYAADGYARLRGFGVILTTYGVGSLSAINATTGSFAENVPVLHISGVPSALVQQNRKLVHHSTARGEFDTFERMFREITEFQSIISEYNAAEEIDRVIESIYKYQLPGYIELPVDIVSKEIEIDEMKPLNLTMRSNEKTLEKFVNDVKEMVASSKGQHILADYEVLRAKAEKELEGFINEAKIPVNTLSIGKTAVSESNPYFAGLFSGETSSDLVKELCKASDIVLLFGVKFIDTTTAGFRYINKDVKMIEIGLTDCRIGETIYTGLYIKDVIKALTDAKIKFHNDVKVEREAVEKFVPTDAKLTQDRYFKQMEAFLKPNDVLVGETGTSYSGACNMRFPEGSSFVGQGSWMSIGYATPAVLGTHLADKSRRNILLSGDGSFQLTVQEVSTMIRQKLNTVLFVVNNDGYTIERLIHGPEREYNHIQMWQYAELVKTLATERDIQPTCFKVTTEKELAAAMEEINKGTEGIAFVEVVMDKMDAPKSLRQEASLFSSQNNY

SEQ ID NO: 7092 - protein, 727 aa, Physcomitrella patens
MAACTIVWFRRDLRLEDNPALIAAARAGTVVPVFVWSPAEDGQFHPGRVSRWWLKQSLTHLELSLKKLGSPLILRKSPDMLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 7093 - protein, 449 aa, Desulfotalea psychrophila
MRQRITELLVAKAEEQVVTVAGWIRTRRDTGDFSFLEVNDGSTLINMQVIADKSLGNYEEEVKKLSTGCSVMVEGVLKESPAKGQSVEVHASSVTVVGWADPETYPLQKKRHSLEFLREISHLRPRTNAISAVARVRSRLSYAVHNFFQEKGFTQVHTPIITTSDCEGAGEMFQVAATGKDGHFFGAPAGLTVSGQLQAEVYATALGDVYTFGPTFRAENSNTSRHLAEFWMIEPEMAFCDLQGDMEVAEEMLKYVLADVLEHCVTDMNLFDKFISKGIIERLQSVLAHDFARVTYTEAVDQLLASGQKFDFAVKWGIDLQSEHERYLTEQVYKRPLIVTDYPAAIKPFYMRMNEDGKTVAAMDILVPGIGELVGGSQREERYDLLAERMEAAGLDLEEYGWYLDLRKYGTVPHAGFGLGFERLVQFVTGMANIREVIPFPRTPGFAPC

SEQ ID NO: 7094 - protein, 205 aa, Banksia ilicifolia
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAEVGLPVDGNIPVIGFIGRLEEQKGSDILAEAISQFVGENVQIVILGTGKKPMEKQIEQLERKYPDKAIGIAKFNVSLAHMIIAGADFMLIPSRFEPCGLIQL

SEQ ID NO: 7095 - protein, 300 aa, Pseudomonas fluorescens
MTLQYPTIADCVGNTPLVRLQRLPGATSNTLLLKLEGNNPAGSVKDRPALSMITRAELRGQIQAGDTLIEATSGNTGIALAMAAAIKGYKMILIMPDNSSAERKAAMTAYGAELILVSQEEGMEGARDLAERMQAEGRGKVLDQFANGDNPEAHYSGTGPEIWRQTQGSITHFISSMGTTGTIMGTSRYLKEQNPAVQIVGLQPMEGSAIPGIRRWPEQYLPKIYQASRVDRIVDMAQSEAEDVTRRLAREEGIFCGVSSGGAVAAMLRLSREVENAVMVAIICDRGDRYLSTGIFDAPN

SEQ ID NO: 7096 - protein, 205 aa, Banksia cuneata
SSFDFMDGYDKPVEGRKINWMKAGILESDRVVTVSPYYAQELLSGIEKGVELDNIIRKTGITGIVNGMDVQEWNPSTDKYIGVKYDATTVFNAKPLLKEALQAEVGLPVDGNIPVIGFIGRLEEQKGSDILAEAISQFVGENVQIVILGTGKKPMEKQIEQLERKYPDKAIGIAKFNVSLAHMIIAGADFMLIPSRFEPCGLIQL

SEQ ID NO: 7097 - protein, 144 aa, Nostoc punctiforme
MRLLHTMLRVANLEESLKFYCELLGMKLLRRKDYPGGEFTLAFVGYGDESDNAVIELTYNWGVEKYELGNAYGHIALGVDDIYATCEEIRNQGGKVVREPGPMKHGSTVIAFVEDPDGYKIELIQLGSQGSAAKEESQEQLVSQ

SEQ ID NO: 7098 - protein, 179 aa, Sordaria macrospora
VLIGVGLLSLPMGIKYAGWLCGMVTLFLCAAVTIYTAKLLAKCMDLDPSLITFSDLAFISFGRNARIATSILFTLELLAACVALIVLFADSLDLLFPGFLSVTGWKIICAVIMVPLNFLPLRLLSFTSIIGIFCCFSIVLILLTDGFLKPTAPGSLIEPAKTYMFPQNWLTLPLSFGSL

SEQ ID NO: 7099 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELELSHSGMLLRGYRSLFASLLLIAAGLAGTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRQSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 7100 - protein, 267 aa, Unknown
  Nostoc sp. PCC 7120
MENFVTPPAFGEKIRERWTLAGRKALITGATKGIGLAIAQEFLALGAEVVIVARNAEAIEQQMKAWHSAGKVHGVAADVSTSEGRQMMLDYVSKTFGELDILVNNVGTNIRKKATDYTEEEFAAIFQINLTSIFELSRLFYPLLKTSKNSSIVNIGSVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 7101 - protein, 205 aa, Banksia elegans
SSFDFMDGYDKPVEGRKINWMKAGILESDRVVTVSPYYAQELLSGIEKGVELDNIIRKTGITGIVNGMDVQEWNPSTDKYIDVKYDATTVFKAKPLLKEALQAEIGLPVDGNIPVIGFIGRLEEQKGSDILAEAISQFIGENVQIVILGTGKKQLEKQIEQLERKYPDKAIGIAKFNVSLAHMIIAGADFMLIPSRFEPCGLIQL

SEQ ID NO: 7102 - protein, 1422 aa, Unknown
  Vibrio sp. Ex25
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTVFESMPKAGGWLRYGIPEYRLPKDILDKEIELMCRNGMQVETNKKLSVDFTLSQLSEDYDAVCLAVGASQAVEMKYPGSELDGCYLGVDYLKDYVTEQNYVTGKKVAVIGGGNTAIDCARTARRAGADTTLIYRRTRDEMPAEDYEIVEAEHEGVKFHFLTNPAENIADENGRVKAIRLERMALGEPDASGRRSPKPTGEFFTEAFDTVIAAVSQKPDLSFLENDELSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGASCSGLTLMGNSNCVQCGACVQACPTGAMVDSRDRSQGRTEQLKAVDTICTYCGVGCKLTMFVDERQNKIRYVKGADSPVNQGMLCVKGRFGFDFISSEERLTTPLIRKDGWLQPASWDEAIQLVASKLSTIKQDFGNNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHADLYLAHRPGTDVMLLNGVMQQIIKNGWYDQEYIEERVDGFDTLLQEVMSPAYNLDKVELVTGIKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGSIEIDAFVTKRMQKGVVFIPFHFVESPVNRLTTTATDPHAKIPEFKVAAVKIEISETAAQPEPVEEAVHHL

SEQ ID NO: 7103 - protein, 517 aa, Lolium rigidum
MDKAYIAILSSAFLFLVHYVLGKVSDGRRGKKGAVQLPPSPPAVPFLGHLHLVEKPIHATMCRLAARLGPVFSLRLGSRRAVVVSSSECARECFTEHDVTFANRPKFPSQLLVSFNGTALVTSSYGPHWRNLRRVATVQLLSAHRVTCMSGVIAAEVRAMARRLFHAAEASPDGAARVQLKRRLFELSLSVLMETIAQTKATRSEADADTDMSLEAQEFKEVVDKLIPHLGAANMWDYLPVMRWFDVFGVRSKILHAVSRRDAFLRRLINAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFKPERFEDGKAEGLFMIPFGMGRRRCPGETLALRTIGMVLATLVQCFDWEPVDGVKVDMTEGGGFTIPKAVPLEAVCRPRVVMRDVLQNL

SEQ ID NO: 7104 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHATEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 7105 - protein, 395 aa, Arabidopsis thaliana
MSSPERKRKRVTSTKNPSVKKKKKISPVPTPIPSLPDDLLVSIFARVSRLYYPILSLVSKSFRSLLRSPELYETRSLLGRTESCLYLCLQEGNPDPNPLWFTLCMKPDRTLKNGKKKKKKKMSSGNLLIPIPVPNPPLEHWSGHASVGSDIYFFGGYMEENVRSSRVVILDCRSHTLREAPSLQMERSDPAASVIDGKIYVAGGVDGDDADSLYPIEVFDIKTQIWDHRPIPYWEKDWGALSRSAYVDGKFYLTIGMKVMAYDLEESRWDFAGYQMGQSWFWSCNCVIENVLYCYGDAFRWFDTKLRLWKVMKVKGLPKLSRNVDVKIADYGGKMAIFWDNPSPSASDTNKIIRCAVIALERPNSEEIWGTVEWHEAVLTVPVSYEFEHALAVTV

SEQ ID NO: 7106 - protein, 674 aa, Hordeum vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 7107 - protein, 165 aa, Anabaena variabilis
MKMELKSGSTETPMEKATFGAGCFWGVEAAFRQVKGVVSTSVGYMGGHFPNPCYLDVLSRITGHAEVVQIEYDPQLVSYEDLLAVFWDIHDPTTLNRQGPDKGEQYRSVIFFHNEQQAEAARQSKAKLQVSGRFERDIVTEIKHKSEYYLATEEHQQYFEKQAKR

SEQ ID NO: 7108 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLVFRPERFEDGKAEGLFMIPFGMGRRRCPGETLALRTIGMVLATLVQCFDWEPVDGVNVDMTEGGGFTIPKAVPLEAVCRPRAVMRDVLQSI

SEQ ID NO: 7109 - protein, 321 aa, Bacillus cereus
MAVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSGRFSKPIATKILPAATFYPAEEYHQGYHKKNEFRYELYRKGSGRDAFIKQHWPKDNAHLKEKLNEMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 7110 - protein, 746 aa, Unknown
  Cyanothece sp. PCC 8801
MTNSAKTLCPYCGVGCGLEVLPPAQPGKPTNRDSQGTPIWQVRGDRSHPSSQGKVCVKGATVSESLDKNRLKYPMMRDSLDESFRRVSWDEALEAIVHRIQTVLQTQGPDGLSMYGSGQFQTEDYYIAQKLFKGFLGTNNFDANSRLCMSSAVAGYTQSFGSDGPPCCYEDLELTDCAFLIGTNTAECHPIVFNRLRQHHKQNRKVKMVVVDPRRTKTAEVADLHLAIKPGTDIDLFNGIAHLLMRWGTIDTYFIDECTQNFPAYAEVISHYPPELVARNCEIRLDDLETAAKYWAKSERVLSLWSMGMNQSSEGTAKVRTLINLHLMTRNIGKPGAGPFSLTGQPNAMGGREAGGLANILPGYRVITNPQHCAEMEQFWGRPPGSIRPQRGLTGVEMMRALETGDIGFLWIAATNPAVSMPDVKRTQEALRRSPFTVYQDAYYPTETSEYAHILLPAAQWSEKTGVMTNSERVVTLCPEFRDPPGEARPDWAVLAEVGRRLGFVEAFRFNSSAEVFAEFVQCTEGRPCDYSGLSHDRLRQQGPLQWPYPYQWPSPEGEEEKEQNRTNKRLYTDLRFNTPDGRARFAAYHSKGLAEPPDTDYPFILTTGRLYGHWHTQTRTGHIPKIRKMHPTPFIEIHPRDAARFKIEENSLVEVRSRRGVARFPAMITEAIAPGTVFVPMHWGALWADDAEANALTHPIACPSSLQPELKACAVQLEKVTIPTGSLHGEPSELDLKRNQALTRK

SEQ ID NO: 7111 - protein, 444 aa, Prochlorococcus marinus
MNEENGKDNKSFEYETNNLIRSNFNEKESVKELENIAPKPSNQLTNGLLGWYSVSSSESIKEGKLNHFTIYNEPLVLYRDREGIVRCVKDVCPHRGASFLGGEVINGQLVCPYHGARFSSQGSCTNLDRITCQHIIDSNYDNYAKSIKLFQYPCVEKEGYIYIYYTGTPLANIEDFQIKSSINSLLPDSYGFPSLEYEYEEVYVDFKADWARIIENHLDILHVFWMHGDTIPDKNVNRETITSFNQKIKRDNRQIESIYSYKTNGQEEFIRIKFVPPGRIFIYKGSPESTRYIQVLDHIPLGNNKARVIVRHYRKFLKNKFFTNLVLFSHLQRRTFYKIFTEDYLVLKTQTFNDQMGYIQKDNVKLLGEDKMVQYYWDWLQNALNKEKPWDLHPTNSLTNSVHEDRGMQYPPENPNMAIKNNRKIIIKLLTRLLFPISFILLLI

SEQ ID NO: 7112 - protein, 74 aa, Streptomyces avermitilis
MTKNKNVIEVEGKVVECLRSAMFTVELENGHQVLAHISGKIRKNYIKIMLEDRVLVELPPYDLTRGRIVFRYRN

SEQ ID NO: 7113 - protein, 617 aa, Medicago truncatula
MLLSYQKHTLYLPHSSIHTPKNPKLTTIVNCQNPNEQHQNQPIPRRHNAKSTSFLIHHLTQKNTNTNPSPTSLQDPTPHEEKIKLLELSLVRKRTPQFPGSIYAQSPSDPDVGSSLPPLSTLFRRDEKEEEMIMQAIEIRRKVTEEVFKEAMRKGKFGITYTGNLVDRLGDFIDYVMIEAANLKRLPEYSNSTFNLRAKTVIEDSQVVPLIRWLKHNSLSYPQIAKLILMSRGKLESIRNRVEWLKSVLVKGEFIGDAMLKSGDNVLLRSDGELDEIVDYLEFNGVRREWMGYVVSRCPKLLFYSLEEVKTRVQFYLDMGLDAKDFGTMVFDFPKALGHYTLEEMNRKVDYLKEFGLESKDVGKLLAFRPQLMACSIEEQWKPLVKYLYYYGITRDGMRRMLTIKPMVFCVDLEMTIVPKVKFFQDLGVRNDGIAKMLVKFPTLLTYSLYKKIRPVVIFLMTKAGVTEENIPKVIALGPELLGCSIVHKLEGNVKYYLSLGIRLQQLGEMIADFPMLLRYKIDVFRPKYTYLRKTMVRTLKDAIEFPRFFSYSLEGRIIPRHKVLVENQINVKLKCMLACTDEEFNNMVKNMIRKRHKLQSTVMKEDTKHPQSTAQT

SEQ ID NO: 7114 - protein, 151 aa, Zea mays
MAPKAGKKPAEKKPAAAEKPVEEEKVAEKAPAEKKPKAGKKLPKEAIGATDKKKKRSKKNIETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 7115 - protein, 887 aa, Desulfotalea psychrophila
  misc_feature (346)..(346): Xaa can be any naturally occurring amino acid
MKKVTLTINGRSVTAPEGSYVLQAALQKGIYIPHLCYHNDLEPVGACRLCTVRVNGRWDALSCKTPVEEGMVIETETETIAKTRKIAIELLIADHDMDCLACARNTTCKLQQAADYIGVNKKHLARLKKPEVLLPIDDSNPFFDFDPNRCVLCGICIRTCDELQNINAIDFAYRGLTTKVAGFGDKARILSNCESCGECVARCPVGALTEKDYVKPSHWVKTVCAYCGCGCGLDLGVRDNKIVSARGEHGNPANRGRLCVKGRFGFNYVNSKERLTTPMVRRPEGFVPVSWDEALDLIADNFAKNKGDSFAAVSSAKCTNEENYLLQKFTRTVMKTNNIDHCARLXHAPTVAGLATAFGSGAMTNSIAEIGDAQVILAIGTNTTAAHPIIALQIKDAVRRGAKLIVINPKRIDLCKHAHIFLQNTPGSDIPLLMTMMRIIVEEDLIDKEFIEERCENYPAFLASLQQFELEDVAELTGIPAETIREAALCYATESPATILYCMGITQHVHGTDNVLATSNLALLTGNVGKESTGVNPLRGQNNVQGSCDMGALPDVYPGYQKVVNNTAAFEEKWQTSLSAVPGKTHTEIFDGLYDGSIKSVYLIGENPVLSEANASHAIEAMNRAKFLVVQDIFFSETAELADVILPASSFAEKDGTFTNTERRVQRVRQAIEPVGDSRPDWWIIKEIATRMGAKGFDHEGPEQIMEEISATIPNYAGINYDRLQHGTLQWPCPSTDHPGTKFLHAERFATANGRARFMPLKTRKTTEQVDKKYPLLLNTDRSLFHFHGTMTRRVFGLNVLDRGENLIIHPEDAEKFSLTDGEIVEVRSRRGAVKVAVEINDSCRPGSVSMSFHFSETPTNMLTSGALDPVAKTPGTKICAVQINKL

SEQ ID NO: 7116 - protein, 441 aa, Arabidopsis thaliana
MASNYVFSVLRSLLLLIHTVFLGQHHVSSATIIKSLPGFEGPLPFELETGYIGVGEEEEVQLFYYFIKSERNPKEDPLLLWLSGGPGCSSISGLLFENGPLAMKLDVYNGTLPSLVSTTYSWTKASSMIFLDQPVGAGFSYSRTQLLNKPSDSGEAKRIHEFLQKWLGKHQEFSSNPFYVGGDSYSGMVVPATVQEISKGNYECCNPPINLQGYVLGNPLTDFVYDYNSRIPFAHGMALISDELFESLKKTCKGDYRNVHPRNTECLKFIEEFNKCTNSICQRRIIDPFCETETPNCYIYRFLLAAYWANDETVRKALQIKKETIGEWVRCHYGIPYNYDIKSSIPYHMNNSINGYRSLIYSGDHDFEVPFLGTQAWIRSLNYSVIDDWRPWMIKDQIAGYTRTYANKMTFATIRGGGHTIEFKPEEASIMFQRWIKGQPL

SEQ ID NO: 7117 - protein, 884 aa, Glycine max
QRPYPGLHNGVVRPLKPGPDIPRPKKLPQAPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHEEILPINSWTTQMPYFIRGYAYSGGGRKVTRVEVTLDGGETWQVCTLDCPEKPNKYGKYWCWCLWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPTGGIMSQHLDSLPIGSVLDVKGPLGHIVYTGRGNFLVHGKPRFATRLAMLAGGTGITPIYQVVRAILKDPEDCTEMHVVYANRTEDDILLKEELDEWAKKYDRLKVWYVIQASIREGWEYSVGFITESILTEHIPNASPDTLALTCGPPPMIQFAVQPNLEKLGYDTQNNLLVF

SEQ ID NO: 7118 - protein, 205 aa, Banksia lindleyana
SSFDFMDGYDKPVEGRKINWMKAGILESDRVVTVSPFYAQELLSGIEKGVELDNIIRKTGITGIVNGMDVQEWNPSTDKYIDVKYDATTLFNAKPILKEALQAAVGLPVDGKIPVIGFIGRLEEQKGSDILAEAISQFIGENVQIVILGTGKKPLEEQIEQLEIKYPDKAIGIAKFNVSLAHTIIAGADFMLIPSRFEPCGLIQL

SEQ ID NO: 7119 - protein, 329 aa, Arabidopsis thaliana
MALSMEFGFSIGSCFKAPNPPVLISASPNKINFTLRRRNKRFLLRVSAVSYKEFAESALEETRKRIVLEPSHLQEKYSSMTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 7120 - protein, 277 aa, Brassica oleracea
MGKEDLSLSLSLGFAQTHHPLKLNLNPTSSSISNLQMFPWNQTFVSSSDHQNQQFFTKIDVNSLPSTVHLEEETGFSSPNSTISSTVSGKRRSEREGTSGGAGDDLDVTLDRSSSRGTSDEEEEHGGEACRKKLRLSKDQSAVLEDTFKEHNTLNPKQKLALAKKLGLTARQVEVWFQNRRARTKLKQTEVDCEYLKRCVEKLTEENRRLEKEAVELRALKLSPRLYGHMSPPTTLLMCPSCERVAGPSNHNQRSVSLSPWLQMAHGSTFDVVHPRS

SEQ ID NO: 7121 - protein, 133 aa, Arabidopsis thaliana
SPPPPPESSKMAKYNEIAKKKREAKADRKRAIHGDPLTNKLKTRTPVPSVSGKRQRKLLRKWRREQKDMVEKGLVTMEDVEMASAQAASEDSKKSPRKFSVKKSLKLNKLNNKGKKKKNQKASGEKSADCMLE

SEQ ID NO: 7122 - protein, 203 aa, Mycobacterium leprae
MLVAQSFSAINPGPTAELYLGDIKSVMLTQEQIQARIAELGAQIGHDYRDRSPASDQDLLLVTVLKGAVIFVTDLARAIPLPTQFEFMAVSSYGSSMSSSGVVRILKDLDRDIHDRNVLIVEDVVDSGLTLSWLLRNLATRRPQSLQVCTLLRKPDALRANVDITYVGFDIPNDFVVGYGLDYDERYRDLPYIGMLDPRVYQQ

SEQ ID NO: 7123 - protein, 205 aa, Banksia serrata
SSFDFMDGYDKPVEGRKINWMKAGILESDRVVTVSPYYAQELLSGIEKGVELDNIIRKTGITGIVNGMDVQEWNPSTDKYIDVKYDTTTVFNAKPILKEALQAAVGLPVDGNIPVIGFIGRLEEQKGSDILAEAISQFIGENVQIVILGTGKKPLEKQIEQLEKKYPDKAIGIAKFNVSLAHMIIAGADFMLIPSRFEPCGLIQL

SEQ ID NO: 7124 - protein, 205 aa, Banksia aemula
SSFDFMDGYDKPVEGRKINWMKAGILESDRVVTVSPYYAQELLSGIEKGVELDNIIRKTGITGIVNGMDVQEWNPSTDKYIDVKYDATTVFNAKPILKEALQAAVGLPVDGNIPVIGFIGRLEEQKGSDILAEAISQFIGENVQIVILGTGKMPLEKQIEQLEIKYPDKAIGIAKFNVSLAHMIVAGADFMLIPSRFEPCGLIQL

SEQ ID NO: 7125 - protein, 205 aa, Banksia sceptrum
SSFDFMDGYDKPVEGRKINWMKAGILESDRVVTVSPFYAQELLSGIEKGVELDNIIRKTGITGIVNGMDVQEWNPSTDKYIDVKYDATTVFNAKPILKEALQAAVGLPVDGNIPVIGFIGRLEEQKGSDILAEAISQFIGENVQIVILGTGKKPLEEQIEQLEIKYPDKAIGIAKFNISLAHMIIAGADFMLIPSRFEPCGLIQL

SEQ ID NO: 7126 - protein, 252 aa, Vibrio vulnificus
MTLTSLSSLQNQGFVSLVGAGPGDPDLLTVKGYRVIQQAEVVVYDRLVSPEILALANEKAEMIYVGKKLDFHCVPQEEINQILVRKALEGKRVVRLKGGDSFIFGRGGEELEELAEHDVRFEVVPGITAAAGATAYAGIPLTHRDHAQSVQFITGHIQKDGKEIEWPSLAQANNTLVFYMGLKQCRYIAEKLLENGLDASTSCAIIENGTRREQRVLTGTLTQLPELATQAISPALIVVGSVTSLHDKLKWF

SEQ ID NO: 7127 - protein, 136 aa, Ustilago maydis
MARTKQTARKSTGGKAPRKQLATKAARKSAPAAGGVKKPHRYKPGTVALREIRRYQKSTELLIRKLPFQRLVREIAQDFKTDLRFQSSAIGALQEAAEAYLVSLFEDTNLAAIHAKRVTIQPKDIALARRLRGERS

SEQ ID NO: 7128 - protein, 378 aa, Unknown
  Synechococcus sp. CC9605
MADFYDLLGVSRDVDPDSLKRAYRRMARQYHPDINKDPGAEDRFKEIGRAYEVLSDPQTRARYDQFGEAGLGGAAGAPDMGDMGGFADLFETFFQGFGGPGGAGAGRPRRQGPQQGDDLRYDLTIDFEQAVFGQEQEIKIPHLETCDTCGGSGAKAGSAPTTCGTCGGAGQVRRATRTPFGSFTQVAECPNCGGTGQVISDPCGSCGGQGVKQVRKKLRINIPAGVDTGTRLRVTGEGNAGPRGGPSGDLYVFLTVRNHPRLQRDGLNIFSEVKVSYLQAILGDTIEVETVDGSKELDIPAGTQPGTVLTLPNLGIPKLGNPVARGDQRVTVTVDLPKRISDLERELLEQLAGHHSARGKQHHHHNSGLFARLFGQKG

SEQ ID NO: 7129 - protein, 239 aa, Prochlorococcus marinus
MAVVTLSEMMEAGAHFGHQTRRWNPKMSRYIYCARNGVHIIDLVQTAICMNNAYKWTRSSARSGKRFLFVGTKKQASEVVALEATRCGASYVNQRWLGGMLTNWTTMKARIDRLKDLERMESSGAIAMRPKKEASVLRRELERLQKYLGGLKGMRRLPDVVVLVDQRRETNAVLEARKLDIPLVSMLDTNCDPDLCEVPIPCNDDAVRSVQLVLGRLADAINEGRHGTNDQRGADDSDD

SEQ ID NO: 7130 - protein, 406 aa, Campylobacter jejuni
MLNNTLFFKQSEIHTISSYANRINDEVKSGDIGYYHLIDTSLNLIDESLQFIQDKEYVKNIVLVGMGGSSCGVKALRDMLFNEKSNQRELFILDNTSSHSFNKTLEKIKLEESLFLIISKTGSTIEVVSLFKLLIEHFKLDMQELKKYFVFITDKDSKLHQEGENLGIKCFFIPANVGGRFSILSAVGIVPLCFCGYNAKALLEGAKACFEDFFTHKKDEILQKAYHYCTHKNANINVLFSYSDAFKGFNEWYIQLIAESLGKKQGYKRIGLTPIALIGARDQHSFLQLIMDGPKNKTVTFLKIKDAQKAPIIPDIHFKFLDSLSNKVNLHELLNAQCDATMHALIAENLSVDVIELEKLDAWHAGYLMYYYELFTSTCGVMLGINTYDQPGVEVGKLILKNILNS

SEQ ID NO: 7131 - protein, 131 aa, Yersinia intermedia
MRKTGDIDRVMSARQLPNKALALILAGGRGSRLKDLTSVRAKPAVHFGGKYRIIDFALSNCLNSGIRRIGVITQYQSHTLVQHIQHGWSFLSEEMNEFVDLLPAHSAQGQNHWYTGTADAVFQDLDIIRRR

SEQ ID NO: 7132 - protein, 555 aa, Triticum aestivum
  misc_feature (247)..(247): Xaa can be any naturally occurring amino acid
NSFHKKAGWYRSLTPGISSTHASALQPLPRGGAPPGGRPPPPPTMAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVSIFFETMPYRLDESTGLXIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVADFFDSAVNLALKVKAAAAGTKLKDFVATLQSDSNIQAEIAKLRHDVEEYAKQFPTIGFEKETMKYKN

SEQ ID NO: 7133 - protein, 559 aa, Yarrowia lipolytica
MSYTPSENSVTKPEHDDLHNDVKGYTHDQEHATTDFSDGPAAEIADDGVKRGLKTRHLSMMALAGIIGPGLLIGSGGALTSGGPASLIIGFGCIGIIAFSIMQSLGEMTTLYPTGGAFTKLGDRFVDEAAGAAVGWNYFIIWACVLSNEYNALTSILYFWSEKVPIWGYFLLFWFFFLGFQLLGVEIFGEAEFWLGLIKIVGLVAFFIFAIVYAAGGVGRLDNGDGTTRALGFHYWHDPGAFPNGFRGVAQVFVFCSTFYAGVESVAVAATETRNPSVAVPRAIRQVFWRIIFVYLGSAFFFGLVCSSKATQLVSADAKALQSPMTVAIQTAGWHGGVHLINAFILVTCLSAVNSSIYIGSRTVLFMAKDKKAPKFLAYTNKRGVPVFAIIFTNAFAALSLMNISTGAGKAYGYIVNLSGVSTFLVWGSISFIHLRFRAGWAAQGYSPEDLPYRAMFFPYNAWFGLVANVFLALVQGWTTLSPFDAGNFVDAYILLPLFFVIFFLYKIIYKTRWVRANEMDVISGRRKDLDTKVDEEQMIDGVMTPKKKTVWKKVCENF

SEQ ID NO: 7134 - protein, 679 aa, Orobanche minor
MGTSGGGCSIVWFRRDLRVEDNPALAAGVRAGAVLPLFIWAPEEEGHYYPGRVSRWWLKQSLSHLDISLRSLGTSLVTRRSTDSVSSLLEVIKLTGAKQIFFNHLYDPISLVRDHRAKEVLTAEGVAVRSFNADLLYEPWEVHDQEGQPFTTFAGFWERCLSMPYDPEAPLLPPKRIISGDLSRCTSDTLVFEDESEKGSNALLARAWSPGWSNADKALTVFTNGPLLEYSKNRRKADSATTSFLSPHLHFGEVSVRKIFHLARIKQVLWANEGNKAGEESINLFLKSIGLREYSRYMSFNHPYSHERPLLGHLKYFPWVIDEGYFKAWRQGRTGYPLVDAGMRELWATGWLHDRIRVVVSSFFVKVLQLPWRWGMKYFWDTLLDADLESDALGWQYISGSLPDGCELDRIDNPQFDGYKCDPNGEYVRRWLPELARLPTEWIHHPWNTPESVLQAAGIELGSNYPLPIVGIDTAKARLQEALSQMWQHETASRAAIENGVEEGLGESSEFTPIAFPPNTQIDMDNEPVRNNPINAITRRYEDQMVPTMTSSLIRVVDEETSIGLDISDNDGRAEVPSNIVNFMEEPRGGPHDDNGVIVDGNDNNGFLQYEFLRGRRHSEDSTAESSSSGRRERDGGVVPVWSPSNSTYPNQFPGEDSGIGTSSSFLPRHPQSASLTSW

SEQ ID NO: 7135 - protein, 322 aa, Prochlorococcus marinus
MPIANDITYLVGQTPLVKLNRLPNEFNCRAEIIAKLESFNPTASVKDRIAGAMVKSAEKEGTIKPGHTVLVEPTSGNTGIALAMVAAAKGYRLILTMPDTMSTERRSMLRAFGAELQLTPGQDGIQGAIQLAKELVASVPNAYLLQQFDNLSNPEIHEKTTAEEIWEDCEGKLDALIAGVGTGGTITGCARFLKQKNPKIKVFAVEPSSSPVLSGGNPGSHAIQGIGAGFIPNVLDMNQIDEVIRINDNEAMDIGRRLAKEEGLLSGVSSGAAVAAALKVGNQPEFANKRLIVILPSFGERYLSTTMFTSIPAKPVKGNEFL

SEQ ID NO: 7136 - protein, 107 aa, Glycine max
  misc_feature (37)..(37): Xaa can be any naturally occurring amino acid
  misc_feature (49)..(49): Xaa can be any naturally occurring amino acid
  misc_feature (70)..(70): Xaa can be any naturally occurring amino acid
  misc_feature (80)..(80): Xaa can be any naturally occurring amino acid
YIFNNNKPYPKSHFYHFIPYPNIIIYYLSINNNVVNXFPFYIHLIYFKXENFSKYSLQSSPISFNKYISXFLEIILFTFXIIFHPFHISNINKILLYYFNNIFFTFN

SEQ ID NO: 7137 - protein, 223 aa, Anabaena variabilis
MSNIQLYFAKASTFSQRTRVALLEKGIDFTPIEIDLQNKPDGYIQISRYGKVPAIQHGDVIIYESAIINEYLEEAFPEPPLLPHDPANKAIARIWIDYANTRLVPAFNKFLRGKDHQEQEQGRKEFTEALLYLEQEGLSKGDYFLGNQFSLVDISFYPWFERLPLLEHFRKFTLPAETTHLQTWWDLVRDRSSIQAVANPVDFYLQRFAKIIGEPVAIGAGQK

SEQ ID NO: 7138 - protein, 435 aa, Flavobacteria bacterium
MLGKVKLNFWQILNMNVGFFGIQYSFGLQQSAVTPIYDFLGAAPDQIPILHLAGPVTGLLVQPIIGAMSDKTWSPKFGRRKPYFLIGALLCSVSLLLFPFSSSLWMAAGLLWILDAGNNTAMEPYRALIADKLIPEQQPTGFQMQSFFTGLGQVLANLSIFIFPIFIVGKTGSLPTWVYASFFLGAFCSIATILWSISKTKEIPPTDEELALMRNEKRSVLGPLIEIASAIKNMPKVMWQLALVYLFQWYALFCYWQNSSKSVALSVWNATPASNEAAYEEAVSWTALVNGWYNVVTFLVAFALVGFAKKYSPKLVHSVCLLLAAAGFLAFPHIADKNLLLFAITGFGIGWASMMGIPYLMVISNIPKERYGVYMGIINMMIVIPMIFQTLTFGYVLKNFLGNDPRNAITFAGVLLILATIATMFIQTKKHVVNE

SEQ ID NO: 7139 - protein, 418 aa, Fagus sylvatica
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQDHMLELLNQLDGFESIKQIKVLMRTNRIDILDQALLRPGRIDRKIEFPNPNRESRFDILKIHSRRMNLMRGIDLKKIAEKMNGASGAELKAVCTEAGMFALTAERRVRLVTQEDFEMAVAKVMKKETEKNMSLRKLWK

SEQ ID NO: 7140 - protein, 441 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYESLKRTCRGEYVNVHPHDTECLKFVEEFNKLTNRVCERHILHSCCETETPSCYSYRFMLTTYWANDETVRKALQINKESIGEWTRCYRGIPYNHDIKSSVPYHMNNSIDGYRSLIYSGDHDIQVPFLGTQAWIRSLNYSIIDDWRPWMIKDQIAGYTTSYVNKMTFATVTGGGHTAEFTPKETFMMFQRWINGQPL

SEQ ID NO: 7141 - protein, 548 aa, Erwinia carotovora
MEIFFTILILTLVVSLSGVVTRILPFQVPLPLMQIALGAILAWPQFGLHVDFNPELFMVLFIPPLLFADGWKTPTREFLRHGREIIGLALVLVLITVVGIGYFIYWMVPGMPLIAAFALAAVLSPTDAVALSGIVGEGRIPKKLMGILQGEALMNDASGLVSLKFAVAIAMGTMVFTVSGATLEFVQVALGGLLAGVGVTWIFGKSLRVISRWSGDDAATQIVLLLLLPFASYLIAEHIGVSGILAAVAAGMTIGQSGVIRSAPLTMRMRANGVWSMLEFVFNGMVFIMLGLQLPDILETSVTQAELDPTVETWMLFTDIAIIYGALLLLRFSWLWVMRTYSVHIQKKRPMVFAEFSTRELWIASFAGVRGAITLAGVLSIPLLLTDGTAFPSRYQLVFIATGVILFSLLCGVLALPFLLRGVVVADKAAHAKEIRMARMAVAEVAIKSMHKMEERLAADREENIDEQVLKEVSARVIGNLRRRLINKDDPENGLLIENLERRFRLTALNSERAELYHLRATQQISNETLQKMLRDLDLMEALLIENE

SEQ ID NO: 7142 - protein, 531 aa, Xylella fastidiosa
MFDESLKAQLKAYLDRVIRSIHIHASVDESHKSREMLDLLENIVLLSGKKVVLEVHRDDDKRKPSFGLSTPGESISIRFAGLPMGHEFASLVLGLLQVGGHPPKVADDLIERVRNLDGHYRFETYFSVSCQSCPDVVQALNMAAVLNPQIEHVAIDGALFQDEVEARQIMSVPTVYLNGELFGQGRMTLEQIVAKLDSGAAKRTAESIQAKAVFDVLVVGAGPAGVAAAVYAARKGVRTGLVAERFGGQVLDTMTIENFISVPETDGPRMAAALEQHVRQYEVDIMNLQRVETLVPAGENGFIEVRLASGASLSSRTVILSTGARWRQMNVPGEDEYRNKGVAYCPHCDGPLFKGKRVAVIGGGNSGVEAAIDLAGIASYVTLLEFDTKLRADEVLQRKLRSMSNVEVIMGAQTTEVRGDGKKVTGLVYVDRSTGGSFILALEGVFVQIGLLPNTEWLKGRVELSPRGEIVVDERGHTSLPGVFAAGDATTVPYKQIVIAMGEGSKAALSAFDYLIRNVVEITGIAQAQAA

SEQ ID NO: 7143 - protein, 71 aa, Mycoplasma mobile
MAKDAIKMTGKVIKAYNTDEYDVELENGIVVRAHISGKIRVHHITILRGDTVDVELSTYDLTKGRIVYRHR

SEQ ID NO: 7144 - protein, 473 aa, Lactococcus lactis
HMAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 7145 - protein, 181 aa, Desulfitobacterium hafniense
MEEKIGKVLLSREEIQKRVAELGEEITRDYKDQNLLVLAILKGAVPFMADLIREIRIPLKYDFMAVSSYGASTHSSGVVRILKDLERSVEDHHILIVEDIIDTGLTLKYLKENLAARNPLSIKVVTLLDKPDRRKAEVVPDYNGFTIPDEFVVGYGLDFDEHYRNLPYVGILKPEAYSSEG

SEQ ID NO: 7146 - protein, 666 aa, Chlamydia muridarum
MGSLSIHLTTPLPLGAQKLSSDRYRFSLVAPRAQQVILVLLDPFSEIHEIPLSSTDHRTGAIWHIEISGISNEWSYAYKLRQSDSAFPNFSTNAYIADPYSKNIFSPQLFGSSKQPNDYTFSYLKQEDFDWEGDTPLRLPKENYFIYEMHVRSFTQDPSSQVTHPGTFLGIIEKIDHLKKLGVNAVELLPIFEFDETIHPFKNKDFPHLCNYWGYSSINFFCPSRRYTYGTDPCAPAREFKTLVKTLHRAGIEVILDVVFNHTGFEGTSCPLPWIDLESYYMVNDNGDLLNFSGCGNTVNTNTPIAIKWILDALRYWVQEMHVDGFRFDLAAVFSRDLQGVPRSLTPILQAISSDSILSETKLIAEPWDAGGLYQLGHFPSISTRWSEWNGCYRDHVKAFLNGDPHQVSSFASRISGSRDIYPAGNSTNSINYICSHDGFTLYDSVAYNHKHNEENGENNRDGTSANYSYNFGCEGETTDPNICQLRERQMKNFFLALFLSQGIPMIKSGDEYGHTAYGNNNHWCLDTKINHFLWDRLAERKEFFSFLCQIITLRTTHAELFNTNFLSEETITWLNSQGLPREWTPDHYLAFELKHPNYSLFIAFYSGNERIEIALPKLRQEHLAYEKIVDSTTGFFSQILSPKLSLEPYSSLVAISRKKKPIEPK

SEQ ID NO: 7147 - protein, 209 aa, Unknown
  Shewanella sp. MR-7
MSGKKRTASSNRWMLEHFDDHYVKLAQKRGLRSRAAFKLEELQQKDQLIRPGMTVVDLGAAPGGWSQVAVKLAGDKGKVIACDILPMDPIVGVDFLQGDFREEKVLEALLTRVGADKVDVVLSDMAPNMSGSDGVDQPRAMYLVELALDMCHQVLAPNGSFAVKVFQGEGFDEYMKAVKEAFKVVKTRKPDSSRARSREVYLVATGYKL

SEQ ID NO: 7148 - protein, 474 aa, Lactococcus lactis
HHMAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 7149 - protein, 748 aa, Cryptococcus neoformans
MAVSQSHPNIVDGWFREINTQWPGQAMTLKVKQVLHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDPRVEVHIGDGFKFLPEHKNEYDVIITDSSDPVGPAEALFQPPYFQLLKEALKEGGSVSTQAECLWIHLPLIKTLKETCSKLFPVVKYGFTTIPTYPAGQIGIMVCTKDSTRDLTVPLRAVPDTRYYNSEVHRAAFTIPEFGRAMLEDGVNVLPKFSGARPTTTKKKVLLLGSGLVAGPAANYIARHNHELTIACRTLASAEELASGLPNATPMSVDVSSADALRQAIKGHDVVVSLIPYTHHAQVMEAALEEKVHVVTTSYVNPQMRALEQKFKDAGLICFNEIGVDPGVDHLWAVKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVISQLLGVEAKEAAIIEKLKTLKSFETESRVLISKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 7150 - protein, 205 aa, Banksia baxteri
SSFDFMDGYDKPVEGRKINWMKAGILESDRVVTVSPFYAQELLSGIEKGVELDNIIRKTGITGIVNGMDVQEWNPSTDKYIDVKYDATTVSNAKPILKEELQAAVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7151 - protein, 197 aa, Banksia speciosa
YDKPVEGRKINWMKAGILESDRVVTVSPFYAQELLSGIEKGVELDNIIRKTGITGIVNGMDVQEWNPSTDKYIDVKYDATTVCNAKPILKEALQAAVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7152 - protein, 853 aa, Vibrio vulnificus
MSKLKLVIVGNGMVGHRYIEDLVDKTDVSQYDITVFCEEPRVAYDRVHLSSYFSHHTADELSLVKTGFYEKHAIKVLLGERAININREKQTVYSSSGREIQYDKLILATGSYPFVPPIKGNESKDCFVYRTIEDLKAIEACAKKSKSGVVIGGGLLGLEAAGALKALGMETHVVEFAPKLMAEQLDQAGGDQLRQKIERMGVKVHTSKNTLEIAAEGEQARNVMRFADGTELETDFIVFSAGIRPQDKLARQMGLGIAPRGGIEINDHCQTTDSNIYAIGECASWNKMFYGLVAPGYKMATVAVDHLLGNVDSKFEGADMSAKLKLLGVKVGSIGDANGRTPGCKSYVYQNEELEVYKRLIVSADNKKLLGAVMVGDTSDYGDLLQLMLNEIELPQHPDTLILPAHAGAEKPKLGADSLPDSAVICSCFDVTKGKIAQAVADGHHTIGDIKAVTGAGTGCGGCIPLVTSVLNAELAKAGVEVKSDICEHFAYSRQELFHLIRIEEIKTFDELLAKHGKGYGCEVCKPAVGSILASCWGEHILKPQLVKLHDTNDNFLGNMQKDGTYSVIPRMAGGEVTPQALKVLAEVAAEYNLYTKVTGAQRIGLFGAQKDDLPAIWKKLIAAGYETGQAYAKALRMAKTCVGSTWCRYGVQDSVGLGVFIENRYKGIRTPHKMKFGVSGCTRECAEAQGKDLGIIATDAGWNMYVCGNGGMKPRHADLLASDLDQETLIKYIDRFMMFYIRTSAPLQRTSVWLGNMEGGVDYLRQVIVEDKLGINEQLEADIAKLVEAYRCEWNETINDEAQLTRFAHFINSDKRDENVVFVSERQQHRPATFAEKHPELKGDILHVAVTE

SEQ ID NO: 7153 - protein, 205 aa, Banksia menziesii
SSFDFMDGYDKPVEGRKINWMKAGILESDRVVTVSPFYAQELLSGIEKGVELDNIIRKTGITGIVNGMDVQEWNPSTDKYIDVKYDATTVFNAKPILKEALQAAVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7154 - protein, 333 aa, Unknown
  Candidatus Desulfococcus oleovorans Hxd3
MVWPMYREFSGGTRTAPSLSIQGACRSFIQDVDSLPPPAYDLIDLPAYWKRQSMPPIPRRRYASLFSSRGCPYKCAYCHRIFGDTFRGHSADRIVDEIAFLSKTYGISDFEFLDDIFNLDRKRLMTFCDLIHSRNLKTRLVFPNGVRTDIFTAEEIEALADAGMYFASFALETGSPRIQGLVRKNLNIGKFLKNVEIAVRCGVYANGFAMMGFPTETEAEMQMTIDVACGSRLHTISFFTVTPFPNTELYEMARRQCPEKVAAIDYADMEYSGISINLSAVSDDTLYTYQRKANRTFFLNPLRMMRIVRDFPQPHLLPFYLPVFLRRASKGLH

SEQ ID NO: 7155 - protein, 418 aa, Aeropyrum pernix
MQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 7156 - protein, 205 aa, Banksia menziesii
SSFDFMDGYDKPVEGRKINWMKAGILESDRVVTVSPFYAQELLSGIERGVELDNIIRKTGITGIVNGMDVQEWNPSTDKYIDVKYDATTVFNAKPILKEALQAAVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7157 - protein, 205 aa, Banksia baueri
SSFDFMDGYEKPVEGRKINWMKAGILESDRVVTVSPYYAQELLSGIEKGVELDNIIRKTGITGIVNGMDVQEWNPSTDKYIDVKYDATTVFNAKPLLKEALQAAVGLPVDGNIPVIGFIGRLEEQKGSDILAEAISQFIGENVQIVILGTGKKPLEKQIEQLEIKYPDKAIGIAKFNVSLAHMIIAGADFMLIPSRFEPCGLIQL

SEQ ID NO: 7158 - protein, 316 aa, Unknown
  Frankia sp. EAN1pec
MTEPGTASSSTAARAEVPDAAVDRSRLTVVVNPKAGGGRAAKVLDGVRAALARWAEDVSVETTKSLEHAEELARSAVAAGRVTVALGGDGLVGRVAGAVARSGGVLAVLPGGRGNDFARGLGIPRDPALAATALVAAVERRVDLPEANGVPFVGIASLGFDSDVQVIANRTTWLSGQSVYTYAALRGVAAWKPARFTVTIDGEPPLEHVGWTVGAANGPYYGGGMKFAPDADIADGRLEIVLVARTGRFTFLRLFPRIFSGRHVEVPYVQVRRGERLVVDADRPFQVYADGDPIADLPAEIVVRPGALRLLTPPQA

SEQ ID NO: 7159 - protein, 639 aa, Prochlorococcus marinus
MCGITGSTNLSLPCESYNNAISSIEYRGPDNTGRYLDNNIFLAHTRLSISELSKNGNQPYISKNYKGYVLVYNGEIYNIENVKNYLSKYKIKIKSKCDTELLYLMLSEFGIDKTLKLIEGIFSFAFYDKNQQKVWICRDHLGIKPLYYSLEKGLSFSSSQDGVINYLLEANDTSSIISKKGIISYLQFGYNLPNSQNNSKIKALLPGHYICHDIKHSKTMLKKWFKIIVNNKNRKVINNNTLKNTEKLIESIIKEQSVSEVEGTIFLSGGIDSTLIASNVDKNYIKKAFTIKYSDNDSNDESYIAEKVAKDCGLELLTFEFNFFNYNIDKAAERQLKITRYPFANSTLLSTDFLCQKANKEGIRMALVGDGGDELFGGYPRYKAVYLNYLLSKHNYIKGPTLAIKNTLKYSIQKNIMGFNYLINKKSYLDRRVRALLSILGSTSSFAHRKSHTYLDKDSLVNKDFNLCTDEFDAFFPLNEKPPCSSMVADLLTWIPFNLNHCSDLASMNNNIEIRVPFLDRRLLNYVFSQDISHLGIFNSKILLRKILNKKGFRYISKLPKKGFNPPLKNLVDLNLTEISEIIAETNYLLSEYIDIDVILFFLKSHKSKEKDFSRELWSVYLLAKWIRDPFKFLNYKLL

SEQ ID NO: 7160 - protein, 99 aa, Clostridium perfringens
MGYIMDLRKELPNPHRPLIMCSAGIIIIDKKGRVLLQKRTDNNKWGLPGGSLELGESFEEAAIREAYEEVGLRVKSLTLFNVYSGKECYNKYPNGDDSL

SEQ ID NO: 7161 - protein, 377 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLNRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIAYPSAPEQPPRALITVKLSQLPLRSLLWANESAIVAAGYNYSPILLQGNESGWAHTRDLDAGTSKTSFTHTGNTGEGREEEGPVSFTALRSTFRNMDLKGSSQSISSLPTVHQNMIATLRPYAGTPGNITAFTSSGTDGRVVLWTL

SEQ ID NO: 7162 - protein, 180 aa, Escherichia coli
GLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALEMCRDVLAPGGSFVVKVFQGEGFDEYLREIRSLFTKVKVRKPDSSRARSREVYIVATGRKP

SEQ ID NO: 7163 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGIHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 7164 - protein, 275 aa, Glycine max; identical to SEQ ID NO: 343

SEQ ID NO: 7165 - protein, 142 aa, Glycine max
  misc_feature (139)..(139): Xaa can be any naturally occurring amino acid
MVTSTTAAAVLSPPSVAGLRLAPSPRARVAFRAAPARRSVAARAELSPSLVISLSTGVSLFLGRFVFFNFQRENVAKQVPEQNGKTHFDAGDERAKEFSGLLKSNDPVGFNLVDVLAWGSLGHIVAYYILATSSNGYDXNFF

SEQ ID NO: 7166 - protein, 591 aa, Sinorhizobium meliloti
MCGICGEVRFDGGSPSVTAVSIMADVLAPRGPDASGVVVRGNVGLGHRRLRILDLSDKSQQPMVDSDLGLSLVFNGCIYNFRELRLELEEKGYRFFSSGDTEVILKAWHAWGEECVSRFHGMFAFVIHERDSGRVVMARDRFGIKPLYIAEVQGALRFASALPALVKAGGVDTSIDVAALHNYMTFHAVVPPPRTILNGVRKLPPATLRVYERDGSFEDRRYWDPPYRRQAGDAAISREEWQEQLLDALRIAVKRRMVADVPVGVLLSGGVDSSLIVGLLAEAGQRGLMSFSVGFEEANGEKGDEFVYSDLIAGHFGTDHRKIFVPSADLMGALPGTIAAMSEPMVSYDNVGFYLLSKEVSKHVKVVQSGQGADEVFGGYHWYPPLMNSNDVVADYGKAFRDRSHAVLTTQLSDAWIADHDVSGDLLNEHLLREGAATPVDQALRLDSNVMLVDDPVKRVDNMTMAWGLEARVPFLDHELVELAARMPPEEKLRDGGKGILKDVARRVIPSEVIDRKKGYFPVPQLKYIAGPYLDLIRDTLRSQKARERGLFQDAYLDRLFQEPSDHITPLRGSELWQVGLLEMWLEAQGV

SEQ ID NO: 7167 - protein, 164 aa, Brassica napus
  misc_feature (22)..(22): Xaa can be any naturally occurring amino acid
ILLDSSFTPYISDFGLTRLITXTAPSGEPSSSSGTGGFLGGALPYTSIKPSDRSNGYKAPEARLPGSKPAQKWDVYSFGVVLMEILTGKSPDSSPLSSSSSSTGVAEVTDLVKWVRKGFEEETPLSDMVDPMLLQEVHAKQQVLSVFHLALACTESDPEVRPRM

SEQ ID NO: 7168 - protein, 326 aa, Rhizobium leguminosarum
MTKFKLEYIWLDGYTPVPNLRGKTQIKEFDEFPTLEQLPLWGFDGSSTMQAEGSSDCVLKPVAIYPDPARTNGALVMCEVMMPDGHAHASNARATILDDEDAWFGFEQEYFFYQNGRPLGFPEQGYPAPQPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYLREVGGKEYFEALMASSDKNLMDHIAVYGPDNDKRLTGKHETAPWNKFSYGVADRGASIRVPHSFIKNDYKGYLEDRRPNSQGDPYQIVRRF

SEQ ID NO: 7169 - protein, 568 aa, Oryza sativa
  misc_feature (87)..(87): Xaa can be any naturally occurring amino acid
AAEAFGCAPTPAKALEKKLLDLELPPFPAPAKKAAAKVVAAAPKKKLAGGAGGYVLEDVPHLTDYLPNLPSFPNPLQNHPAYSVVKXASLPSSSSPTPAIFFPFSDYSRFVTVRSFCRQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDRAALCNGAA

SEQ ID NO: 7170 - protein, 481 aa, Mycobacterium leprae
MSIPAVPSPQIAVNDVGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGIVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGAFVDLGGVDGLVHVSELSWKHIDHPSEVVQVGNEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYIEEFDPAKYGMADSYDEQGNYIFPEGFDPDSNEWLEGFDTQRAEWEARYAEAERRYKMHTIQMEKFAATEEAGHGSSEQPPASSTPSAKATGGSLASDAQLAALREKLAGSA

SEQ ID NO: 7171 - protein, 300 aa, Unknown
  delta proteobacterium MLMS-1
MQIAMIGLGRMGFNMASRLLQGGHQVVVYNRTPAKSEELASQGATAAYSLSELVAKLSSPRVVWLMLPAGETVDQHLDELGELLAPGDLVVEGGNTYFKDDLRRAEKLAGKGIKYLDAGVSGGIWGLKLGYCTMVGGEQGDFERIEPLLKTLAPPEGYLYCGPQGAGHYVKMVHNGIEYAMMQAYGEGFALLEASPYGENLNYSQVSHLWNQGSVIRSWLLELLEPAFAKDPRLTEITGHVDDSGEGRWTVQQAVECGVAAPTIAISLFQRFQSRNPNAFENRVLAAMRREFGGHAVVKS

SEQ ID NO: 7172 - protein, 333 aa, Cryptococcus neoformans
MSSPSLASALTLSTIGLASRSFLRLTTKEFKIEGLPILLDALNIPHGEKGKGKIKTDDGSDPSLKPRRGILTICNHNSVVDDPMMWSLLPLSTYFPFTSPSHTCRNNRWTLGASDIMFTNSVHSKFFNLGQVIETHRGAGIFQEAIDRAVKLLQEGNWIHIFPEGKVNQQLTNPEGGLLRFKWGVGRIIMDSEIMPEIIPMWISGFDQIMPETRGFPRFVPRPGAHISITVGQPLTSQIQPLVKTWKDMASKEKGTLGIGGEWEQKVKGEGLAGQQQREVRDKGQLIHGREKEVRIKIVEALQEGMRKLGHDVERREGRFERGLWSHSTRQSV

SEQ ID NO: 7173 - protein, 739 aa, Crocosphaera watsonii
MTNSTKTICPYCGVGCGLEVLPPAQPGKAVNRDSEGNPIWQVRGDRSHPSSKGKICIKGGTVSESLVKDRLKYPMMRDSLTDEFRRVSWDEAMEAIVNRMQKVRLTQGPDALCMYGSGQFQTEDYYIAQKLFKGFLGSNNFDANSRLCMSSAVAGYIQSFGSDGPPCCYEDLELTDCAFLIGTNTAECHPIVFNRLRLYHKKNRKVKMVVVDPRRTQTAEAADLHLAIKPGTDIDLFNGIAYLLMRWGRIDSLFIDECTQNFPAYAEVIRHYSPELVARKCGIRIQDLEKAAKYWGESQRVLSLWSMGLNQSSEGTAKVRTLINLHLMTGDIGKPGAGPFSLTGQPNAMGGREAGGLCNILPGYRLVNNPQHRAEVEQFWGVRPGTIQPQRGRTAWEMIQGLETGEVGFLWIAATNPAVSMPDLKRTQAALKRSPFTVYQDAYYPTETATYAHILLPAAQWSEKTGVMTNSERVVNLCPQFRDPPGEARADWEIFAEVGRRLGFEKQFSFPNSAQVYAEFVKITEGRPCDSSGLSYEKLRRYGPLQWPYADTWPCLEGEELDRQNRTNKRLYTDFCFNTPDGRARFGAYHSRGLAEPSDQAYPFVLTTGRLYGHWHTQTRTGRIPKINKKHPEPFIEIHPRDAAKLNIKENSLLEVRSRRGKAYFPAKITKEIAPGTLFVPMHWGALWAENAEANALTHPTACPSSLQPELKTCAVQISIARVNEVRNQRSEVVFETRI

SEQ ID NO: 7174 - protein, 479 aa, Agrobacterium tumefaciens
MSLKTAPVIVWFRKDLRLSDNLALLAAVEHGGPVIPVYIREKSAGPLGGAQEWWLHHSLAALSSSLEKAGGRLVLASGDAERILRDLISETGADTVVWNRRYDPTGMATDKALKQKLRDDGLTVRSFSGQLLHEPSRLQTKSGGPYRVYTPFWRALEGSDEPHAPADPPKSLTAPKVWPKSEKLSNWKLLPTKPDWAKDFSDIWTPGETGALDKLDDFIDGALKGYEEGRDFPAKPATSLLSPHLAAGEISPAAVWHATKGLSRHIASNDISRFRKEIVWREFCYHLLFHFPELGEKNWNDSFDAFSWRDDEKSFKAWTRGMTGYPIVDAGMRQLWQHGTMHNRVRMIVASFLIKHLLIDWRKGEKWFRDTLVDADPASNAANWQWVAGSGADASPFFRIFNPILQGEKFDGDGDYVRRFVPELEKLERKYIHKPFEAPKDALKKAGVELGKTYPLPIVDHGKARERALAAYAAVKKTT

SEQ ID NO: 7175 - protein, 704 aa, Rhodobacter sphaeroides
MTAAAQPSGLPGLATAPGRPWPLGASFDGEGVNFALFSAHAEKVELCLFAPDGRREALRLPLTERDGDIWHLKVNGLLPGQLYGYRVHGPYQPEQGHRFNPNKLLIDPYARKLEGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEFAAMVRRFHAAGIEVILDVVYNHTGESDELGPTLSFRGIDNRSYYRLTEGGRRYANMTGTGNTLDLSHPMVLRMVMDSLRYWVEVMHVDGFRFDLASTLGREEDAFDEQGAFFDAIRQDPVLTRVKLIAEPWDLGPGGYRLGGFPHPFLEWNDKFRDDVRRFWRGEGGMTGDLARRLLGSAERFDHHSRAATSSVNFVTAHDGFTLLDLVSHARKHNEANGEDNRDGHDDNHSDNMGLEGPTTDAGILAARALRRRNLLATLFLSQGTPMLLGGDEIGNGQGGNNNAYAQDNPIGWIDWDRPDETMLAFVARISELRRSLPVLRQKGFLHGRIREADGLRDVVWRLPDGREPGPQDWHSPAMSCLCVEIRMDADRPDAGESPVFAVFNAGEAVPLALPPVPESWSLVLDTTRPEAGPEPAAPGLEAPARSVLVFVPAPPGETG

SEQ ID NO: 7176 - protein, 423 aa, Rhodobacter sphaeroides
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 7177 - protein, 113 aa, Brassica oleracea
MRRILIYRRFSNRAIFGKFIPKVLLHSLRGLSLIFDLICTYNEQSAARATVPGGPSVPCSTAKAVEWDAAWSQNLDLSGRAALGVHVAAYEEDKAEGARPKKLQAEKTAEGIV

SEQ ID NO: 7178 - protein, 205 aa, Banksia attenuata
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAEVGLPVDGNIPVIGFIGRLEEQKGSDILAEAISQFIGENVQIVILGTGKQPLEKQIEQLERKYPDKAIGIAKFNVSLAHMIIAGADFMLIPSRFEPCGLIQL

SEQ ID NO: 7179 - protein, 597 aa, Acidobacteria bacterium
MPTTHRTQRRSVLIVLVLFAAAATAFAQTPLIANIHARQITDLSGTWSTIIDAYHVGERNRFYEDRHQTDPSELIEYNFDHSPTLKVPGDWNSQRPELFLYEGTLWYRRIFSYHPAQGKRQFVYFGAANYHATVYLNAQKLGEHSGGYTPFNFEVTGKLKDGENLLVVEVDDRRSKDAIPALNTDWWNYGGLTREVSLVEVPSAFIENYFIQLAKGSPNEIAGWVQLNSAAGGSEVTIEIPEAKLRQSAKADEHGRAAFRFPAQLTPWSPDNPKLYEVRISSGTDHLTDQIGFRTIEARGTKLYLNGKPIFLRGISIHEEAPFRGGRAFASEDDKTLLGWAKELGCNYVRLAHYPHHESMVREAERMGILVWSEIPVYWDIDWKNPDSLAQARQQLHEEIARDQNRAAIILWSIANETPIDPDRLEFLKALASDVRSLDNTRLLTAALNRTGREGKTRLIDDPLGAVVDVLAINEYIGWYESRVEDADTTEWKSSWEKPLLFSEFGGGAPYGRHGATNERWTEEYQANLYRHQLTMLRKIPALAGLSPWVLMDFHSPVRLLPGVQDMRNRKGLVSDQGQRKQAFYVLQEYYREMGAH

SEQ ID NO: 7180 - protein, 469 aa, Unknown
  Candidatus Desulfococcus oleovorans Hxd3
MSIHRHSRHVVLVFPRFRYKSGDIPIGLATLAAYIRERVPDMSVSILDTTFSPSFAFVERYLQKHRPDIVGVFVDVLMAEDAAKVAAIAKKHGAAVIAGGPHATMAPEAVLKEAVFDAVCVGEGEETFREYIEAFYGNRNFAAVKGLWFRQADGTLYKTPERGFIEEIDALPRPAFDLFDMERYIRIFIQMDSHDPALRGVSLTVSRGCPFNCTFCQPTVHRTLGRKVRIRSPQSVVADLAYLKGAYRIECFYLSDDLLTVLPDWIREFCALLESRRLDLPWGCNTRVDTIDADMMARMKRAGLVKLKVGIESITDRIRNGLYNKQITRLQITDTLAAAEKLGIQVTGFIMVGAPTETAAEVWDTIRFAATSSLDEMVLSVTTPFPGSALHDHVIKQGWRLPSRFRLYNYYQVRRPRMSDDQISNARLFVYKKAANAYFYLHPSRLATTIRSVVGGAWLRKLLIKLRRV

SEQ ID NO: 7181 - protein, 762 aa, Unknown
  Candidatus Desulfococcus oleovorans Hxd3
MTDTHPSLPPRPWWPLLLLVIIAAAAILTYANSLTAPFVFDDAHNIVENPHVRMAELSLDGIIDAVTVGTRRPVASLTFALNYYFHGYDITGYHLVNIAIHILTGFLMFLVVRHTLGLMNLERRDMVAGLAALVWTVHPLHTQSVTYVVQRMAALATLFFLFALYLYIRGRLRQREGRPLGSLFFVLCGLSGILAVLSKQIAATLPFFILVYEWYFFQDLDRAWIKKQAKWIGSAVVVIGALAAIYLGASPIEKIMAMYKTQDFTLGQRLLTEPRVIFLYLSLILFPYPGRLNLDYDFPVSVSLIDPVTTLVSILGLIGLVAAAVVTAKRYRLVSFAVVWFLGNLAIESSFLGLALVFEHRTYLPSVLVIAALAWAAITYIRPRPLAIGFLCAVTLLWGFWTYQRNAIWADEVALWRDVTEKSPTLARPWSNLGMALQIAGNSEAALQAFQKAIALDPNHMEAHNNSGFILRELGRPKEAIKFFRRALEINPAYADAHYNLGLAFFDLKDMAQARTAFEQTLRVNPLYSKAHNNLGVILMQEGDHEAAVAAYQRALKTDPRFAQAYNNLGIIAYQQGNPDQAASFFKKALTADPAYAGAANNLARVRQTIEKHGPAITELKQMLHKTPNDVDLSCRLAQVYQAAGMRYGAISQYQKALALQPGHGPSLNALGVLYAAMGQPAKAVECFRKLSALMPGNATIYYNLACLYARQNQVEPAVENLKKALDAGYDNREQIRADKDLAPIRDTEFYKTRIDSQEPGK

SEQ ID NO: 7182 - protein, 205 aa, Banksia coccinea
SSFDFMDGYDKPVEGRKINWMKAGILESDRVVTVSPYYAQELLSGIEKGVELDNIIRKTGITGIVNGMDVQEWNPSTDKHIDVKYDAKTVFNAKPLLKEALQAAVGLPVDGNIPVIGFIGRLEEQKGSDILAEAISQFIGENVQIVILGTGKKPLEKQIEQLEIKYPDKAIGIAKFNVSLAHMIIAGADFMLIPSRFEPCGLIQL

SEQ ID NO: 7183 - protein, 823 aa, Hyphomonas neptunium
MPEVPYPLPKRHRLVIVGNGMAPGRMLEHLFEHGGKDFDVKIFNAEPRVNYDRIMLSPVLSGEKTFDDIVIHGDGWYIEHGITLYKGHRVVAIDRQLKTVTSDQGEVARYDTLVLATGSDPLILPVPGASLSGVLSYRDLDDVTAMMLAAQPGHKAVVIGGGLLGLEAAAGLQARGMEVTVVHLMPTLMERQLDASAGYLLQKELEARGIRVLCGAKTRAVLGETRAEGLELEDGTTLDASLVVMAVGIRPNAALARGAGLNVGRGIRVDAQMGTSDPDILALGECAEVDGRVYGLVAPLYEMAKAAAARLAGDETITFRHADTATKLKVTGINLYSLGDFASESDREDIVLRDAARGIYKRVVLRENRVIGAVLYGDTRDGPWLSDLKKRDVDIGDIRETLIFGQNAQGAALDPLATVAALPDDAEICGCNGVCKGKIVTTIRTKNLTTLDAVRAHTKASASCGSCTGLVENLMSLVLGDGYQAGAAKTMCPCTPLGHGEVRRLIKVKTLTSIPAVMQELGWSTPDGCAKCRPALNYYLLCDWPDTYTDDPQSRFINERAHANIQKDGTFSVVPRAWGGVTSSKELRAIADVVDRFEIPMVKYTGGQRIDLLGVKKEDLPAVWADLNAAGMVSGHAYAKGLRTVKTCVGSEWCRFGTQDSTGLGIRLEKFLWGSWTPAKVKLAVSGCPRNCAEATCKDIGVICVDSGYEIHFAGAAGLEIRGTEKLGLVRTEDEAVEVIAALLQMYREQGFYLERIYKWAARIGTPVISEQILADPERRRDYFERFIVSQKKAQIDPWAERVAGLERQEFVSLTPQLPGGVS

SEQ ID NO: 7184 - protein, 834 aa, Oceanicola granulosus
MDIVLITAVIASLFLVIAAAEPLAARLRLPYSVILAVLGMMIGVAALFFLRTELTDALNPVAEAILGLPIRSNVFLYVFLPTLLFQATLGMNLRRMLDDWVPILVLAVVAVVVATLSVGYALAWVSPLPLVACLLIGAIVSTTDPSAVVSIFRSISAPRRLARIIEGESLLNDAAAIALFGLFMGFVMRGVPDPEIGPALARFPILIGGGAAAGWLAARVGLWVMALFGRHELAVISVSVALPYLAYIGAEQSIGASGVIAVVAAGLTLNLAGPGRLPPQAWLNLREVWDLLAHWAGALIFILAALLIPRLLEGTRPGDFLLIGVVILAAIAARAVILFGLLPLLTLLRASPVVERPYRTAILWGGLRGAVTLALALAVTESFRVPVEVKRLVGILATGFTLFTLLVQGTTLRMVIGWLGLDRLSSIDEAISRQVVAVALQTVREDVARTTEAYALSRDIVRSEAKAFGERLELAVKAAEDTTDILERDRITLGLIALAGFERETILDRVRERTISGAMAEPILSDADRLIEATRVGGRNGYQRAARRSVAYGGAFRLAVLLHNRLRLSAPLVRMTSDRFERLLSQRLILRDLGAFVDTRIRRIHGPRVADLLHELLARRIDIVETALEGLRLQYPGHAEELERRFIRRTALRMEEREYTAMREDGLIGAEVYTALMQDLAGRRALAEARPRLDLAVQRAVLVRQFPFFADLDEAALRRLSRSLRTRYVDAGRVIVRKDTPLRSVYFIASGAVELERAGQTWRLGRGEMFGQMAILSDRTRRTEVRTIAPSTLLVLDETRFRSLLKRSAPLRNAVRASAEKRGIELSSLEEMEL

SEQ ID NO: 7185 - protein, 541 aa, Oryza sativa
  misc_feature (497)..(497): Xaa can be any naturally occurring amino acid
  misc_feature (511)..(511): Xaa can be any naturally occurring amino acid
MFLFRQWFQGSVILQTPYLKTCCIEGVGTYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERXDQWRKCLELASIIXKLGIRYRLWRDAIERGVDRLPFSNQSESGS

SEQ ID NO: 7186 - protein, 205 aa, Banksia petiolaris
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAAVGLPVDGNIPVIGFIGRLEEQKGSDILAEAISQFIGENVQIVILGTGKKLLEKQIEQLEIKYPGKAIGIAKFNVSLAHMIIAGADFMLIPSRFEPCGLIQL

SEQ ID NO: 7187 - protein, 453 aa, Bacillus cereus
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 7188 - protein, 827 aa, Vibrio vulnificus
MESIVIIGNGMVGHQLVEQLVASGSHLEKRIIVIGEERFVAYDRVHLSAMFSGQSHQDLLLSSEEWYQKHGIELILGVAVVGIDRQSKRVTLEDESQLSYDQLVFATGSYPFVPPMAGSERSKVFVYRTLDDLSQIKQACLGAKKGAVVGGGLLGLEAANALRLLGLETHVVEFAPRLMPVQLDEGAGAVLKSKIEQLGLTVHTSTATEKIIDGETAYHRMVFKDAPPLEVDVIVFSAGIRPRDQLARDCGLELGERGGIVINNACQTSDTAIYAIGECALWQGKIFGLVAPGYAMARVVAQQLRGGSEAEFSGADMSTKLKLLGVDVASIGDAHKATPKATEMVLHDAAAGIYKKLVVDQSGTTLLGAILIGDNQDYDVLLQSYLNKTPLPQPAVSLLFDTSALKGDVSDNTVICSCHNVTKGDLISAIQAGAHELGELKALTKAGSGCGGCSAMVKSVLDQQLSVMGLEVNTQLCEHFSQTRQALYHICQVEKIRDFGSLLAKHGKGHGCDICKPTAGSIFSSLWNEHIMEPEHSPLQDSNDAFMANLQKDGSYSIVPRIPGGEITPEKLIVLGEVARQYDLYTKITGGQRVDLFGAQVEQLPEIWQTLIDAGFETGHAYGKSVRTVKSCVGSTWCRYGVDDSVGLAIELENRYKGLRAPHKLKFAVSGCTRECAEAQSKDIGVIATEKGWNLYVCGNGGMRPRHADLLAADLSKAELIRLIDRVLMFYVRTADRLQRTSVWLENLDGGLDYLKSVVLDDSLHLCEQLEQQMAHVVDTYHCEWKQTLTNPEKLMRFRPFINSTQQSTLLGYQRTRGQRIPVKLED

SEQ ID NO: 7189 - protein, 143 aa, Zea mays
  misc_feature (66)..(66): Xaa can be any naturally occurring amino acid
  misc_feature (131)..(131): Xaa can be any naturally occurring amino acid
TQEATTTSPISTQQAWRSREANDGSVVFGEEQEALVLKSWALMKNDIRNLCLRFLLKVFEIAPTAXRCPCCCADSDVPLEKNPKLKTHAMYDFVMTCEATAQLRKACKVTMRETTLNRLCATHLRLSVSDXHFEDTDFALLDT

SEQ ID NO: 7190 - protein, 500 aa, Xanthobacter autotrophicus
MKAARLPTSQLPTSESRASGSPASPSLLWFRDDLRLSDNPALAALAEARTPLAALYVLDEDSPGVRPLGGAARWWLAQSLRALAADLKDRGVPLILRRGPANRVVPEVAALLGAATVAFNDRAGAAETRVDHAVAARLLSEDRRVLSFCAHLLHPPGSVEGASGGMPRTFSSFHRAALKARRLDTPLPAPKHLDGVAHPPEGETLESFDLEPTHPDWAGGLRSAWTAGEAAAQARLAAFMDAGLAGYAEGRDRPDLNHVSRLSPHLRFGEISPRQILSAVRHAAEAGAVPLVDADKFEAELYWREFSYHLLAEMPDLARSNIQHGFDAFPWRECPGELKAWHKGLTGYPLVDAGLRQLWQTGWMHNRVRMVVASFLTKHLLIDWRSGEDWFWDTLVDADGANNAASWQWVAGSGLDAAPYFRIFNPVTQGEKFDPDGTYVRTFVPELGKLPAPLIHKPWTADAHTLAHAGIRLGHTYPRPLVDHGAARERALRAFESTRK

SEQ ID NO: 7191 - protein, 540 aa, Oryza sativa
MSSYVTTPHHHHHHGCCSGSRRLQAPAPPARPRLVVAAAARHVALPPRRAVASRAMSAEAPLGVAPAAAEEEMAAVVDEMAEEAAVWCAVHGLVVGDRAEPRSGTIPGVGLVHAPFALLPTRFPASFWKQARELAPIFNDLVDRVSLDGEFLQDSLSRTLLNRHGKVLGLDSKRIPQNWAATQFAEALSMAWTEFNNKRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRFPATACVRGRQPAGGEEQRACEGGGRQGEEQHACHDRGNTPTISASLSHPAFPHSAPLLLRPLTSALSAHVSVAANGAANNLGHLHTIGGTVSTVAAMLDSGEILPASREKVVSVLAAFASSDATAHVLVLGRPWPRVAGWPLSSAQAAAAGVLRNLAAFPDLLPMFREEGVLPSLI

SEQ ID NO: 7192 - protein, 427 aa, Oryza sativa
MAGVSAASAAGKIGSFLSKRPYAPPSWASHLSPAPSQTFSLGHFPTPIHKWNLPNLPNGTEVWIKGRVVCLWSLASDTRVWGKLQRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTEVSDISLSKKSIRLNLYDKIQSRWLM

SEQ ID NO: 7193 - protein, 238 aa, Prochlorococcus marinus
MISGPPPSTNQSVEELLERFTSGSKRQRLSLVPTIEERAEELAALAQAALASFDPDGDDWAAGWILQVFQRHQPQVLPSLLSSESSGWFSTPSAVGIDYEPLQRDLLAENFEEADRFTSATLRKLAGPGAEQRGYVYFSEVHAINGLDLVTIDRLWTAYSQGRFGFTTQARLLNALDGRYHSLWARIGWKQDGTWTRYPGSFTWSLSAPEGHMPLINQLRGVRLMDAVLHHPSLAARR

SEQ ID NO: 7194 - protein, 1184 aa, Cryptococcus neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 7195 - protein, 465 aa, Brucella melitensis
MSGNFGGPMDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGVASIEGENGRAIGVTAGDGTFFPADLVVIGTGAVPNVELAAKAGLSIDNGIRVDEHMRTSAPHVYAIGDCASYAHFHAGRHVRLESVQNATDQAKHFARTIVGRETPYREVAWFWSDQGDMKLQTAGLSFDADRHVLSGEPEENAFSVFSFQGRQAGGGRFHQSPGRSYDCASSACGGDQPKRGRYYGWYAAPQGIAGGCGAIKVLWKRPDLGGGEESVRFLIAEGMGGGETPGDILETEGPRGFIRSQS

SEQ ID NO: 7196 - protein, 72 aa, Acidobacteria bacterium
MSKEDAIEVMAVVIEPLPNAMFKVELENKHQVLAHVSGKMRKNFIRILPGDRVAVELSPYDLTRGRIVYRYK

SEQ ID NO: 7197 - protein, 324 aa, Haemophilus ducreyi
MAKEIKKIAVLTSGGDAPGMNAAIRGVVRAALNEGLEIFGVQDGYYGLYHDKVIPLDRRSVSEIINRGGTFLGSARFPQFKDIEVRKQAVKILAKYEIDALVVIGGDGSYMGAKLLTEEFGYPCIGLPGTIDNDIVGTDYTIGYQTALQTAVEAIDRLRDTSTSHQRISIVEIMGRHCGDLTISAALAGGCEYIIVPEKGLDKESLIHSIADNFRKGKRHAIIAITELMTDVHQLARELEEKFGHETRATVLGHIQRGGSPCPFDRILASRMGVYAVDLLRQGFGGRCVGIQNEHLVHHDIIDAINNMRRPFKQDIFEAASKLA

SEQ ID NO: 7198 - protein, 954 aa, Pseudomonas syringae
MTDRIELTTANEFIARHIGPRAADELAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKASQQFFASSHCHPQTLDVLRTRAEPLGITVVVADEHELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHQLTAILAEGLSTLGLNAEQAFFFDSLTLHTGDRTAALHAAARARHINLREIDDQRLGLSLDETTSQSAVETLWAIFANDGQSLPDFAALADSVQSRLPAGLLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKAVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGSNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIENYQEA

SEQ ID NO: 7199 - protein, 160 aa, Rhodospirillum rubrum
MATATFAAGCFWGVEETFRKIPGVTGTTVGYTGGHFKEPTYRQVCAGDTGHAEAVRVDYDPDKVTYEQLLDVFWAAHDPTQVDRQGPDIGDQYRSAIFYHDAGQEAAAGASRARLEQSGALSRAIATRIEPAGPFWPAEEYHQRYIDKQRARTGVAPACH

SEQ ID NO: 7200 - protein, 932 aa, Brucella melitensis
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKLVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQARGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 7201 - protein, 421 aa, Mesorhizobium loti
MIDPKTARRGLALVFTTLLLDIIGFGIIMPVLPAYLQELTGVGVSEAAIEGGWLFFVYAAMQFFFAPIMGGLSDRFGRRPILLASVLTFSIDNLICAIAWSFPMLFIGRVLAGISGASYSTTSAFIADISNDENRAKNFGLLGIAFGVGFVIGPVLGGLLGTFGPRVPFFFAAGLALVNFLIAMVFLPETLDEKHRRRFEWKRANPVGTLLQMRQYKGIGWIGLVFFLMTLGHMMYPAVWSFVSSYRYGWSEQQIGFSLGAFGLCGAIVMAVVLPRVIPWLGEWKTAVIGLTFTAVSAFGYAFASQGWMIYAVIVVGCLEALADPPLRSLAAAKVPPSAQGELQGAMTSLFSITSIITPLLYTAIFSWFTGPSAPVTFGGAPYLVGACFLVLALIVFVTKVARPATMTNATTVVAEDGAQA

SEQ ID NO: 7202 - protein, 925 aa, Pseudomonas aeruginosa
MFKDLGIKGRVLLLTLLPTSLLAMVLGGYFTWVQLSDMRAQLIERGQLIAEQLAPLAATALARKDTAVLNRIANEALDQPDVRAVTFLDARQERLAHAGPSMLTVAPAGDASHLSMSTELDTTHFLLPVLGRHHSLSGATEPDDERVLGWVELELSHHGTLLRGYRSLFTSLLLIAAGLGVTALLALRMSRAINAPLELISQGVAQLKEGRMETRLPPMGSNELDELASGINRMAETLQSAQEEMQHNIDQATEDVRQNLETIEIQNIELDLARKEALEASRIKSEFLANMSHEIRTPLNGILGFTNLLQKSELSPRQQDYLTTIQKSAESLLGIINEILDFSKIEAGKLVLENLPFNLRDLIQDALTMLAPAAHEKQLELVSLVYRDTPIQLQGDPQRLKQILTNLVGNAIKFTQGGTVAVRAMLEDESDDRAQLRISVQDTGIGLSEEDQQALFKAFSQADNSLSRQAGGTGLGLVISKRLIEQMGGEIGVDSTPGEGAEFWISLSLPKSRDDNEEPGASWAAGQRVALLEPQELTRRSLHHQLTDFGLEVSEFADLDSLQESLRNPPPGQLPISLAVLGVSAAIHPPEELSQSFWEFERLGCKTLVLCPTTEQAQYHATLPDEQVEAKPACTRKLQRKLQELLQVRPTRSDKPHAMVSGRPPRLLCVDDNPANLLLVQTLLSDLGAQVTAVDSGYAALEVVQRERFDLVFMDVQMPGMDGRQATEAIRRWEAEREVSPVPVIALTAHALSNEKRALLQAGMDDYLTKPIDEQQLAQVVLKWTGLSLGQSLASMSRAPQLGQLSVLDPEEGLRLAAGKADLAADMLAMLLASLAADRQAIRQARDNDDRTALLERVHRLHGATRYCGVPQLRAACQTSETLLKQNDPAAAAALDELDKAIEALADTASATTHLSSTSLDSSEL

SEQ ID NO: 7203 - protein, 320 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSASATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 7204 - protein, 299 aa, Pseudomonas aeruginosa
MTVQYPTIADCVGNTPLVRLQRLPGETSNTLLVKLEGNNPAGSVKDRPALSMITRAELRGDIRPGDTLIEATSGNTGIALAMAAAIKGYKMILIMPDNSTAERKAAMTAYGAELILVSKEEGMEGARDLADKLQREGRGKVLDQFANGDNPEAHYHSTGPEIWQQTGGSITHFVSSMGTTGTIMGVSRYLKEQNPAVQIVGLQPMEGSAIPGIRRWPQEYLPKIYDASRVDRVVDMHQDEAEDIMRRLAREEGIFCGVSSGGAVAAMLRLSRELENAVLVAIICDRGDRYLSSGVYDPR

SEQ ID NO: 7205 - protein, 275 aa, Prochlorococcus marinus
MTDFLVAALQITSTSNVEANFVEAEEQIELAARRGAELIGLPENFAFLGEDDEKLRLAPELSMKCTNFLKTMSQRYQVFLLGGGYPVPAGDDRHTLNRSALFGRDGQVLAKYDKIHLFDVDLPDGNLYKESSTILSGEEYPPVVDVPGLCKIGLSICYDVRFPELYRYLSSNGAELIMIPAAFTAFTGKDHWQILLQARAIENTAYVVAPAQTGVHYGRRQSHGHAMVIDPWGTVLSDAGKTQGAAIAPADKKRVKKIREQMPSLKHRKNKLFSN

SEQ ID NO: 7206 - protein, 337 aa, Brassica oleracea
MGRSPCCDQDKGVKKGPWMPEEDYKLVAYIDKNGYGKWRSLPNIAGLNRCGKSCRLRWMNYLRPDIRRGEFTEEEESTVVKLHALLGNKWSKIASHLPGRTDNEIKNYWNTHMRKKMLQMGIDPITHEPKTNDLSPILDVSQMLAAAIGNGQFGNNTLFNNNIAVEDLLKLQLIHKMLQIITPKAMPNTNSFNTNSLDTKPVANNIKTNPVNPKPEQAAGQLNAIDPHVFTSQIENEDFMPSFEDAWDCFGDNQLPGLVMVSQENLNYQTGAGMMPDYYGDQLREVPSTGSISVTPETSGLNYPGTTQHSSGSNVQEDWEKFLDDETSDSCWKSFLE

SEQ ID NO: 7207 - protein, 844 aa, Coprinopsis cinerea
MPPKADWEKYEKRVDDKDEEKIVALDDSDIQILKTYGQGPYAKKLKEVENDIKVIEKRINERLGVKESDTGLAPPNLWDLAADRQRMSEEHPLQVARCTKIIPMDPKLAEAARAVNAPGAPQGQKGADEQDKYVINIKQIAKFVVGLGDRVAATDIEEGMRVGVDRTKYQIQIPLPPKIDASVTMMQVEEKPDVTYSDIGGCKEQIEKLREVVETPLLSPERFVNLGIDPPKGILLYGPPGTGKTLCARAVANRTDATFIRVIGSELVQKYVGEGARMVRELFEMARSKKACIIFFDEVDAIGGARFDDGAGGDNEVQRTMLELINQLDGFDPRGNIKVLMATNRPDTLDPALLRPGRLDRRVEFSLPDNDGRAHILRIHARSMSVERDIRFDLIARLCPNTTGAELRSVATEAGMFAIRARRKVATERDFLDAVEKVVRQGTKFSSTTKFQQPNSAEVTALLAQYGTAAPRPLNLSQLLSFGRPVTPDSVLSSVSYVLYELPRRLATRVRYLESLPFIVGTNPYVAKTLKAFREGFWVLATHPPVTNLEENEKFVQLLSDLVQRHANDIPTMAKGFQESAKYMSFEDINAFLDGAIRNRISVRLIAEQHIAVTRALHDPPQDGKDVGVIDTRCSPKEMVDVCGSFVGDLCRATLGSAPEIVVDGYPEATFAYIPVHLEYVLTELLKNSFRATVEHHARSKERGSLPPIQITLSPPPASSHSGHNVDRPNFFSIRIRDQGGGVSRQHLERIFSYAFTTVKTGDDEGPDWDTSDSREDEPFLGVMTQRTLQTGLGTIAGLGYGLPMSKLYTKYFGGSLDLISLEGWGSDVYIKLRCLDEAGDSNI

SEQ ID NO: 7208 - protein, 479 aa, Chlamydia muridarum
MAPADIGLIGLAVMGKNLVLNMIDHGFAVSVYNRSPEKTEEFLKEHGENISLQGFTAIEEFVQSLKRPRKIMIMIKAGAPVDEMISSLLPFLEEGDILIDGGNSYYLDSERRYIDLKKKGILFVGMGVSGGEEGARKGPSIMPGGNIEAWPVIAPIFQSIAAQVDGQPCCSWIGTGGAGHFVKAVHNGIEYGDIQLICETYEILKSRLDLSLEQIGNIFFEWNQTDLNSYLMGASAAVLTAKDENGVAVASTILDVAGQKGTGRWVAEDAIKAGVPMSLIIESVLARYLSAWKEVRRQAAREFPVASLLYQPSQEASVLIEDAREALYAAKIISYAQGFMLLKQISEERNWDLNLGELALIWRGGCIIQSAFLDKIHQGFESCPDAHSLMLQDYFKNVLLNSETGFRRAILHAVGAGVAIPCLASALAFYDGYRTENSPLFLVQGLRDYFGAHGYERQDRPRGEFYHTDWLGSKNASRM

SEQ ID NO: 7209 - protein, 112 aa, Alteromonadales bacterium
MKMISAIIKPFKLDDVREALADLGIEGMTVVDVKGFGRQRGHTELYRGAEYQVDFIPKIKLEIATRTENCQRVVEAITKIASTGKIGDGKIFVYDLDQIVRIRTGELDEEAI

SEQ ID NO: 7210 - protein, 205 aa, Banksia media
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAAVGLPVDGNIPVIGFIGRLEEQKGSDILAEAISQFIGENVQIVILGTGKKPLEKQIEQLEIKYPDKAIGIAKFNVSLAHMIIAGADFMLIPSRFEPCGLIQL

SEQ ID NO: 7211 - protein, 141 aa, Aspergillus oryzae
MAPKAAEKKPSTGGKAPAGGKAPAEKKEAGKKTAAAASGDKKKRGKTRKETYSSYIYKVLKQVHPDTGISTRAMSILNSFVNDIFERVATEASKLAAYNKKSTISSREIQTSVRLILPGELAKHAVSEGTKAVTKYSSSAK

SEQ ID NO: 7212 - protein, 337 aa, Brassica napus
  misc_feature (168)..(168): Xaa can be any naturally occurring amino acid
  misc_feature (314)..(314): Xaa can be any naturally occurring amino acid
RLQRPGGSPLTRIFQVIVAAFRKVSVKVPEDKSLLFETADDESNITGSRKLEHTDNLMFFDKAAVESHSDSIKDGEVNPWRLCSVTQVEELKSIITLLPVWASGIVFATVYSQMNTMFVLQGNAMDQHMGKNFEVPSASLSLFDTVSVLFWTPVYDQFIVPFARKFTXRQERGFTQLQRMGIGLVISIFAMVTAGVLEVVRLDYVKSHNAYDDKKIPMSIFWQIPQYLLIGCAEVFTFIGQLEFFYDQAPDAMRSLCSALSLTTVALGNYLSTVLVTVVMKLTKKNGKPGWIPDNLNRGHLDYFFYLLAVLSFXLNFLVYLWISKRYKYKKAIGRAH

SEQ ID NO: 7213 - protein, 112 aa, Herbaspirillum seropedicae
MKLITAIIKPFKLDEVREALSAIGVQGITVTEVKGFGRQKGHTELYRGAEYVVDFLPKTKIEAAVDDAIVERALEAIETAARTGKIGDGKIFVQDLLDVIRIRTGETGKDAL

SEQ ID NO: 7214 - protein, 360 aa, Bacillus anthracis
MPKHRKQSKIKIYRITNYKKDKRSELDSNKFELEQQAVENKQDKQGKQDNQVQSENVVIVPTDSHNLDIWDEISLKEIQAGEHTNLFAEQSNYQNINLLQVSDIRLYLDKQLQFSSVDEQIYHEALVHPIMSKVIDPKRVLILGGGDGLALREVLKYETVLHVDLVDLDGSMIDMARNVPELVSLNKSAFFDNRVNTHVCDAKEFLSSPSSLYDVIIIDFPDPATELLSTLYTSELFARIATFLTEDGAFVCQSNSPADAPLVYWSIGNTIEHAGLTVKSYHTIVPSFGTDWGFHIAANSVYVLDQIEQLYVVPTPRTLPSLLFPLFQFKEEHLEQRNFALLNSESNLILHQCYKKEMEF

SEQ ID NO: 7215 - protein, 205 aa, Banksia grandis
SSFDFMDGYDKPVKGRKINWMKAGILESDRVVTVSPYYAQELLSGIEKGVELDNIIRKTGITGIVNGMDVQEWNPSTDKYVDVKYDATTVFNAKPLVKEALQAAAGLPVDGNIPVIGFIGRLEEQKGSDILAEAISQFIGENVQIVILGTGKKPLEKQIEQLEVKYPGKAIGIAKFNVSLAHMIIAGADFMLIPSRFEPCGLIQL

SEQ ID NO: 7216 - protein, 499 aa, Xanthomonas axonopodis
MSEEILVNVTPRETRVAVIENGMLQELHIERGWRRGVVGNIYKGKVQRVMPGMQAAFVEVGLERAAFLHANDVVRLAPAPASVVDTEETPIPPPPPASVPIVELLRDGQEIVVQVVKDPIGTKGARLTTQISIPSRYLVLLPQSKVVGVSARIEDEAERLRLKTIVSEVSAQHGGFGYIIRTNAEGQPAEALAEDIAYLSRVWNVVERRGREAPPCSIIYEDLSLPLRAVRDLIRRDVEKVKVDSNETFVQLQAFVAKYMPVLAERLELYTGDRPIFDLYGVEDEIGRALNKQVPLKSGGYLVIDQTEAMTTIDVNTGSFVGQRNLEETVFRTNLEAAQAVARQLRLRNLGGIIIIDFIDMDDSEHRRQVLRTLEKALARDHAKTTVYEFSPLGLVEMTRKRTVESLERQLSETCGQCGGRGTIKTAETVTYEIFREITRAVRQFDAARLLVIASSKVVARITDEESAAVAELEEFLGKSIRFQSDDQYLQEQFDVVLL

SEQ ID NO: 7217 - protein, 398 aa, Klebsiella pneumoniae
MTRQLVIIGNGMAATPGEALVERDARRFSITIIGDEPRQAYNRIQLSPVLGAEKTAGATRLLPAEWYSQHNVTVRAGETVTAVDMAARTLQTTAGELGWDELVFATGSLPFLPPLPGITLPHVFAFRTLADVEGILAIDGPAVVIGGGVLGVEAAAALRRHGDSVTLLHRGSWLMEQQTDAFVGEQLQMLLAERGIGCVMESRIAAIDEHQVLLEDGRAFAASRVVLATGVQPNKRLAERSGLACGRGILVDRRLATAQPGVSALGECCEIDGQTWGLVAPCLRQAEVLADRLCAIPGEDFRWQDSGTRLKVTDIELFSAGELRADEQDDVYTSWDPLDRHYRRLLLRDGKLRGVLLLGDCSSAAPLTALLGRHGPRRQSGFSTHLQRCSRALWDKLR

SEQ ID NO: 7218 - protein, 297 aa, Vibrio vulnificus
MDTSISTQLRDRSYSEHAISYHSSRRLQAKNRPTSTGMAASGFVYLVGAGPGDPEMLTVKAVNALQQCDLLVYDRLVSKEILALVPEHVDKIYVGKRCGEPSLKQDEINQILVSFAQLGRKIVRLKGGDPFIFGRGGEEALALVEHNIHYCVVPGITAAIGCAASCAIPLTHREVARSVTLVTGTVVTGSLPAWSAIVEAGQTLVFYMGLESARAIEQGLLGQGVRADFPVAIVTQGSTPEQKTYVTTLATLEKTAVALKGVSPALIIMGEVVKLRERLKTTLAAVAPMANASFVNE

SEQ ID NO: 7219 - protein, 586 aa, Bacillus cereus
MFKEAIYHRPKDNYAYAYDEQTIHIRVRTKRDDIQSADLIYGDPYEWKDGKWISASTPMKKTGSTALFDYWSISIEPKFKRLRYAFELKSETDTLIYAERGFFSSIPNDDVGNFFCFPFIHADDVFKAPSWIKDTIWYQIFPERFANGDSTLNPENTLPWGSANPTPTNFFGGDFSGVIQNLDYLVKLGISGIYFTPIFKAHSNHKYDTIDYMEIDPQFGTKETFKELVEECHKHGIKVMLDAVFNHSGYFFEKFQDVLENGEKSAYKEWFHIHEFPIITEPLPNYDTFAFTPYMPKLNTAHPDVKEYLLEVGRYWVREFNIDGWRLDVANEVDHNFWREFRTEIKTLNPEVYILGEIWHDALPWLQGDQFDAVMSYPVTNALLSYFANDSIKASEFMKQITESLHSYSMNVNEAAFHLLDSHDTPRILTTCNGDKNKLKLLYVFHLSFIGSPCIYYGDEIGMDGGMDPDCRKCMIWDTKEQDHALFTHIQTLILLRKQHKAFGGHGTFQFIEANDEHNYISYTKTYEDETIFFVLNPTNSEVTVSLPLHVTGKKIINIYTNEEFSAEASVLQVTLPPYGFSILKW

SEQ ID NO: 7220 - protein, 197 aa, Banksia oblongifolia
YDKPVKGRKINWMKAGILESDRVVTVSPYYAQELLSGIEKGVELDNIIRKTGITGIVNGMDVQEWNPSTDKYIDVKYDATTVFNAKPLLKEALQAAAGLPVDGNIPVIGFIGRLEEQKGSDILAEAISQFIGENVQIVILGTGKKPMEKQIEQLEIKYPGKAIGIAKFNVSLAHMIIAGADFMLIPSRFEPCGLIQL

SEQ ID NO: 7221 - protein, 509 aa, Unknown
  Acinetobacter sp. ADP1
MTAQAKKLDSADRKALPSHIYDSFIVGAGISGIAAAIRLDQVGYANYKIIEKASRVGGTWRENTYPGCGCDVPSALYSYSFAPSAQWSHLFARQPEILNYLEDVSHKFNINEKIEFETELNKAAWDNERNLWVLDTNKGQFLSRTVVFATGPITEAQIPKLDGLDSFKGEMFHSARWNHDYDLSGKRIAVIGTGASAIQFVPQIQPLAKELFVFQRTAPWVVPKPDMELGDFSKSVIAKLPIIQSTWRKAVAQSLNAINFGLRNPAVLKPVGELFKQVLKSQVKDPELLKAVIPDFTIGCKRLLFANNYYPALQASNTKLIPHGLVKVEGNTVIAANGERHEVDVIIWGTGFEVSHPPIGRRVYNDKGECLNDLWKQSSPEAYLGTNIENVPNAFLVLGPNVLVYDSFIGLAEAQLDYIVDGLQKIKKHNISKLTIKPQVIHAHNERVQKHLKTTVFNAGGCKSYYLDANGRNFAAWPWSLKKLRQRLKSLNIRDYDVTYQTTTNKIDA

SEQ ID NO: 7222 - protein, 881 aa, Vibrio vulnificus
MHGCSKTTCPYCGVGCGVEVKPDELVGDKEHPANHGALCVKGAALAESLNMPSRLLYPKLSGEQVSWELASDWIAQRFHQAMEEYGPDSVAMYVSGQLLTEDYYVANKLMKGYVGSANIDTNSRLCMSSAVAAHVRAFGEDVVPVSYDDLEHAELIVISGANTAWTHPVLFRRIQQIRENNPNVKLVVIDPRKTVTAEQADLHLPIANDSDVSLFHGLLAYLLEQQGSDKGIDTEFIELHTQGFAALQALVSSGAYQLEQVASHCGIDIQALRTFYQWFSRSNATMTLFCQGVNQAQNGVDKANAIINAHLATGQIGKRGAGPFSLTGQPNAMGGREVGGLANQLAAHRGFDPDSIRAVQQFWQSPRIAEQPGLKALDLFKAVERGEIKVLWIMATNPVVSMPDNRWIRQALERCPCVIVSDITADSDVAHYADLLLPAAGWGEKQGMVTNSERRMSRQRRFISPPGEAKPDWQAICEVGARLSLKLQAKNGFAFESEAAIFREFAGLTAINSDSHYKLDLAQYQNLSDEAYEQWRPTQWGGESPYADGRFSHPDGKARFVAMTELANSRDESIGRGLWRLNSGRQRDQWHTMTRTGHIEKLAASELEPSVYLNRLSAGKLELQAGELANITNPDTLQSLLAKVVIDESMAFGELFMSMHWAGRYGGQSQVNAVVSASGDPISGQPAFKSSLVEVEKAPVVSFGVMISDFSPAIATDYCAYQHQDQSGVWRVASLTLPPQQLAEINLPPGSQVRRVSWQHELGWITLQLQSDTDEANQAKLQAIFIASSQPLKADYQQLQKLIGEPINWQALMQAGFATRVSQLVCSCLRVTDRQIEQAIEQKGVTTLTQLQNQLQCGTNCGSCIPQLKQYFAPAIAQPSR

SEQ ID NO: 7223 - protein, 129 aa, Unknown
  Oceanobacter sp. RED65
MRILHTMLRVGNLDKSIEFYTDVLGMKLLRKHDNEQYKYTLAFVGYDTEDKTAVLELTYNWDTSEYDLGEGYGHIAIGCEDIYKTCDLIRERGGIISREPGPVKGGTTEIAFVKDPDGYAIELIQTDKA

SEQ ID NO: 7224 - protein, 487 aa, Bordetella pertussis
MTEDILINVTPFETRVALVEQGAVQELHVERSVQRGHVGNIYLGRVVRVLPGMQSAFIDIGLERAAFIHIADLRENRSERSQGQTPTPIEKLLFEGQTLMVQVIKDPLGTKGARLSTQISIAGRMLVYLPHDPHIGISQKIDSESERTQLRERLQALMPPEEKGGFIVRTQAEGATDEEIAADLEYLRKLWASVQAAARSQPAPTALHQDLTLGQRVLRDMVGPHTGTILVDSRSTSSALQEWARVYTPSVAERIRHYSGERPLFDTANVDEEIARALSRRVDLKSGGYLIVDQTEALTTVDVNTGGFVGGRNFDDTIFKTNLEAAQAIARQLRLRNLGGIVILDFIDMEDPDHRETVLAELKKALSRDRTRMTVNGFTQLGLIEMTRKRTRDSLAHQLCEPCPMCQSRGNVRTARTVCYEILREILREARQFNPREFRILAAQGVVDLFLEEESQHLAMLGDFVGKQISLEVESQYSQEQYDIILI

SEQ ID NO: 7225 - protein, 317 aa, Gibberella zeae
MSFHPDNLPSLNGKVFIVTGGNAGMGYYTVLHLAAHGAHVYMCCRSLEKGNAAIAEIKKEHPSANIDLLQMDLMDFSSTVAAAKHFLTRETSLHGLINNAGIMATPFDMTKDGHEAQWQTNYLSHWVFTEHLIPVMQRTAKTLPPGSVRIVNLTSSGHLGAPKTGINFDDLTLKDQGVWERYGQGKLANILHTKSLHNKYGPGSENKDGEIWVTAVHPGLVETNLATTVDPTEKGMLTLVSALRCFRMLWTADKGSWNSLYCAASQDMKAEQSGQYMEIFHRFGEPWWASSAAKDEELAKKLDVWTRETMGKEGWVQ

SEQ ID NO: 7226 - protein, 315 aa, Burkholderia xenovorans
MSNFRGVIYDSIVDTIGATPLVRLSKLAAACDCRADVVGKLEFFNPLASVKDRIGIALIETAERAGRIKPGTLLIEPTSGNTGIGLAFVAAAKGYPLVLCMPESASIERRKMVGLLGAKVELTPASEGMGGAIRRAEALKRNHPDSLILQQFDNPANPDAHRHTTAEEIWNDTAGRVDIIVSGIGTGGTITGIGQTLKARKPELQMIGVEPSGSAVLSGGKPGPHKQQGIGSGFLSSILDLSVVDEIVTATDEDAIQTARQAAALEGVPIGISSGAALSVALRVGRRPGNAGKLIVVIVPSFAERYLSTELFADV

SEQ ID NO: 7227 - protein, 305 aa, Glycine max
  misc_feature (95)..(95): Xaa can be any naturally occurring amino acid
  misc_feature (127)..(127): Xaa can be any naturally occurring amino acid
  misc_feature (138)..(139): Xaa can be any naturally occurring amino acid
  misc_feature (212)..(212): Xaa can be any naturally occurring amino acid
MASSVEKEGGASEETFSLELPAPPGWKKKFIPKKAGTPKKNEIVFTSPTGEEINSRKQLEKYLKAHPGGPAVSEFDWGTGETPRRSTRISEKAKXAPPAESEPPKKRTKRSSASQKETSLEEKEEEXKEAEMQEADDXXKDDNVIEKEKDFVKENQDDKSVENTDVNKSAHSGEAKPVENVEVLIEEEKSNAADGELPALKDKVDDKRTEGXEDFRKDEEKIEHPQEETKEYRGFGEQEKLETCLTADKRVEVEGVNKEEHVKSTCEFDVEEIEGTKVNSEEHHKLDEINKKAEAELTVNGNHGS

SEQ ID NO: 7228 - protein, 207 aa, Oryza sativa
MEHHRHRGAVVLVVAAAAMAMAMSAVRGDFAADRAECADKLMALSTCLTFVQDGASGGAAAPTPDCCSGLKAVLAASRKCLCVLIKDRDDPNLGLKINVTKALSLPQLCNAPANISDCPRLLNLPPNSKDAQIFEQFAKQQAAMQGSPSASPGGSSAPAAGAQKSGAAVLRWLGVDGVGGGGARAVALLLFLLSSAVAVAAPLLLVF

SEQ ID NO: 7229 - protein, 144 aa, Glycine max
  misc_feature (62)..(62): Xaa can be any naturally occurring amino acid
  misc_feature (94)..(94): Xaa can be any naturally occurring amino acid
  misc_feature (107)..(107): Xaa can be any naturally occurring amino acid
FAFLISYDNPGILAGLGCSASSQAKRGRGLELSRIQAHRGPDWSQLHQYGDHYLAHHRLAIXDPAHGEHPLFNADYTESVPVNGEIYNHEELMXQLPNDTFQTGCDXDVIAHLHEEHGDYYMDMLDGIFSAALLDSRDSMHIVA

SEQ ID NO: 7230 - protein, 1029 aa, Coccidioides immitis
MLVWNPDNIKDVAESVGINALNEEVVDHLARDVEYRVSQVLEESHKFMRHGKRTLLTTQDVSNALRVLDVEPLYGYESTRPLKFGEATIGPGQPLFYVEDDEVDFEKLINAPLPRVPREITFTAHWLAVEGVQPTIPQNPTSADSRNLELISKGPNANANLAAMSGNENVTVKPLVKHILSKELQLYFERVCSAFLDESNEEYRLSAFASLKEDPGLHQLVPYFVQFISEKVTHSLKDLFVLTQVMHMTEALIQNKTLYVDPYVASLIPPVLTCVIGRQLEGGSDPLDHFTLRDLAGSLIGMISKKYSHSSHTLKPRLARTFLKNFMDPSKPFGTHYGAIIGLHSIGGPDVIRELIIPNLPTYEVVLKDVAGDEGLRKSEAEKVIGVILAALSTIQDEKAPLTNGVANGAMETLSKQLTKKIGGILASRIIDSGNPEDEKGRQRGALASEFQPASLICTVCACRPSTLQFDGLVKYFVPVRCRYVTTTSRRGFGELDDPLAILPENYIMPRFRVTTFVYPDNTSSTRVDPPHLPFSCLPEIFLYQTQISSSVRPDTFTSIGIYLDSSNAFEGPEKLLEVWFSPSAHDLAGTAVPTGLKAVSPEIWKGMLDLVNCQVLSIVESDDVDAYLLSESSMFVFPHKLILKTCGTTTLLLGLPRILEIAALHAGFPKNSPPCYGGISSAAAPYRVFYSRKNFLFPDRQRGPHRSWRDEVKTLDKLFLGGSAYMIGKMNGEHWYLYLTEPFTSLTPPTTPNHETSIKTLTLPEAMNGMQPENGRCDESDETLEILMTDLDEKNAKQFYLDHASAVAEDRHRSLHQNNDHHLDVFSNNSSDNSDIESDAGQSLPPELTSEGHALGTVVSDSCGLSDVYPVNKYPDARVDAYLFTPCGFSANGVVPSPDNKSGTHYFTVHVTPEPHCSYASFETNVPHAQSGRETADIVKHVVEIFKPGRFSVTLFEAKPPHADAPSVYDSKALQRHAVLRNAKMEHIPGYRRVDRIVHDLDGYDLVFRYYERNDWRGGAPRIGETGF

SEQ ID NO: 7231 - protein, 216 aa, Schizosaccharomyces pombe
MRRAFVERNTNETKISVAIALDKAPLPEESNFIDELITSKHANQKGEQVIQVDTGIGFLDHMYHALAKHAGWSLRLYSRGDLIIDDHHTAEDTAIALGIAFKQAMGNFAGVKRFGHAYCPLDEALSRSVVDLSGRPYAVIDLGLKREKVGELSCEMIPHLLYSFSVAAGITLHVTCLYGSNDHHRAESAFKSLAVAMRAATSLTGSSEVPSTKGVL

SEQ ID NO: 7232 - protein, 572 aa, Unknown
  delta proteobacterium MLMS-1
MSRKIVIIGGVAAGPKTASRVKRLLPEADVTIIDQDNLISYGGCGIPYYIGGDVSDEKELRNTSFHLTRNEDFFLKAKGVTVRTKTRALAIDRPNQKVRVQALDGGAREEIPYDQLVIATGSQPNRLPLPGVELDGVFTISDLHQAIEIKERIARGKVSRAVIIGGGAIGIEMAEAFVDLWGLEADLLEFMPQLLPRLVDWEFARMLENHLRQQGVNIYTNEAARAIEGEAGKVSRVVTPQRTLAAELVIMAVGVRARGELAAEAGLPVDGQGNILVNDRLQTADPNIYAAGDCIAVKNRLTGKSGIAPMGSLANREGRIVADNLAGIPTRYQGWVGSFTLKAFECCIAATGLSLESARAEGFDAAAVTTAQSDRAHFFPTQTVIPLRLVFDRSNRQLLGVQGFGPMGDAVLARIDAAAALLQQGGTIDDVSQLEMAYAPPFATALDALNATGNVADNLAAGRLRCVETADFLAWMEDFASRPDLVALDIRHPNEASLLADKFGRDQWLTIPYVDIRERHRELPTDRTMIIICDAGTRSSEIQIFLDSVGLANNLVLGGGFNLIRRMGVAWM

SEQ ID NO: 7233 - protein, 654 aa, Prochlorococcus marinus
MCGIAGLICKDRQILALDEIGSKMNTSLLNRGPDDSGIWIDNDIGILLSHTRLSVNDLSKAGHQPMLSSSNRFVLTFNGEIYNHWDLRQELEITQGSQNWKSHSDTETLIQAIECWGVYKTLTKLIGMFAFGIFDRKENKFYLARDRFGEKPIYWGITGVGTRKVLIFGSDLKALKSYPEFNNTINRESMGLFINYNYVPDPHSIYENIWKLEAGKILEIDVTDDDYSKIYPMSWWQLEDTIKNVDGREIENESEAINLLKQELIKSVKSQSKADVKITSFLSGGIDSSLVSALLQETSNSQINTFTIGFENKRFDEATYARRISNYLGSNHSELIFTNEDALNIVPKINEYYSEPFADPAAIPTLLLCNAAKSQGYTVALSGDGADELFGGYNRYTMAPKIWKYFGIIPNFMKPMLINSVNKLSTQSIDLIGSILKIRQFRERLYKITDKISYSNSLEDLYYRLIREWSDVSSITEYKYNQPFTPISNERLNQSIHELKLDPVTFMMVIDCLSYLPGNNQVKLDRASMAVGLETRSPFLDKNVGELIWRLPINLKIKNNCGKYILKEILADYIPKKLFERPKAGFATPINEWIKGPLREWAEEMLNSNKVRDEGFLNPEITTKLLNEHIQGVKDNSKKLWSALIWESWIDKNI

SEQ ID NO: 7234 - protein, 507 aa, Prototheca wickerhamii
ADPPSGKPTHHLSTGDLPARTPMAPCLATVVPTSVGTLQGARALPKGAFGPRPSALATRQAQRAPRNPAGPAPRSLSHRTAAVAPGTAQAPNSSMASPTAQSEVGLIGLAVMGQVNPGSEAASRVHQGAGNPWMQLWGGPALRKRLCSDRVYRDVMSDSGRDPHAFPQNLALNVAEKGFHISVYNRSGEKTDAAVSRAVKEGVGERLHGVQGAKDFVLSLKRPRRIIILVKAGAPVDSTSKQLTEFVVEPRDIIIDGGNEWYENTERRQAELATKGSHHIGMGVSGGEEGARNGPAMMPGGDKGAYSHLRPVVEKVAAQTDDGACVTYIGPGGAGNYVKMVHNGIEYGDMQLIAEAYDVLKTVGGLTNAELASVFSEWNGGELESFLIMITAIIFAVKDEGGEGELVDKILDKTGMKGTGKWTIQEAAELSVAAPTMAAALDARFVSGLKDQRVAAEAVYAGLGLGPPTPPPASYKAALVADVRDALYAAQDLSYAQGVQHHPCQVG

SEQ ID NO: 7235 - protein, 406 aa, Rhodobacter sphaeroides
MQQPRLALAFILITVALDAIGIGLIFPVMPDLILEITGQPLSEAAVWGGLLSASFAVMQFLFGPTIGSLSDRFGRRPILLGSLVLMSGTYLAMALAPTMAILLAARIVAGIVSATYATASAFIADVTPPEDRGKRFALVGAGFGIGFVLGPALGGLLAGLDTRAPFYAAALMALLNLGLGSLILPETVTDATRRAFTLSRANPLGALRAVARLPGLSRPLAVFLILGIAMNVYPAVWAFYGQAQFGWGAGMVGASLALYGISFAVGQVALVGPAIRHLGEHRTALVGIWVDIVTLAILGVLASGTGVLFLIPVTALGGVVVPALQSILSRATPADAQGELQGVLASLNAIAMIASPLVMTATFRAFTAPGAPLHLPGAPFLLASLLMVGALVLHVRGAGQPERDAA

SEQ ID NO: 7236 - protein, 379 aa, Oryza sativa
MSTSAPTSSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRSWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIAVTKAEEGRLTGKVLSRDTIVFKDMPKGSAITHCIALEL

SEQ ID NO: 7237 - protein, 112 aa, Idiomarina loihiensis
MKMLVALIKPFKLEDVKQALFEIGCKGLTVTEVRGVGRQKGHTELYRGAEYQVDFLPKMKIELAVPDETVERALEVVIAAAHTGNIGDGKIFVMPLEQCVRIRTGETDQDAL

SEQ ID NO: 7238 - protein, 320 aa, Xanthobacter autotrophicus
MTAHTVKVVIIGSGPAGYTAAIYAARAMLEPVLFEGIQPGGQLTITTDVENYPGFADPIQGPWLMEQMRAQAEHVGTKIVTDHVASLDLSHRPFRMVTESGDTYVADVVILATGAQARWLGLESEAAYRGSGVSACATCDGFFYRGKDVVVVGGGNTAVEEALFLTNFASNVTVVHRRDSFRSEKILQERLFAHPKVKVVWNAELAEVVGQDDPFTKVTGAKLRDVRTGVLTELPADGIFIAIGHAPATELVKDQLKLKESGYVWTAPDSTATSVPGVFAAGDVADDVYRQAVTAAGRGCMAALEAERFLAHQGVAKAAE

SEQ ID NO: 7239 - protein, 528 aa, Crocosphaera watsonii
MDKQQLWQRYQDWLYYHEGLGVYVDVSRMRFDHGLVTQLTPKFEKAFADMETLESGAIANPDEGRMVGHYWLRAPELAPNDDVRKEITEPLANIGEFVQKVHAGTIKPPTADKFTHVLSVGIGGSALGPQFVAEALSDVDPPMVIHFIDNNDPAGIDRVIEQIGDHLKNTLVLITSKSGGTPETRNGMLEVKNAYESKGLAFEPNAVAVTMPGSKMDKVAVDDKWLARFPMQDWVGGRTSELSAVGLLPAALQGINIDEMLVGAKEMDEATRVKDLKTNPAALLALAWYHSGNGKGEKDMVVLPYKDSLLLFSRYLQQLVMESLGKEKDLDGNTVYQGIAVYGNKGSTDQHAYVQQLREGVPNFFATFIEVLEDGRDTLFEIEPGVTSGDFLSGFLQGTRQALFENNRDSITITIPQVNPRIVGALIALYERTVSFYASLVNINAYHQPGVEAGKKMAASILDLQTKVQTVIKETSEVLDMATLAEKAGSPDEVESVYKIVRHLAANGRGVSLEGELTDLKTLKVSAS

SEQ ID NO: 7240 - protein, 518 aa, Unknown
  Acidovorax sp. JS42
MLDANLQAQLKAYLERLQRPVELVATLDDGATSQELRELLQEIRSLSDKITVVEKNDAPVRKPSFLITNPGVDTGVRFAGVPLGHEFTSLVLALLQVGGHPSKESADLLEQVKNLDGDFHFETYYSLSCHNCPDVVQALNLMSVLNPRITHTAIDGAVFQDEIKERQIMGVPTVFLNGKNFGQGRMELAEIVAKIDSGAHARVAAKLNAMEPFDVLVVGGGPAGAAAAVYAARKGIRTGVVAERFGGQVLDTVDIENYISVSKTEGPKFAIALEQHVNDYDVEVMNLQRAKALKPAATEGGLVEIELDNGATLKSKTVILSTGARWRNMNVPGEEQYRTKGVTYCPHCDGPLFKGKDVAVIGGGNSGVEAAIDLAGIVKSVTVLEFASELKADGVLQKKLRSLPNVTVILNAQTTEVNGDGSKVTGLTYKDRTTDEAKTVAVEGIFVQIGLLPNTDWLKGTVDLTRFGEIIIDARGHTNVPGVFAAGDCTNVPYKQIIIAAGAGATAALSAFDHLIRH

SEQ ID NO: 7241 - protein, 213 aa, Brassica oleracea
MGCFHSKIAREFRGHEDPVKLASETAFSVSEVEALFELFKSISSSVVDDGLIHKEEFQLALFKNRKKENLFANRIFDMFDVKRKGVIDFGDFVRSLNVFHPNASLEDKIDFTFRLYDMDCTGFIERQEVKQMLIALLCESEMKLADETIEIILDKTFEDADVNQDGKIDKLEWSDFVNKNPSLLKIMTLPYLRDITTTFPSFIFNSEVDEIVK

SEQ ID NO: 7242 - protein, 620 aa, Oryza sativa
MKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFVSQKLKSAITTEAETD

SEQ ID NO: 7243 - protein, 567 aa, Rhizobium leguminosarum
MSVATPSREDFAALLEESFAKNDLAEGYVTKGIVTGIEKDVAVVDVGLKVEGRIALKEFGARAKDGLLKVGDEVEVYVERIENALGEAVLSREKARREESWVKLEAKFEAGERVEGVIFNQVKGGFTVDLDGAIAFLPRSQVDIRPIRDVTPLMHNPQPFEILKMDKRRGNIVVSRRTVLEESRAEQRSEIVQNLEEGQVVDGVVKNITDYGAFVDLGGIDGLLHVTDMAWRRVNHPSEILNIGQQVKVQIIRINQETHRISLGMKQLESDPWDGIQAKYPEGKKISGTVTNITDYGAFVELEPGIEGLIHISEMSWTKKNVHPGKILSTSQEVEVVVLEVDPSKRRISLGLKQTLENPWAAFARSHPAGTEVEGEVKNKTEFGLFIGLDGDVDGMVHLSDLDWNRPGEQVIEEFNKGDVVKAVVLDVDVEKERISLGIKQLGKDAVGDAAASGDLRKNAVVSCEVIAVNDGGVEVKLVNHEDITSFIRRADLARDRDEQRPERFSVGQVFDARVTNFSKKDRKIMLSIKALEIAEEKEAVAQFGSSDSGASLGDILGAALKNRGGE

SEQ ID NO: 7244 - protein, 136 aa, Brassica napus
  misc_feature (88)..(88): Xaa can be any naturally occurring amino acid
MARTKQTARKSTGGKAPRKQLATKAARKSAPATGGVKKPHRFRPGTVALREIRKYQKSTELLIRKLPFQRLVREIAQDFKMDLRFQSXAVAALQEAAEAYLVGLFEDTNLCAIHAKRVTIMPKDIQLARRIRGERA

SEQ ID NO: 7245 - protein, 205 aa, Banksia ericifolia
SSFDFMDGYDKPVKGRKINWMKAGILESDRVVTVSPYYAQELLSGIEKGVELDNIIRKTGITGIVNGMDVQEWNPSTDKYIDVKYDATTVFNAKPLLKEALQAEAGLPVDGNIPVIGFIGRLEEQKGSDILAEAISQFIGENVQIVILGTGKKPMEKQIEQLEIKYPGKAIGIAKFNVSLAHMIIAGADFMLIPSRFEPCGLIQL

SEQ ID NO: 7246 - protein, 205 aa, Banksia brownii
SSFDFMDGYDKPVKGRKINWMKAGILESDRVVTVSPYYAQELLSGVEKGVELDNIIRKTGITGIVNGMDVQEWNPSTDKYIDVKYDATTVFNAKPLLKEALQAAAGLPVDGNIPVIGFIGRLEEQKGSDILAEAISQFIGENVQIVILGTGKKPMEKQIEQLEIKYPGKAIGIAKFNVSLAHMIIAGADFMLIPSRFEPCGLIQL

SEQ ID NO: 7247 - protein, 69 aa, Glycine max
  misc_feature (44)..(44): Xaa can be any naturally occurring amino acid
CRNATSAVPAGASMVAPFTGLKYIAVLPTRNTILDFAYIASNGXRAQCMHVWPPIGKKKVETLSYLPDL

SEQ ID NO: 7248 - protein, 545 aa, Vigna unguiculata
MALPHSISALSTTLTLSSSVNKPTTNKVNSFPFLSNKGTQFFTKQTRPRSGRSPLLTPARVAAPPSTVETDQSFPETEKGETEEEFNEESSSSKFTWRDHWYPVSLIEDLNPLLPTPFQLLGREIVRTTSPLPKWVAFDDKCPHRLAPLSEGRIDEDGKLQCSYHGWSFDGCGSCVKIPQAASEGPEARAVGSPKACATRFPTLVSQGLLFVWPDENGWEKASASKPPMLPDEFEKPEFATVNIQRDLFYGYDTLMENVSDPSHIEFAHHKVTGRRDRAKPLPFKMDARGSWGFSGANEGNPKISAKFVAPCYYMNKIEIDTKLPVVGDQKWVVWICSFNVPMAPGKTRSIFSARNFFQFTVPGPAWWQVVPRWYEHWTSNKVYDGDMIVLQGQEKIFLSKTKEGDDINKQYTSITFTPTQADRFVLAFRNWLRRHGNGQPEWFSSIPDLPLPSTVLSKREMLDRLEQHTLKCSSCKEAYEGFQIWQKVLIGATVIFCATSGIPADVQFRVLLAGLAIVSAALAFTLNQLQKNFEFVDYVHAEIE

SEQ ID NO: 7249 - protein, 205 aa, Banksia quercifolia
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAAAGLPVDGNIPVIGFIGRLEEQKGSDILAEAISQFIGENVQIVILGTGKKLLEKQIEQLEIKYPGKAIGIAKFDVSLAHMIIAGADFMLIPSRFEPCGLIQL

SEQ ID NO: 7250 - protein, 686 aa, Unknown
  Lilium hybrid division I
MELLQIENELPWRQFRKQLAATVRDIQWSYAIFWAFSTKQQGVLAWKDGYYNGEIKTRKTTQAVELEDEEMGLQRSEQLRELYGSLSFGDSNHQMKRPSASLSPEDLTDMEWYYVVCMSFTYRPGEWLPGKTLARNQYIWMSNAPSADTELFSRTLLAKSASVQTVVCFPFMGGALELGTSELVLEDPSLIQHVKTCLRETPTPVYSPTSISSSPVTGNGEDNLFPNLNPELVDTIFLDNHILMTECQTPVESYNPGLPFALPSPAPPEEAGLIQDKFDELCEELKFGSPDHSSNIFCPNQHADNTQIIEGINVASLDQGNQLMDNDLTAFCGSLEGGGCISETFLNTRLVPSSLKGERVQNNAVDYFREGDFTKLVSPDLNGGDSHYTRTLHDTLSNSKQLTSTPYFWSNSYESSFSAWKSDLSFPELLGNTYQKLLKKILMDDVGMNSDRSLKPQEDDRLKNKFPKIDVDDASASHVISERRRREKLNEKFLVLKSLVPSITKVDKASILGDTIEYLKELQRRIEELESCRKSVNHDPKGKRKHLDVIERTSDNYGSNKIGNCKRASAGKRKACAIEEAETEHQWTLMKDGPVHVNVTTTDKEAIVELHCPWRDCLLLKIVEAISNLHLDAHSVQSSITEGILALTLRAKHRRSVVTSTAMIRRALQSVISKCVDQESTSERYN

SEQ ID NO: 7251 - protein, 333 aa, Prochlorococcus marinus
MIENKNILITGGNSGIGFFAIVNLLKTKNNLYILIKSEFRKNDFLIRIEKYFEKNYLSKYLNIIENCDLSDLENIKKIKDYLISKNIFLDVVILNAGLQYTGSFYPKVSKQGIELTFAVNHLAHFYLINIIKDFVSNKEESRIIITSSDVHDPKSSGGNIGKKAGLNNLVDFRKKVAGRFLNFNADESYKNSKLCNILFAKELAKKFKISSSKISVITWAPGLVIPDDDSGFFRYSKCFNLFGYFIFSKVAKNILGISESVENAGKILSEIVFDSSFNNIAYIHLSNKLISFKKHKLVAGKVSDEANSSELASKLWIFSEEICRSFGFVAFNI

SEQ ID NO: 7252 - protein, 285 aa, Saccharomyces cerevisiae
NVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 7253 - protein, 680 aa, Unknown
  Lilium hybrid division I
MAAPPCNSLQQLLQTVVQSVDWTYSLFWQLCPREEILVWGGGYYNGAIKTRKTVQSVDVSIEESSLQRSQQLRELYDSLTTAGKAGQPVLRPSAALSPEDLTESEWFYLICVSFSFPPGVGLPGVAFTKRQHVWLSRATEVDRKVFTRAILAKSANIQTVVCIPIMDSGVLELGTTKKVEEDLGLVQHAKSIFNDYLDKHPMPTLSEHSTSNPVAYTDQVLFQSQPFQTTSINLQGSDQEEDDGDDEDDVDGDDNDDDELEAGSDSDTAYNARVLMQSLHPSFTTEAVIPRTEQSELMHIEMSEGIRLGSSEDCSNNLDSELQMFGMGCNSSQSDQHQDDSYQAWHFLHQDLCDGFPQSTGDTLMQDLSQQDAHYSETVSSILHNNSSRWAGSVPISYLSHSWQTAFSKWNSRDQVLQVLSEGTSQRMLKYNMFTVPHLHSRPKDENSLESGVGDGESKFQKGTLQEELSANHVLAERRRREKLNERFIILRSLVPFVTKMDKASILGDTIEYVNQLRRRIQDLEARNRQMGKNQRSKESEVYGPSNSKEHTVQINRSPELPFASSCQTRTSLSDKRKVRVVEGVGRRAKHAEAVESSTNVQVSIIETDALLELSCPYRDGLLLKIMQTLDELRLEVISVQSSSANSTLVAELRAKVKEVQGKKATIVEVKKAIHYIFSQ

SEQ ID NO: 7254 - protein, 231 aa, Triticum aestivum
MLRLSRFLPSTSRGVTDLKDVLWSGSLTFKHALSTSAANVDENASVKKYASYTVFKGKAALSISPILPLFTKVESGGSRVDRNGSVMLTFFPAVGQRKYDYTKKQLFALSPTEVGSLISLGPAESCEFFHDPSMKSSHEGQVKKSLSITPLGSDNGYFVNITVLNNVQKTNERLSVPVTKAEFAVMRTALSFALPHIMGWDQALSTHPQSTSTSASKPRFERPNPASEWDR

SEQ ID NO: 7255 - protein, 197 aa, Banksia dryandroides
YDKPVKGRKINWMKAGILESDRVVTVSPYYAKELLSGIEKGVELDNIIRKTGITGIVNGMDVQEWNPSTDKYIDVKYDATTVFNAKPLLKEALQAAAGLPVDGNIPVIGFIGRLEEQKGSDILAEAISQFIGENVQIVILGTGKMPLEKQIEQLEVKYPGKAIGIAKFNVSLAHMIIAGADFMLIPSRFEPCGLIQL

SEQ ID NO: 7256 - protein, 149 aa, Bacillus cereus
MGYIEELRKVVGTRPLILVGSAIIILNDNQEVLLQYRSDTYDWGVPGGAMELGETTEETARRELFEETGLTAKIMQFLGVLSGKEVYFRYPNGDEIFNVIHLYQAHHVSGELKLDHEGLKLQYFPVDKLPKLNETTEKILQKFLYALTE

SEQ ID NO: 7257 - protein, 311 aa, Helicobacter pylori
MIDCAIIGGGPAGLSAGLYATRGGVKNAVLFEKGMPGGQITGSSEIENYPGVKEVVSGLDFMQPWQEQCFRFGLKHEMTAVQRVSKKDSHFVILAEDGKTFEAKSVIIATGGSPKRTGIKGESEYWGKGVSTCATCDGFFYKNKEVAVLGGGDTAVEEAIYLANICKKVYLIHRRDGFRCAPITLEHAKNNDKIEFLTPYVVEEIKGDASGVSSLSIKNTATNEKRELVVPGFFIFVGYDVNNAVLKQEDNSMLCKCDEYGSIVVDFSMKTNVQGLFAAGDIRIFAPKQVVCAASDGATAALSVISYLEHH

SEQ ID NO: 7258 - protein, 426 aa, Acidobacteria bacterium
MSNRMSQSLNEEDPQIAEAIANEERRQHEGLELIASENFVSEAVLQAAGSVFTNKYAEGYPGKRYYGGCEYADVVENLARDRAKELFGAEHANVQPHSGSSANMEAYGAILQPGDTILGLNLAHGGHLTHGHPLNFSGKTYKIVPYGVTKETETIDYDELEKLALEHHPKVIVGGGSAYPRIFDFKRMREIADKAGALFMVDMAHFAGLVAGGAHPSPVPHAHVVTTTTHKTLRGPRAGMILSKQEFAAAIDKVTFPGMQGGPLVHIIAAKAVCFKEAMEPSFKDYANQVVANAKVLAQSLADQGFRIISGGTDTHLMLIDVFAAGMLGSEAEKALGEAGITVNKNAIPFDTNPPMKPSGVRIGTPALTTRGMKEPEMRQVGIWIAESLRHRTDPDFLGRVRRQVHELCDAYPLYPERRATRLATV

SEQ ID NO: 7259 - protein, 279 aa, Mesorhizobium loti
MDLKDKTILITGSTDGVGRVVAQRLGADGARVLVHGRDAARGKAAVAEIEAAGGRAEFFAADLASLAEIRHLAEAVRARTNRLDILINNAGIGTAAAKRQVSADGYELRFAVNYLAGFLLTSELLPLLKASAPARIVNVASAGQQAIDFGDVMLTHGYSGVRAYCQSKLAQILFTVDLAEQLKGTGVTVNALHPASYMNTTMVRQAGVTPWSSVETGAEAIVNLAASPALEGRSGLYFDGLREARADAQAYDATARQQLRSLSRDLVGAASSKSRERHS

SEQ ID NO: 7260 - protein, 451 aa, Prochlorococcus marinus
MSDATSHEIDHFMKGLMKRNPGEPEFHQAVHEVVETLIPFILSNRVYKDAQILERMTEPDRVVIFRVCWEDDSGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFIKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFTKVADAMLAYGIV

SEQ ID NO: 7261 - protein, 369 aa, Persea americana
MAPTIVPFLPTTTEEKTLRQNFVRDEDERPKVAYNQFSNDIPIISLAGIDSEDGRAEVCKKIVEACEDWGVFQVVDHGVEAGLISEMTRLAREFFTLPAEEKLRYDMSGGKKGGFVVSSHLKGEAVQDWREIVTFFSYPIRSRDYSRWPDKPEGWKEVAQVYSDKLMGLACKLLEVFSEAMGLEKEALTKACVDMDQKMVVNFYPKCPQPDLTLGLKRHTDPGTITLLLQDQVGGLQATKDGRQTWITVQPVEGAFVVNLGDHGHFLSNGRFKNADHQAVVNSNFSRMSIATFQNPAPEAIVYPLAIREGEKPILDEPMTFAEMYRKKMSRDLELANLKKQAKEQQHQQEAEKASLVTIQAKALDDILA

SEQ ID NO: 7262 - protein, 258 aa, Acidobacteria bacterium
MRFVIKVGTSLIAPGGRIDTVLMRALVDQLDLERHEYLIVSSGAIASGMSKLAFSAKPKSVRLMQACAAVGQSLLMYTYEQLFFGKKVVAQLLLSSDDFTSALRYENLQHALHELLKLGVVPIVNENDSVSVRELVGAFGDNDELSALLATAVKADWLVLLTNVDGFYDSAGRGQKLVRTVRRLTPKMEALCGEKSELGTGGMRSKLRAAMMASENGVQVAIANGTAPQAIRNAIERKIGTYFPATKPAPKKRAKAAD

SEQ ID NO: 7263 - protein, 624 aa, Oryza sativa
MVQDEVTEEVPLDPLFNRTGNVWHVFIEGELHNMLYGYRFDGMFAPHCGQYFDVSNVVVDPYAKAVISRGEYGVPGPGGDCWPQMAGMIPLPYSTELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 7264 - protein, 409 aa, Acidobacteria bacterium
MTTREKLEAARRAAPVVAELSTESKNALLLALARTIDERTEEILAANRADLEASGLDGSLRDRLLLTPERIATMAEGLREVAALADPVGETLAEWERPNGLRIRKVRVPLGVVAIIYEARPNVTIDVIGLALKSGNAVVLRGGKEAVRSNECLVKIAGATPGMPDGAIQLLDASNRESVQQLMKARGLVDVIVPRGGAGLIQFVVENSTVPVIETGAGNCHIFVDESANLDMADRIVINAKTQRPSVCNAAEKLLVHRAIAKEYVPRIVKLLLDHGVEVRGDAETLALAQGMQVAEATSADWDEEYLRLCMAVKVVADVDEAIAHINQHSTKHSESIITANDAHARRFLRAADSAAVYWNASTRFTDGAEFGFGAEMGISTQKLHCRGPFALAELTSSKYEVIGSGQVR

SEQ ID NO: 7265 - protein, 252 aa, Unknown
  Synechococcus sp. WH 5701
MFGLFNQAPGAAKGRIVSAEEALPGRDTPIATASTHVVLGTPLQAPLQPGQEEAFFGCGCFWGAEKGFWRLPGVITTAVGYCGGHTPNPTYEEVCSGRTGHTEAVRVVWDTDQVGFADLLKLFWECHDPTQGMAQGNDRGSQYRSAIVASTEAQAELARASRDHYQQQLSAAGFPAITTELLAGKPFFFAETHHQQYLERPGSRPYCSARPTGVRLSAFPGSDFKLPASVWEHYDWSQPHCVLRSPGGPITL

SEQ ID NO: 7266 - protein, 309 aa, Manihot esculenta
CYGMLGNLPPPAEVVSLYNQNGIRRMRIYDPNPDALRALGGSNIELILGLPNDKLQSIASNQAEADSWVQNNVKNHGNVKFRYIAVGNEVKPSAAEAGSLFPAMRNIRNALNSAGLGGIKVSTAIDTIGLTADSFPPSRGSFKPEYRQLLDPVIQFLVNNQSPLLVNLYPYFSYRDSQGTINLDYALFRPAPPVQDPDVGRTYQNLFDAILDTVYAAVEKAGGGALEIVVSESGWPTAGGFGTSVENAKTYNNNLIQKVKNGTPKKPGKPIETYIFAMFDESNKGGEELEKHWGLFSPNKQPKYPVNFN

SEQ ID NO: 7267 - protein, 196 aa, Arabidopsis thaliana
MASEARESPANNPGLSTNRDEATKGYIMQQTMFRIKDPKASLDFYSRVLGMSVMGSYILRYSRLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 7268 - protein, 847 aa, Escherichia coli
MSKVRLAIIGNGMVGHRFIEDLLDKSDAANFDITVFCEEPRIAYDRVHLSSYFSHHTAEELSLVREGFYEKHGIKVLVGERAITINRQEKVIHSSAGRTVFYDKLIMATGSYPWIPPIKGSDTQDCFVYRTIEDLNAIESCARRSKRGAVVGGGLLGLEAAGALKNLGIETHVIEFAPMLMAEQLDQMGGEQLRRKIESMGVRVHTSKNTLEIVQEGVEARKTMRFADGSELEVDFIVFSTGIRPRDKLATQCGLDVAPRGGIVINDSCQTSDPDIYAIGECASWNNRVFGLVAPGYKMAQVAVDHILGSENAFEGADLSAKLKLLGVDVGGIGDAHGRTPGARSYVYLDESKEIYKRLIVSEDNKTLLGAVLVGDTSDYGNLLQLVLNAIELPENPDSLILPAHSGSGKPSIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPEHTPLQDSNDNFLANIQKDGTYSVIPRSPGGEITPEGLMAVGRIAREFNLYTKITGSQRLAMFGAQKDDLPEIWRQLIEAGFETGHAYAKALRMAKTCVGSTWCRYGVGDSVGLGVELENRYKGIRTPHKMKFGVSGCTRECSEAQGKDVGIIATEKGWNLYVCGNGGMKPRHADLLAADIDRETLIKYLDRFMMFYIRTADKLTRTAPWLENLEGGIDYLKAVIIDDKLGLNAHLEEEMARLREAVLCEWTETVNTPSAQTRFKHFINSDKRDPNVQMVPEREQHRPATPYERIPVTLVEDNA

SEQ ID NO: 7269 - protein, 942 aa, Schizosaccharomyces pombe
MSGETVHGISCYSVVANTEDTYNQTLDFYQKLGFKKVASFGTSDSDNARVCNESLREDWMHVAGNNSAESVTIKFRLVPGELSLSPAAEDSEWRGQKSSLVFYYPNLLDLLKQLSADAIKYQAFPNEKKPDEVYVEDPLGNLIGFSDRYNPFAHANLKKSEESGAASNLESGLATPVVETLKKATTSDKPAGVKKKIAVMTSGGDSPGMNAVVRAVARIAIHRGCDAFAIYEGYEGLVQGGDMIKQLQWGDVRGWLAEGGTLIGTARCMAFRERPGRLRAAKNLISAGIDSIIVCGGDGSLTGADIFRSDWPGLVKELEDTKAITPEQAKLYRHLTIVGLVGSIDNDMSSTDVTIGAFSSLHRICEAVDSISSTAISHSRAFIVEVMGRHCGWLAVLAALATGADFVFIPERPAEVGKWQDELCNSLSSVRKLGKRKSIVIVAEGAIDSELNHISPEDIKNLLVERLHLDTRVTTLGHVQRGGIPCAYDRMLATLQGVDAVDAVLASTPDTPSPMIAINGNKINRKPLMEAVKLTHEVADAIEKKQFAHAMELRDPEFADYLHTWEGTTFIEDESHFVPKDERMRVAIIHVGAPAGGMNSATRAAVRYCLNRGHTPLAIDNGFSGFLRHDSIHELSWIDVDEWCIRGGSEIGTNRDTPDLDMGFTAFKFQQHKIDALIIIGGFEAFTALSQLESARVNYPSFRIPMAIIPATISNNVPGTEFSLGCDTCLNAVMEYCDTIKQSASASRRRVFVCEVQGGRSGYIATVGGLITGASAIYTPEDGISLDMLRKDIDHLKATFALEAGRNRAGQLILRNECASKVYTTEVIGNIISEEAHKRFSARTAVPGHVQQGGNPTPMDRARAARLAMRAIRFFETCRANDLGNDPSSAVVIGIRGTGVSFSSVADVENNETEIEMRRPKNAWWRDMHNLVNILAGKTFAD

SEQ ID NO: 7270 - protein, 407 aa, Ralstonia eutropha
MNNVLQQRPRATIVGGSLGGLFAANMLQRNGWDVTIFERTPETLTGRGAGIVTHPELFEALAAAGVAIDDSIGVRIRTRVTLSRDGSTVSDREMPQTLTAWGKMYDVLGHAFSGEYRTGATVTDVDSRSDHAVVKLEDGSTHRADLVIAADGFRSGVRERLVPSAALEYAGYIAWRGLVDEAKISRETHAAIFDKFAFCLPPHEQILGYPVAGDGNSTTPGQRRYNFVWYRATREHDELPDLLTDATGKVWNNGIPPALIRADVLADMESAAADRLAPQFAEIVSSTAQPLFQPIFDLTVPRMAFGRIALLGDAAFVARPHCGMGVTKAAGDAMALVRALAGHESVETALEAYSAERVQVGQAVVEHARHLGAYMQAQLKSEQDREMAERYRTPEAVMRETAVSRRF

SEQ ID NO: 7271 - protein, 234 aa, Nicotiana tabacum
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 7272 - protein, 416 aa, Streptococcus pyogenes
MTDMRRLGQRAKQASLLIAPLSTQIKNRFLSTLAKALVDDTQTLLAANQKDLANAKEHGISDIMMDRLRLTSERIKAIAQGVQQVADLADPIGQVIKGYTNLDGLKILQKRVPLGVIAMIFESRPNVSVDAFSLAFKTNNAIILRGGKDALHSNKALVKLIRQSLEKSGITPDAVQLVEDPSHAVAEELMQATDYVDVLIPRGGAKLIQTVKEKAKVPVIETGVGNVHIYVDAQADLDIATKIVINAKTKRPSVCNAAEGLVIHEAVAARFIPMLEKAINQVQPVEWRADDKALPLFEQAVPAKAEDFETEFLDYIMSVKVVSSLEEAISWINQYTSHHSEAIITRDIKAAETFQDLVDAAAVYVNASTRFTDGFVFGLGAEIGISTQKMHARGPMGLEALTSTKFYINGDGHIRE

SEQ ID NO: 7273 - protein, 273 aa, Streptococcus pyogenes
MMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAYYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVANITQEIIASAGGAGSKFGTGGMLSKVQSAQMVFENKGQMVLMNGANPRDILRVLEGQPLGTWFKQIEEVRHD

SEQ ID NO: 7274 - protein, 860 aa, Glycine max
  misc_feature (335)..(335): Xaa can be any naturally occurring amino acid
  misc_feature (371)..(371): Xaa can be any naturally occurring amino acid
  misc_feature (378)..(378): Xaa can be any naturally occurring amino acid
LDLSLVRSSGGKPNRTSMSCKDGSRNGIGIGMDNGKYVRYTPEQVEALERLYHDCPKPSSIRRLQLIRECPTLSHIDPKQIKVWFQNRRCREKQRKESSRLQAVNRKLTAMNKLLMEEIDRLQKQVSQLVYENGYFRQHTTQNTKQQAIKDTSCESAVRSGQQHNLTTQHPPRDASPAGLLSIAEETLEEFLSKATGTAVEWVQMPGMKPGPDSIGIVAISHGCNGVAARACGLVGLEPTRVAEILKDRPLWFRDCRAVDVLNVLPTANGGTIELLYMQLYAPTTLAPARDFWLLRYTSVLEDSSLVICERSLKNTQNGPSMPPVQHFVRAEMLXNGYLIRPCEGGGSIIHIVDHMNLEPWSVPEVLRPLXESSKVLXQKTTMAALRHLRQISHEVSPSNVSGWGRRPSALRALSQRLSRGFNEALNGFTDEGWTTIGNDGVDDVTILVNSSPDKWLGLNLSFANGFPSVSNAVLCAKASMLLQNVHPAILLRFLREHRSEWADNNMDAYTAAAIKVGPCSFSGSRVGNYGGQVILPLAHTIEHEEFLEVIKLEGVAHSPDDTIMPREMFLLQLCSGMDENAVGTCAELISAPIDASFADDAPLLPSGFRIIPLESGKEASSPNRTLDLASSLDVGPSGNRASDECAGNSSYMRSVMTIAFEFAFESHMQEHVAAMARQYVRSIISSVQRVGLALSPSHLSSHAGLRSPLGTPEAQTLAHWICNSYRCYLGVELLKSNNEGNESLLKSLWHHSDAILCCTLKALPVFTFSNQAGLDMLETTLVALQDIPLEKIFDDHERKILFSEFPQIIQQGFACLQGGICLSSMGRPVSYERVVAWKVLNEEENAHCICFMFMNWSFV

SEQ ID NO: 7275 - protein, 119 aa, Brassica rapa
LMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWVSLA

SEQ ID NO: 7276 - protein, 979 aa, Arabidopsis thaliana
MGLYWAILMSTMNSCPNYLGTVLGCKRVDIACANGFKDPAFTEVVVSVGLEHHLFIMITRPAREIFLTSSSLSFSSMSSSVSWDDAVERSTKESKASSEDTSQQNWELSNASSSKGSDISGVTHVRMQPSSSSQGSEISGLTHLRMQPAPSPPSRLRPVHLMNNGIANYDPGRIPASVFSKNGDVDWSEISNESLFSLKIDGYRKSNAQGSRHSNLKPDEVLMSGEFLRYSPSLVVKPEDAKEKTSEVEEVKNNEETRLQSHNHREKYPSFPDVPLSSIPNNFYCLYAPRTKPVSFSLPVGEKKSMKRKKRRKNKKKKNKKEKKKKKCCTCMWTWLCSVFSKDPYNGWGMNNNFSGHRNKGKSFQSERKRRNSSGCVGCYREHRSTAASLKDPPSNSIARPCKKPSVSEDFWSTSTVDMDNITFPSQGSLSSSNQTFDSQSAARNSNAPPEYVNQGLLLWNQTRERWVGKDKPNNPVDHNQGAKLNWNTATYDSLLGSNKLFPQPIPLTEMVDFLVDIWEQEGIRLVPTRESEPKSIKAKKMFRIVIGLLIWAFSMESSSRRVGIKQKKNIRRENSSGHVPDLNTTLHSTLLSGKQILPYPSMKRRPHWIRVVLKEFYPKRAGTPRKTEIVFVAPTGEEISSRKQLEQYLKAHPGNPVISEFEWTTGETPRRSSRISQKVKATTPTPDKEPLLKKRRSSLTKKDNKEAAEKNEEAAVKENMDVDKDGKTENAEAEKEKEKEGVTEIAEAEKENNEGEKTEAEKVNKEGEKTEAGKEGQTEIAEAEKEKEGEKAEAENKEAEVVRDKKESMEVDTSELEKKAGSGEGAEEPSKVEGLKDTEMKEAQEVVTEADVEKKPAEEKTENKGSVTTEANGEQNVTLGEPNLDADAEADKGKESKEYDEKTTEAEANKENDTQESDEKKTEAAANKENETQESDVKKTEAAVAEEKSNDMKAEDTNRSLEANQVQQQQGAAASVSC

SEQ ID NO: 7277 - protein, 353 aa, Glycine max
  misc_feature (49)..(49): Xaa can be any naturally occurring amino acid
MMALGRGIYVAHNVCFRSELQPMAPDRIGSSTSRQRDLVFVVNPLELGXAGANGRTGKEWRKLVPYLRSRLGKECNICESITSGPCHAIDITREAIREGADAVIAVGGDGTLHEVVNGFFWAGKPVVSQVKESTHSTALGLIPLGTGSDFARTFGWKNDPHEAIERVARGLRSRIDVGVITGESCDHHYFINVADIHLSAKAGFYASRYKRFGNLCYIIGALQAFIGHQNQDLRIRFNDGPWETCPQVTALCIGNAKYFGGGMKITPNADPFSRNLEVVTLQNFKWYDFILKLHKLYSGTHLSVKNVSDRSVLSIEVEDISGKGGIYIQSDGEHLGFLPKKISVVPAAIEMIL

SEQ ID NO: 7278 - protein, 115 aa, Arabidopsis thaliana
MPAAFPSFRMLHKLRRTNDFRSTTTTSFIPRDVTTTKLSSDPSSSNQSPTQLPHETNFAAWLYCLARMGIVKEEDYHSLVARVFVKYLELMRKLQMVYWLEPAGSHGVWGLDDYQ

SEQ ID NO: 7279 - protein, 1269 aa, Streptococcus pneumoniae
MVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 7280 - protein, 392 aa, Mycobacterium avium
MAQREWVEKDFYKELGVSSDASPEEIKRAYRKLARDLHPDANPDNPAAGERFKAVSEAHNVLSDPAKRKEYDETRRLFAGGGFGGRRFDTGGFGGFNVGGDGAEFNLNDLFDAAGRSGGTNIGDLFGGLFGRASGGRPSRPRRGNDLETETQLDFVEAAKGVAMPLRLTSPAPCTNCHGSGARPGTSPKVCPTCNGSGVISRNQGAFGFSEPCTDCRGSGSIIEHPCDECKGTGVTTRTRTINVRIPPGVEDGQRIRLPGQGEAGLRGAPSGDLYVTVHVRPHKVFGRDGDDLTVTVPVSFTELALGSTISVPTLDGKVGVRVPKGTADGRILRVRGRGVPKRSGGHGDLLVTVKVAVPPNLDGAAQEALEAYAAAERASGFDPRAGWAGNR

SEQ ID NO: 7281 - protein, 484 aa, Unknown
  Oceanobacter sp. RED65
MLDTEFLIIGAGFGGIGMAIKLKQQGHNCITLWEKESDLGGCWRDNHYPGAACDVPSHLYSYSFAPNSQWSHKFAPQQEIYDYIKDCADRFKITEHIHFNKEVSEARYDSENNLWRVTDTQGNELRCRYLITATGQLNRPAYPGIAGLESFKGEQFHSARWNHDVDLKDKNVAVIGTGASAIQFVPSVVNKAKHVTLFQRSAPYVIPKPDRPYSKFERWAFKRIPGLLKLSRLKTYLQFEVRFLAFRDLQFLLKPYIAYWRRFMNKQVKDEGKRKKLTPDYIIGCKRILIANNYYPAIDQDHVDLVDSGIAEVTPSGITDKQGNQHDVDVIILATGFKATDFLSPIKIYGQDGISLNNAWKDGAEAYLGMCVNGFPNCFMLYGPNTNLGHSSIIYMLESQINFILKAIDYAKRHDTKTLNVKADIQSKYNDTLQRKIHASVWDQGCTSWYKNESGKNTNNWSGFTLSYRRLTKHFKAKDFATNE

SEQ ID NO: 7282 - protein, 388 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 7283 - protein, 424 aa, Treponema denticola
MSKVLSIILGGGKGTRLYPLTMHRSKPAVPFGGKHRIIDIPLSNCINSGFRNIYIVTQFNSASLHIHIAKAYTFDTFSNGFVEILAAEQTFDNTGWYEGTADSIRKNLHHFRHQNPSHYLILAGDQLYRMDLKKFLNFHKESESDITVACTPVTREDASGFGIMKVNSDSLITEFMEKPGADKNIDDWKIPEKSLIKPNDPNKQYLASMGIYIFSAKIMEECLDSDHTDFGKEVIPAAINGKYKVSAFPHNGYWSDIGTIKSFYDATLDLTEITPKFDFYDAERPIYTHNRNLPPSKVNYAHLSRSICSEGCVITNSTINHSVIGVRSIIETGSFVEDSICMGADYYETHEEKETRLKEGSPGLGIGNHCRIRSAIIDKNVRIGNNVSIGMDQTPPDGDYGFYHVVGGIYVIVKNSVIPDNTSI

SEQ ID NO: 7284 - protein, 106 aa, Flavobacteria bacterium
MALEITDANFEETVLNSEKPVLVDFWAAWCGPCRMVGPIIDEVATDYDGKAVVGKMDVDANQEFAAKYGVRNIPTVLVFQNGEVVGRQVGVAPKNAYTDAIDALLN

SEQ ID NO: 7285 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDAHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 7286 - protein, 205 aa, Banksia nutans
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAAAGLPVDGNIPVIGFIGRLEEQKGSDILAEAISQFIGENVQIVILGTGKKPLEKQIEQLEIKYPGKAIGIAKFNVSLAHMIIAGADFMLIPSRFEPCGLIQL

SEQ ID NO: 7287 - protein, 465 aa, Medicago truncatula
MAKFRFHDFLFGKVPFLLLLLFLSNICFQVATCGSIVKFLPGFQGPLPFVLKTGYVGVGEQEDVQVFYYFIESERNPKEDPLLLWLTGGPGCSALSGLVYEIGPIMFKKEYYNGSVPNLILRPASWTKVSSIIFADLPVSTGFTYATTESGAKRSDLIQVNQAHEFLRKWLVEHPKFQSNEIYIAGDSYSGITIPAIVQEIAQGNEKGLQPKINLQGYVLGNPLTIRKEKNYQIPYAHGMGFLSDELYESLQKNCNGDYTNVDPKNLLCSRDINSYDEVIKGINTAHILDPTECRWLRPENILRRSLIKKYLSRVPPISCPNYPQLLSGYWANNSTVRKALHIREGTIGKWSRRSDRIPYTGDISNSFDYHVNLSDKGYRSLIYSGDHDISIPFLDTKAWIKSLNYSIVDDWRQWHTDGQVAGYTRTYSNGMTFATVKGGGHTAAEYRPEECLAMFSRWISKRPL

SEQ ID NO: 7288 - protein, 205 aa, Banksia tricuspis
SSFDFMDGYDKPVKGRKINWMKAGILESDRVVTVSPYYAQELLSGIEKGVELDNIIRKTGITGIVNGMDVQEWNPSTDKYIDVTYDATTVFNAKPLLKEALQAVAGLPVDGNIPVIGFIGRLEEQKGSDILAEAISQFIGENVQIVILGTGKKPMEKQIEQLEIKYPGKAIGIAKFNVSLAHMIIAGADFMLIPSRFEPCGLIQL

SEQ ID NO: 7289 - protein, 712 aa, Rhizobium leguminosarum
MFDTHTVEIEWAGRPLKLETGKIARQADGAVLATYGETVVLATVVSAKAPKAGQDFFPLTVNYQEKTYAAGKIPGGYFKREGRPSEKETLVSRLIDRPIRPLFPEGYKNDTQVVVTVIQHDLENDPDVLSMVATSAALTLSGVPFMGPVGGARVGYINGEYVLNPHLDEMDESSLDLVVAGTYDAVLMVESEAKELNEDVMLGAVMFGHKGFQPVLDAIIKLAEVAAKEPRDFQPADYSALESEMLGLAEGELRNAYKITQKADRYAAVDAVKAKVKAHFLPEEGEAKYTAEEVGAIFKHLQAKIVRWNILDTKSRIDGRNLETVRPIVSEVGLLPRTHGSALFTRGETQAIVVATLGTGEDEQYVDSLTGMYKERFLLHYNFPPYSVGETGRMGSPGRREIGHGKLAWRAIRPMLPTPEQFPYTLRVVSEITESNGSSSMATVCGTSLALMDAGVPLAKPVAGIAMGLILEGDRFAVLSDILGDEDHLGDMDFKVAGTADGITSLQMDIKITGITEEIMKVALGQAQGGRVHILGEMSKAITESRGQLGEFAPRIEVMNIPVDKIREVIGSGGKVIREIVEKTGAKINIEDDGTVKIASSSGKEIEAARKWIHSIVAEPEIGQVYEGTVVKTADFGAFVNFFGARDGLVHISQLASERVAKTQDVVKEGDKVWVKLLGFDERGKVRLSMKVVDQATGQEIPNEKKKEEAAE

SEQ ID NO: 7290 - protein, 756 aa, Arabidopsis thaliana
MEKQNIISNTSSSSSSWIRGSCVGRGCFGTVSKALSKIDGGLFAVKSIDLATCLPSQAESLENEIVILRSMKSHPNIVRFLGDDVSKEGTASFRNLHLEYSPEGDVANGGIVNETLLRRYVWCLVSALSHVHSNGIVHCDVKSKNVLVFNGGSSVKLADFGSAVEFEKSTIHVSPRGSPLWMAPEVVRREYQGPESDVWSLGCTVIEMLTGKPAWEDHGFDSLSRIGFSNDLPFIPVGLSELGRDFLEKCLKRDRSQRWSCDQLLQHPFLCQDHHDSFFTESSPRCVLDWVNSEFDEEEESDEWRPESMVSAMARISKLAITGGANWESNGWTEVRDTSEESEAKKEVLVSPRVELESYISLESSSDDSVRQPRNEESATELASAVTKYKKLPIPLSVSFSGDILLLRLTLHRLSLDPSFFQIIYAFRICIDSNFDLEIYTTGDCCLRDNHFGNMPGQKIETGHEDIVHDVQMDYYGKRIATASSDCTIKITGVSNNGGSQQLATLTGHRGPVWEVAWAHPKYGSILASCSYDGQVILWKEGNQNQWTQDHVFTDHKSSVNSIAWAPHDIGLSLACGSSDGNISVFTARADGGWDTSRIDQAHPVGVTSVSWAPATAPGALVSSGLLDPVYKLASGGCDNTVKVWKLANGSWKMDCFPALQKHTDWVRDVAWAPNLGLPKSTIASGSQDGKVIIWTVGKEGEQWEGKVLKDFMTPVWRVSWSLTGNLLAVSDGNNNVTVWKEAVDGEWEQVTAVEP

SEQ ID NO: 7291 - protein, 698 aa, Flavobacteria bacterium
MTDVIDVFVPATTQTQVQPAGLKNGINENADGSITFLLAAPGKTDAAVIGDFTNWNLDTNFQMYKDGDYFWVTIPSTYFTTGQTFQYQYIVDYTIKVADPYSGLILDPDSDQYIKPGNFPNLPVYPTGLTTGDVSLYTYQATPYNWTVNNFQKPDKENLVIYELLVRDFSEADSFQEVINRIDYLETLGINTLQLMPINEFEGTDSWGYNPKFHGALDKAYGTPEKFKELVDLCHSKGIAVVIDVVYNHAFSQSPLCQMWWDENNFRPAANNPYLNSSPTHDFNVGYDFNHESQWTRDYVKQTLQYWIDEYRIDGFRFDLSKGFTQNFTLGNIGAWSAYDQSRVDILNDYKNTIWNANSNDIYMILEHLGDNSEETALANAGFMLWGKMTDEFNQNSMGYSSNHDVFRSYYLARGWNDQHLVAYAESHDEQRLMYKNLNFGNAANSSHNVRSLPVALDRQEAIAAILYSIPGPKMLWQFGELGYEIDIDQNGRTGRKPIPWTLNYDTDQDRMDLYDVTATMIGFKTQYPDTWNTTNNNLDVSGVTKRINLDGPVFDVVVVANYGVTAQNVNPNFSQTGTWYEYFSNASMNVTNPTAMINLQPGEYRVYSTQQLQDPLSNIEITDHTESDIKLFPNPAQNSFRLSQDIEHISIVNMNGQQVLEYNENLSTYSIENLNTGVYIINVKTEKGNRRIKLIKQ

SEQ ID NO: 7292 - protein, 256 aa, Zea mays
SARGRPHRPPHVQRLPPRRGHRRRRGHGHVQRHPQGQEEDFPHRLQLPPATSALILPISYTYIAMMGSQGLTDASKIAILNANYMAKRLEKHYPVLFRGVNGTVAHEFIIDLRAFKTTAGIEPEDVAKRLMDYGFHAPTMSWPVPGTLMIEPTESESKAELDRFCDALISIREEIAEIESGKADVLNNVLKGAPHPPQLLMGDTWSKPYSREYAAFPAAWLRGAKFWPTTGRVDNVYGDRNLICTLQQATQVAEEA

SEQ ID NO: 7293 - protein, 205 aa, Banksia pulchella
SSFDFMDGYDKPVKGRKINWMKAGILESDRVVTVSPYYAQELLSGIEKGVELDNIIRKTGITGIVNGMDVQEWNPSTDKYIDVNYDATTVFNAKPLSKEALQAAVGLPVDGNIPVIGFIGRLEEQKGSDILAEAISQFIGENVQIVILGTGKKPLEKQIEQLEIKYPGKAIGIAKFNVSLAHMIISGADFMLIPSRFEPCGLIQL

SEQ ID NO: 7294 - protein, 205 aa, Dryandra foliosissima
SSFDFMDGYDKPVEGRKINWMKAGILESDRVVTVSPYYAQELLSGIEKGVELDNIIRKTGITGIVNGMDVQEWNPSKDKYIDVKYDATTVFNAKPLLKEALQAAVGLPVDGNIPVIGFIGRLEEQKGSDILAEAISQFIGENVQIVILGTGKKPMEKQIEQLEIKYPDKAIGIAKFNVSLAHMIIAGADFMLIPSRFEPCGLIQL

SEQ ID NO: 7295 - protein, 558 aa, Onion yellows
MCSIFGILNIKTDPQILRDQALKLSSLMRHRGPDWSRIFASQKAILAHERLSIIDVNAGAQPLYNKTKTLILAINGEIYNHLDLRKQYKDKYEFQKESDCEVILALYQEKGVNFLDELQGMFAFILYDLTKNTYLIGRDHMGIIPLYMGYYLNQNFYIASEMKALIPICQTLSIFPPGNYLYSESGKMVKYYKRNWMDYQNVYNNQTNTNQLRNFLEASVKKILMSDVPYGVLLSGGLDSSIISGITKKFAKHRIEESSKKEVCFPSLHSFAVGLKGAPDLKAAKEVDNHLGTAHHEINFTIQEGIDALKDVIYHIETYDITTIRASIPMYLMARKIKAMGIKMILSGEGADEIFGGYLYFHKAPNAQEFHKETVRKLASLHLYDCSRANKAMSAWGVEARVPFLDKNFLDVAMRLNPKDKMCGTNGKIEKHILRQTFESYLPKKIVWRQKEQFSDGVGYSWIDALKQLAQTKITDTQLKNAYVRFPYNTPTNKEGYMYREIFEILFPLPSAISLFPGGPSIACCTAKAIEWDKAFKQINDPSGRAALGVHNEAYKDK

SEQ ID NO: 7296 - protein, 205 aa, Dryandra serratuloides
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAAVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7297 - protein, 259 aa, Bacillus cereus
MKVACIQMDIVFGDVEKNIENAKNKISEAMKERPDVIVLPELWTTGYDLTRLSEIADRDGVETKEKLIEWAKRYDVHIVGGSIAKQTEQGVTNTMYVVNNEGQLVNEYSKVHLFQLMDEHKYLIAGNGTGEFKLDDVECAGTICYDIRFPEWMRVHTAKGAKVLFVVAEWPLVRLAHWRLLLQARAVENQCYVVACNRAGKDPNNVFAGHSLIVDPWGEVVVEANEEESILFGELEFEKIKEVRKGIPVFADRRPELYK

SEQ ID NO: 7298 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 7299 - protein, 318 aa, Ralstonia eutropha
MSSSMRDIDERTNLTNNNQFELLLFRLGDAEHTGQSELFGINVFKVREILVMPPVTTVVGADPSILGMADIRGQVIPVIDLPRLVGCKPANGLGILLVTEYARSTQGFAVEAVEEIVRLEWNQVHSAEASVRTGHVTSIAKLDAGTDNARLVQVLDVEQILRDVLPSRQPDVVPEAVGPQLTLPPGTKVIAADDSALARGLIEQSLKALGAPVLMTKSGKEAWDLLDSMAAEAASNGRSIHDEVALVLTDLEMPEMDGFTLTRKIKADSRLKSLPVVIHSSLSGEASEEHVRKVGANAYVAKFVAKELAETLRSVLVH

SEQ ID NO: 7300 - protein, 513 aa, Burkholderia xenovorans
MKVLTVHPSGLMYTRVFLRLEPLGLETVAAVLREAGHEVRLIDLQVETHRDLHRLIRNWQPDAVCFSGNYLANIPEIVDLAKSVKEKQPRCFVFVGGHSVSFTAADILRHAEGAVDCVLKGEGEASVVALLEAASHGADLLQIPGAVTQHGEGPPPHFVESLDPVRPARDLLRHRRKYFIGTLDPCASIEFARGCPWDCTFCSAWTFYGRSYRARSPEVVAGELASIREPGVFIVDDVAFVHADHGMEIGKAVQRRGIRKKYYLETRGDVLLRNREVFEFWRGLGLQYMFIGMEAIDAEGLKAFRKRINLDRNFEALAFARSLGITVAINLIADPDWDHDRFEAVRQWCLEIPEIVNISVNTPYPGTEIWLREQRRLTSLDYRLYDIQHAVLPTRLPLPEFYAELVRTQQVLNRKHLGWTALRGAAGHACHLLLRGQTNFVRMLWRFNSVFNPQLQLNDHAREVHYTMSPPPGITEQRIDVKALYVHGPIGRKGRRIDDATENFVEQTRMGAG

SEQ ID NO: 7301 - protein, 642 aa, Silicibacter pomeroyi
MPELFNSDIEEAPEARLEDTSVMSSISSGDEGDEGNEDNEGNENDEGNEGNEISASTYDDDHNEGNEGNEGNEGVDGQEDDEGNEGDEGNEGNEGNEGNEGDEGNEDDEGDENDENDENDEHNEADEGNEHDEGDENFSIISNNTDGQIDLSEADEGNEFDEGDEDSTYWDFNFDDEYDEGIDANMHEADEGDEGDEGDENNEGNENNEGDEGNEGDEGNEGDEGLINIGLEGDEGNEGNEGDENDEGNEGNENDENDEGDENNEADEGNEFDEGDEDGEFFGRGQEADEGDEGDEDDEDDTFGGLLEEADEGNEGDEGDEDDEGDEDDEGDEGDEGDESQNGDEGDEGDEGDELNDGDEGNEGDEGNEGNEANEGNEGDEDNEGNEGNEGNEGNEGNEANEGNEGDEDNEGNEEDEGNEDNEGNEGNEGSEGNEGDEGDEGNEGNEGNESNEGNEGGLNDEGDEGDENDEGNENDEGDENNEGDEGNEDNEGNEEDEGNEDDEGDEDNEDDEGDEDDEGDEDDEGDESLEPDHPSRHDEGDEGDEDDEGDEDADALLDDEGDEGDEGDENDDGNEGDEDDNLADSGNEDDEGDELNEPDNGDEGDEHDEGNEHDEGDEDDEGDEGDEGDEGDEDDEGDESV

SEQ ID NO: 7302 - protein, 664 aa, Coccidioides immitis
MSVTTVLHPVQHPSIGSLKQQPQMNLPSSDGTLDKFPALDDESHRTPADADVPLSASNFRYSPEPFWLPRKNGTLSHGFPSSRKQRPRKSISEAIGSFKKRSASVSVNAQELAEALKAPVSYRLIGLCIVWYMTSALTNTSSKEILNALPKPITLTIVQFGFVSTCCLLLSYLASVFPTLRSTVPALKNGIRYPTLEVISTALPLALFQLAGHILSSMATSQIPVSLVHTIKGLSPLFTVLAYRVLFRIRYARATYLSLVPLTMGVMLACSAGFSTNFFGILCAFCAALVFVSQNIFSKKLFNESSRIEAEGQALTGRKLDKLNLLCYCSGLAFFLTAPIWFFSEGYPLLMDLLQDGAIDLTEKKGSLDHGPLILEFIFNGMSHFAQNILAFVLLSMISPVSYSVASLIKRVFVVVVAIVWFGNATTPIQAFGIGLTFVGLYLYDRNSHEDAADRRANADHFHIKKTILPLSVRNTNNNNKGWSSNGYAFPPIKEGSPENTKGYISASTGNFKKDDSGPNGRPRKSSAVRPWMPPGTKQESTWQPGDSAKTHPHNYVDGRLLKCILKSEDVATVDWKFQRKPIENNTNRRNDVVLVTRNPPSLPIIPFSSLSPFSSLSYFSPCDIFSSLQDAAAIVPCGGPLEEMVQTQLLPHIRNDCPSSSGG

SEQ ID NO: 7303 - protein, 372 aa, Sesbania rostrata
MDSGLCLVSGLNHKDVQTRFFGPSWLQMQSHVPMNFIWPKECLVNAHEELQAPLVDLDGFLRGDEEATHRAAELISKACLTHGFFQVINHGVDQRLIGEAYNQMDGFFKLPIDRKLSVRKIPGSMWGYSGAHADRFSSKLPWKETLSFPFHDNNSEPVVTNYFNSTLGKTFEQTGVTFQKYCEAMKGLGMKLMELLAISLDVDRFHYKDLFEDGCSIMRCNYYPSCQQPSLALGTGPHCDPTTLTILHQDQVGGLDVFADKKWQTVRPLPHALVVNIGDTFTALSNGRYKSCLHRAVVNQYKERRSLAFFVCPKEDKVVRPPEDIVRRDGTKQYPDFTWSKLLEFTQKYYRADEDTLQNFTKWLLSSKPQTL

SEQ ID NO: 7304 - protein, 72 aa, Campylobacter jejuni
MAKDDVIEIDGTVLEALPNANFKVELDNKHVILCHIAGKMRMHYIRIMPGDKVKVELTPYSLDKGRITFRYK

SEQ ID NO: 7305 - protein, 110 aa, Zinnia elegans
KIWFQNRRARTKLKQTEVDCEFLKRCCENLTEENRRLQKELQELKALKLSPQFYMQMAPPTTLTMCPSCERVGAPPSQKSIDHQHRKLPFYPWPTSASQVVQRQMGALHH

SEQ ID NO: 7306 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 7307 - protein, 238 aa, Nicotiana tabacum
VKPMEEIIPKNTNTITTICSSKPSTHIERKIRPHQKDQALNCPRCNSTNTKFCYYNNYSLSQPRYFCKTCKRYWTEGGSLRSIPIGGGSRKSKKSSSTNCSSSNTVLREFSKNVVAPVLDPPKMEGSQDLNLGFSCDFKTISELIQVPNNSFMPMPISDPNSVYSSLNFSLDYGLGISGDYENNLQDVQDSTTSGRLLFPFEDLKQISNTSIDCAEENRDGESNGYWNAVLGGNGGSW

SEQ ID NO: 7308 - protein, 526 aa, Clarkia similis
VEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKKLKDVIAVGIGGSFLGPLFVHTALQTDPESSKNARGRVLRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNVPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPTDPSTLLPNI

SEQ ID NO: 7309 - protein, 121 aa, Schizosaccharomyces pombe
MRSFALRRSFTSSRILRKVNAVESFGDYNTRISADKVTVVDFYADWCGPCKYLKPFLEKLSEQNQKASFIAVNADKFSDIAQKNGVYALPTMVLFRKGQELDRIVGADVKTLSSLLAKYQE

SEQ ID NO: 7310 - protein, 341 aa, Streptomyces avermitilis
MRIGVLTSGGDCPGLNAVIRSVVHRAVVDHGDEVIGFRDGWKGLLECDYLKLDLDAVSGILARGGTILGSSRVQPAHLRDGVERARGHVAELGLDAIIPIGGEGTLKAARLLSDAGLPIVGVPKTIDNDIAVTDVTFGFDTAVGVATEALDRLKTTAESHQRVLIVEVMGRHTGWIALHSGMAAGAHAIVVPERPFDIEELAAKVGERFEAGKRFAIVVAAEGAKPRAGSMDFDEGKKDVYGHERFAGIARQLSLELEERLGKEARPVILGHVQRGGTPTAYDRVLATRFGWHAVEAVHRGEFGKMTALRGTDIVMVSLAEAVETLKTVPEERYAEAECVL

SEQ ID NO: 7311 - protein, 177 aa, Zea mays
  misc_feature (42)..(42): Xaa can be any naturally occurring amino acid
  misc_feature (63)..(63): Xaa can be any naturally occurring amino acid
  misc_feature (125)..(125): Xaa can be any naturally occurring amino acid
RDSSLSLSLLQWNTTNSLQHHHHSSSSYHRHNLHPQPHVVPXSLSLKHPSSTATFSSLICSSXSSSLFSAALTTNASYVTAQTSTEVNLLATHLTNPDPPPAHEETPPLLIQITGETPAKLGYVXFVSEAKSISAQHLQAIKNLRTKHNHGRIGYSPQRKLRMKVKKDFTRFSIKDK

SEQ ID NO: 7312 - protein, 114 aa, Nicotiana tabacum
MDTAQWPQEIVVKGMEEIIPKSINTITTICSSKPSTHVERKIRPHQKDQALNCPRCNSTNTKFCYYNNYSLSQPRYFCKTCKRYWTEGGSLRSIPVGGGSRKSKKSSSTNSSSS

SEQ ID NO: 7313 - protein, 589 aa, Glycine max
MMTMEKESMENNEKHVTENDPKIDYRGWKAMPFIIGNETFEKLGAIGTLANLLVYLTTVFNLKNITATNIINIFNGSTNFATFIGAFLSDTYFGRYKTIGFCTFTSFLGLLVIQLTAVFKNLHPPHCGKEMKTCKGPTAGQMAFLVSGFGLLLIGAAGVRPCNLAFGADQFNPNTDSGKKGINSFFNWYFFTFTFAQMVSLTLIVYVQSNVSWAIGLGIPAALMLISCVVYFMGSKIYVKVEPSGSPIAGIVQVFVVAVKKRSIKLPAEHPMLSLFNYVPPMSVNSKLPYTFQFRLLDKAAIVTPKDKIKPDGSAADPWNLCSIQQVEEAKCVVRVLPIWFAAIVYHLVIVQMHTLLVFQALQSDRRLGSSNFKIPGASFNVFLMLSMTLWLPIYDRIVVPFSLSNTPEKSGGITLLQSDGIGIFISALCMIVAGVVEEHRRSLALTNPIGVQPRKGAISSMSGLWLIPQLSLAGLSESFTAVGQVEFYYKQFPENMRSIAGSLFYCGMAGSSYLSTLLISIVHNTSEKSATGNWLPEDLNKGRLDFFYYMIAALEIMNLGYFLLCSKWYKYKEIGSSDLELNQVPKHI

SEQ ID NO: 7314 - protein, 992 aa, Kluyveromyces lactis
MNNSVYGVAFRSLSTGDEKLYKEATRFYHSLGFQTVKLYDNFKNHDDSNLIVGTSKNSVKECWLESFKLSELDSQGFRVPQQEASNQLQTDGVMIKLRLVDTEPLNQTADTVVYYTVSLDEVSKIGERVDDHNVKLVDPLGNVVLVTDSHDGKELNASEFIAPKDSSVEQKITVELVDKDSKKKKIAVMTSGGDSQGMNAAVRAVVRSSIYYGCDVYAVYEGYEGLVKGGDYLRKMEWKDVRGWLSEGGTLIGTARSKEFRERWGRKQACSNLIDQGIDALVVIGGDGSLTGADLFRSEWPSLVEELVKDGKFTEDEVALYQNLTIVGMVGSIDNDMSGTDSTIGAYSALERICEMVDYIDATAKSHSRAFVVEVMGRHCGWLGLMSGIATAADYIFIPERAAPHGKWQDELKRVCQRHREKGRRNNTVIVAEGALDDQLNPITAEQVKDVLVELGLDTKITTLGHVQRGGTAVAHDRWLATLQGVDAVKAILNMTPETPSPLIGILENKVIRMPLVESVKLTKQVAAAIEAKDFDKAISLRDTEFIELYSNFMSTTVNDDGSQLLPEADRLNIAIVHVGAPSAALNAATRAATLYCLAHGHRPYAITNGFSGLIQTGQVKELSWIDVEDWHNLGGSEIGTNRSVAAEDMGTIAYHFQKNKFDGVIILGGFEGFKSLKQLRDGRDQYPIFNIPMCLIPATVSNNVPGTEYSLGSDTCLNALVKYTDAIKQSASSTRRRVFVVEVQGGHSGYVASFTGLVTGAVSVYTPENAINLKTIQEDLALLKESFKHEQGETRNGKLVIRNEMASDVYTTELLADIITEQSNDRFGVRTAIPGHVQQGGVPSSKDRVIASRFAVKCVKFIEQWNKKNTAADNEDFKILRFNYVNGVKQYTVLDEDLSAAVICVNGSKISFKPIAHIWENETNIELRKGQEIHWEEYNEIGDILSGRSMLRRKIQKEQQEESSLPSVADTPLSSVTVSTSAAKEDSALYV

SEQ ID NO: 7315 - protein, 178 aa, Alteromonadales bacterium
MSSTTQVATFGGGCFWCIDAAFRRVNGVSDVSSGYTGGNTDNPTYKSVCSGKTGHAEVVKVEFDSTIVSFETLLAMFFTLHDATQLNRQGNDIGTQYRSVVYYHNDEQLALTNTMIEQLQTHVSEPIVTEVSSVTTYYPAEHYHQDYYNENPQQGYCSMLIAPKLHKFETVFKEFLAE

SEQ ID NO: 7316 - protein, 545 aa, Desulfotalea psychrophila
MLCNQCEQTAKGTGCTQIGVCGKTDEVAALQDLLTYSLQGLSIVIQEARRKDLVSTEVKHFITKSVFACLTNVDFDPIRFQQWINASVNIRKDLLRQLGKDIAKRLEGTHPSVSFAPALELTALIQQGQELDLIASLDENEDLRSLKQTILYGLRGLAAYTDHAAILGKEDNTVYIFIFDTLATITRNDLSLEELVDLTLECGQVNLTAMGLLDEGNTGTYGHPVPTTVPLGHIAGKAILVTGHDLKDLQLLLEQTEGKGINIYTHGEMLPCHGYPELKKYSHFYGHYGTAWQNQQKEMALFPGAILFTTNCIQKPRDNYKDNVFTTGLVGWPDVAHIDDGKNFSPVIERALALPGFTEEEDNDTVMVGFGHNAVMGVADKIIAGVKAGKIRHFFLVGGCDGAKPGRNYYTDFVEQVPEDCIVMTLACGKFRFFDKKLGDIDGIPRLLDIGQCNDAFSAIQIAVALAGAFKCDVNELPLSMILSWYEQKAVIILLTLLSLGITDIRLGPTLPAFLTPNVLNLLVEKFAIKPIAETAAEDLKTILG

SEQ ID NO: 7317 - protein, 347 aa, Ralstonia eutropha
MRRSTVRAAMKLTFLGAGAWGTALASHAAANHDVVLWGRDPAQLAAIAATGSNEAYLPGVPLSPRLRVEADFEQAVGHAADDPDGLVVVATPVSGLREMTRRLAGRGNGHVRMLWLCKGFEAGTHALPHQMVREELDAAGRTSGFDYGVLTGPSFAREVALGLPCALTVAGSVPTLADCAQAAFHHHAMRIYGSDDLTGVEVGGAVKNVLAIATGASDGLGLGLNARAALVTRGLAEMTRLGLALGGRAETFMGLAGVGDLILTATGDLSRNRKVGQQLAAGQSLDQILASLGHVAEGVRCAQAVAALAEACKIEMPITRAVCAVLFEGLSAADAVAQLLQRDARDE

SEQ ID NO: 7318 - protein, 469 aa, Medicago truncatula
MTKLSSTYGKVHLLSILLLLSNICFQVATCGSIVKFLPGFQGPLPFALETGYVGVGEKEDVQVFYYFIESEKNPKDDPLILWLTGGPGCSALSGLMLEIGPLELKKEEYNGSLPNLILRQHSWTKVSSIIFVDLPVSTGFTYATTESGTKRSDSILVHQTYQFLRKWLVDHPKFQSNEVYIAGDSYSGIPIPVIVQKIAEGNEKGVQPWINLQGYLLGNAAITGKEKNYVIPFAHGMGLISDELYDSLQKNCNGDYINVETRNVLCSRDISSFDEVTSGIHEPHILEPSCEWLDNTENSPRRSLINKDPTNFLNTNLKLPLLSCRSYTYFLMGYWANDDNVRKALHIQKGSVAKWHRCTFNIPHKKDIPNSYDYLVNLSRKGIRSLIYSGDHDMKIPFLATQAWIRSLNYSIVDDWRQWHTNDQVAGYTRTYSNQMTFATVKGGGHTAPEYRPKECFDMFSRWISKRAL

SEQ ID NO: 7319 - protein, 488 aa, Bacillus halodurans
MMNKDQALIFELSKPGRVGHSLPELDVLEQPVETLIPAEFLREEAPELPEVSELQLMRHYTALSKRNHGVDSGFYPLGSCTMKYNPKINEDVARYPGFANIHPYQPEAQVQGALRLMYELQTALAEITGMDEVTLQPAAGAQGEWTGLMLIRAYHEANGDTNRTKVIVPDSAHGTNPASATVAGFESVTVRTDEDGLVDLDHLREVVGEDTAALMLTNPNTLGLFEAHIVEMAAIIHEAGGKLYYDGANSNAILGIARPGDMGFDVVHLNLHKTFTGPHGGGGPGSGPVGVKKELIPYLPKPVVVKDGDSYRLDYDRPHSIGRVKPYYGNFGINVRAYTYIRTMGPEGLRTVSEYAVLNANYMMRRLAPYFDLPYDQHCKHEFVLSGRQQKKLGVRTLDIAKRLLDFGYHPPTIYFPLNVEECLMIEPTETESKETLDEFIEAMIQIAKEAEETPEVVQEAPHHTVIGRLDETTAARKPILRYEKITQ

SEQ ID NO: 7320 - protein, 409 aa, Mycobacterium leprae [sequence omitted]

SEQ ID NO: 7321 - protein, 750 aa, Saccharomyces cerevisiae
MPAPKLTEKSASSKSTQKTTNYSSIEAKSIYQEPSATKKILYSIATWLLYNIFHCFFREIRGRGSFKVPQQGPVIFVAAPHANQFVDPVILMGEVKKSVNRRVSFLIAESSLKQPPIGFLASFFMAIGVVRPQDNLKPAEGTIRVDPTDYKRVIGHDTHFLTDCMPKGLIGLPKSMGFGEIQSIESDTSLTLRKEFKMAKPEIKTALLTGTTYKYAAKVDQSCVYHRVFEHLAHNNCIGIFPEGGSHDRTNLLPLKAGVAIMALGCMDRHPDVNVKIVPCGMNYFHPHKFRSRAVVEFGDPIEIPKELVAKYHNSETNRDAVKELLDTISKGLQSVTVTCSDYETLMVVQTIRRLYMTQFSTKLPLPLIVEMNRRMVKGYEFYRNDPKIADLTKDIMAYNAALRHYNLPDHLVEEAKVNFAKNLGLVFFRSIGLCILFSLAMPGIIMFSPVFILAKRISQEKARTALSKSTVKIKANDVIATWKILIGMGFAPLLYIFWSVLITYYLRHKPWNKIYVFSGSYISCVIVTYSALIVGDIGMDGFKSLRPLVLSLTSPKGLQKLQKNRRNLAERIIEVVNNFGSELFPDFDSAALREEFDVIDEEEEDRKTSELNRRKMLRKQKIKRQEKDSSSPIISQRDNHDAYEHHNQDSDGVSLVNSDNSLSNIPLFSSTFHRKSESSLASTSVAPSSSSEFEVENEILEEKNGLASKIAQAVLNKRIGENTAREEEEEEEEEEEEEEEEEEGKEGDA

SEQ ID NO: 7322 - protein, 419 aa, Medicago truncatula
MTKFSSTYGKILLSVFLLLSNISFQVATCGSIVKFLPGFQGPLPFVLETGYVGVGEKEDVQVFYYFIESEKNPKDDPLILWLTGGPGCSALSGLMLEIGPLEFKKEEYNGSLPNLILKPHSWTKVSSIIFVDLPVSTGFTYATTEESGAKRSDWILVHQTYQFLRKWLVDHPKFQSNEVYIAGDSYSGIPIPVVVQEIAQGNEKGVQPWINLQGYILGNGVTTRKERNYAIPFAHGMGLISDELYESLQKNCNGDYVNAETRNVLCSKDINSFSESYSYFLMGFWANDDNVRKALHIRKGSIGKWHRCTYNIRHNADIPNSYDYHVNLSRKGIRSLIYNGDHDMTVPFLATQAWIRSLNYSIVDDWRQWYTDDQVAGYTRTYSNQMTFATVKGGGHTAPEFRPKECFDMFSRWISKRAL

SEQ ID NO: 7323 - protein, 447 aa, Bacillus halodurans
MNHRYLPMTTDDRQEMLQAIGVDSIEELFSDIPQDIRFKGKLNIPNALKEPELIRYFQQLANENVHLKDKASFLGAGVYDHYIPSIVDHVISRSEFYTAYTPYQPEISQGELQAIFEFQTMICELTGMEVANSSMYDGPTALAEAAMMSCGHTKKKKILVSKAVHPEARDVLMTNAYGQRLEVVEIDTNNGVTDVEHLKALYDEETACVIVQHPNFFGRLEPLAEIESVSHQGKATFVVSSNPLALGLLKPPGAFGADVVVGDAQPFGIPTQYGGPHCGYFATTKKLMRKVPGRLVGQTTDDQGQRGFVLTLQAREQHIRREKATSNICSNQALNALAAAVAMATIGKRGVKEMALQNVQKAAYAKSQLKANGVEIVAEGPCFNEFIIKLSSPLHEVEEALLAKGFIAGYDLGKVYPELEGHMLVAVTEVRTKEEIDQFAKEVGMFA

SEQ ID NO: 7324 - protein, 301 aa, Unknown
  Acidovorax sp. JS42
MKTYPTIEDAIGHTPLVALQRIGAQDNAARGNVILGKLEGNNPAGSVKDRPALSMIRRAEERGEIKTGDTLIEATSGNTGIALAMAAAIKGYRMVLIMPEDLSVERAQTMKAFGAELVLTPKSGGMEYARDLADQMVAQGKGVVLDQFANPDNPRIHYETTGPELWEQTEGRITHFVSAMGTTGTITGVARFLREKNPAVRIVGAQPQEGSRIPGIRKWPEEYLPKIYEPQLVDELVLVSQDDAEDMARRLAREEGIFAGISAAGACWVAQQIAQREENATIVFVVCDRGDRYLSTGVFPA

SEQ ID NO: 7325 - protein, 486 aa, Flavobacteria bacterium
MQKPKLGFWNIWNMSFGFLGIQFGFALQGSTMSRIFETLGANKDEIPLLWIAAPLAGLIVQPIIGYLSDNTWHKNLGRRRPFFLIGAILSSIALLFMPYSSEVWMAAGLLLVLDASINISMEPFRALVADKLPESQRSYGFVVQTLIIGVGTWVASNLPKWVNDTLEISNEAPSGVVPDSVKVAFGVGAFVFITAILVTIFTTKEYSPEELAQFDDAEKEPEEKKGMWETISGTYALMPLIMKKLGVVQFFSWFAFFAMWTLANPALTSHIYNAPKPDVIEFAKTTTDDNGELITMRDANDEVVFLNDAKALEYKQQDKSYNEASDDVGSKMGIYGLTSMLFALGLTFYTAYNSINRKYIHMASLILGGLGFLYMFFIPGEPDKLLVSFSLIGIAWGSILSMPYAMLSSSVESHKMGLMMGVFNMFIVIPQIIAAIGGVVFLQKLIGEESIHAMTIAGIFLIIAAFSNLLIINKKAITYQPSIDNE

SEQ ID NO: 7326 - protein, 205 aa, Dryandra calophylla
SSFDFMDGYDKPVEGRKINWMKAGILESDRVVTVSPYYAQELLSGIEKGVELDNIIRKTGITGIVNGMDVQEWNPSKDKYIDVKYDATTVFNAKPLLKEALQAAVGLPVDGNIPVIGFIGRLEEQKGSDILAEAISQFIGENVQIVILGTGKKPLEKQIEQLEIKYPGKAIGIAKFNVSLAHMIIAGADFMLIPSRFEPCGLIQL

SEQ ID NO: 7327 - protein, 88 aa, Chromobacterium violaceum
MSKEDMIELEGVVIEMLPESRFRVRLDNNMEILAYGSGKMKMHRIRVLLGDRVTVEMSPYDLTKGRINFRHPTANPGAGPRPSHHHRR

SEQ ID NO: 7328 - protein, 523 aa, Unknown
  Rhodococcus sp. RHA1
MTTTAAEPNTSTTRALGGRARAFLLAAVAACAACGLIYELALLTLSVSLTGGGITQTSLIVAGFVAALGVGALAAKPLLSTAAASFVVVEIVLGLVGGFSAVTLYVTFTFFGSSAIVLVLATALIGVLVGAEVPLLMTLLQSGRNDTDAESTGKVLANLNAADYAGALVGGLLWPFVLLPIAGMIRGAAITGIINLVAAAVVALILLRWQLSLRTRLFAVVALLVAAACIAVLLVRADGIETTSRQRLYTDPVVAAERSQYQEIVVTERGGDVRLFLDGDLQFSSIDEHRYTESLVYPAMADDPKRVLILGGGDGLAAREVLRLPGVEEIVQVELDPAVIELANTRLSGLNQGALQDPRVHVVLDDAFRWLRDAPDSGFDAVIVDLPDPDTPALGRLYSTEFYGLAAAALNPGGLMVVQSGSPYSTPDAYWRTTSTVASAGLAVTPYHVLVPSFGDWGYVLARRGPEPPALRLPRDVPELRFLDEPTLAASAIFPRDRPRRELEPSTLDRPRIVDDMRKGYER

SEQ ID NO: 7329 - protein, 205 aa, Dryandra sessilis
SSFDFMDGYDKPVEGRKINWMKAGILESDRVVTVSPYYAKELLSGIEKGVELDNIIRKTGITGIVNGMDVQEWNPSTDKYIDVKYDATTVFNAKPLLKEALQAAVGLPVDGKIPVIGFIGRLEEQKGSDILAEAISQFIGENVQIVILGTGKKPMEKQIEQLEIKYPDKAIGIAKFNVSLAHMIIAGADFMLIPSRFEPCGLIQL

SEQ ID NO: 7330 - protein, 480 aa, Flavobacteria bacterium
MKKSTSQWLLLLCVALSFFACKDAASDQEQVIIEETASVLAPITNADLENAVIYEANIRQYSEKGTFNEFTKDIPELKKLGVKVIWLMPVFPISEKNRKAKGDLMVEDIKDPIERAKYLGSYYAVANYEKVNPDLGTEKDLKKLVETAHDNGMYVILDWVANHTGWDNLWIEKHPDFYTKDEKGNIIHPKGTDWTDTADLNYENKKLWDAMASSMIHWVETYDVDGFRCDVAHEVPTEFWNYAVKSIKDVKPVFMLAESEKKDLFIDAFDMGYNWEGHHIMNELAQGKTDVSAWDEYMLRVEENYQEDDILMNFITNHDENSWNGSVTERMGEASEAMLAFQYVIPGMPLIYSGQEYGMTERLKFFEKDQIPHEKGKVWDMMEKLGALKATNPALNGGKEAASYKRINTSEDSKIYAIERQKDDHKVIFVANFSNEPVEFKAPTIVGQLTDAVRGSESNIPANYTFTFPPFGYRVWEVRK

SEQ ID NO: 7331 - protein, 129 aa, Prochlorococcus marinus
MRILHTMLRVGDLDKSINFYVNRLGMNLLRKKDYPHGKFTLAFVGYGSEKENAVIELTYNWDKKSDDYELGDKYGHIAIGVKDIHLICQGLENNGCKVTTKPKTMKNSTTVLAFIEDPDGYKIELIERD

SEQ ID NO: 7332 - protein, 575 aa, Coprinopsis cinerea
MCGIFAAHGLEKPSQDRARCIALAKRLRHRGPDWSGCYVGQQSVLVHERLAIVGVESGAQPLVSEDGKQILAVNGEIYNHVALREHVGRDIKFKTNSDCEVVLPLYKKYGTELCGMLDGMFSFVLLDESVTPSRIIAARDPIGITTLYQGWSSQRPGAVFFASELKALVDDCDEIISFPPGHVYDSADKTTTRYYKPSWWNGDLDGPEATIPTTKADLTLIRETLEAAVRKRLMSEVPYGVLLSGGLDSSLIAAVAARETEKVAKAQYELRQRKLQEASSGPPSPSGSGLVTEEATLAAWPQLHSFSIGLENSPDLLAARKAAHFLGTVHHEYVFTVQEGLDALPEVIYHLETYDVTTVRASTPMYLLSRKIKAMGVKMVLSGEGSDEIFGGYLYFHAAPDARSTMAWGLEARVPFLDKAFLDVAMNVDPKEKMFSKGSTQEVDEDGCPRMEKYILRKAFDCSPDGKPYLPRSILWRQKEQFSDGVGYSWIDGMKQHAEDTITDEQFAKGAERWPEDTPATKEAYLIRQIFDDLFPSPAAAKTAVRWIPRGDWGCSSDPSGRSVSIHNAAYSVDD

SEQ ID NO: 7333 - protein, 205 aa, Dryandra speciosa
SSFDFMDGYDKPVEGRKINWMKAGILESDRVVTVSPYYAQELLSGIEKGVELDNIIRKTGITGIVNGMDVQEWNPSTDKYIDVKYDATTVFNAKPLLKEALQAEVGLPVDGNIPVIGFIGRLEEQKGSDILAEAISQFIGENVQIVILGTGKKPLEEQIEQLEIKYPDKAIGIAKFNVSLAHMIIAGADFMLIPSRFEPCGLIQL

SEQ ID NO: 7334 - protein, 873 aa, Unknown
  Oceanobacter sp. RED65
MLINATQSEELRVALVDGQRLYDLDIEPTTRQQKKANIYKGKITRVEPSLEAAFVDFGAERHGFLPLKEISREYFKQSTSGRPNIKDVIEEGQEVVVQVDKEERGNKGAALTTMISLAGRYLVLMPNNARAGGISRRIEGDERNQIRDAMRDVNVPNNMGVIVRTAGIGRASEELQWDLDYLCQLWDAIKGAYDRRDAPCLLLQESNVVIRAIRDYLRQDIGEVLIDDPVVYDEALSFVQAVMPQYENKIKLYQDSTPLFSRYQIEAQIETAYQREVKLPSGGSIVIDTTEALISIDINSSRSTKGSDIEDTALNTNLEAADEIARQLRLRDIGGLIVIDFIDMTSNKNQREVENRMKDALEIDRARVQVGRISRFGLLEMSRQRLRPSLGETSGHVCPRCDGTGTIRDMRSLALSLLRLIEEEAAKENTAQVRAVVPLEVSSFLSNDKRQDIIAIESRHSAEISIIPNPNFQTPHFEVLRVREGESVADQVSFEIMYEEELATEATPPVRETAAVKAVATTRAPSPKETKEPGLLSKIGSAISGLFSSEEEPKKKTSNNRSNSNRSNSGNKNRNNGNRNNNRRNQSDNRNQSNGGRNNNQRNGKTNNRRQENTSKPDAANKQDKKPNNNSEKSNDKPKQQARRRNRSNKQQAPLDDKVARKIEAVEQPKSSTNKVEEPKAKAKPDAKKQSEAKPTNKANSTPEKTEKVETKHSTQVQTAEQPKAEKDSTAKPAIESNTITDNVGSEQPFATEESFVKEAPQAESTIASPAQSIADTATTETPKAKQEEAQVVESKPEPVAAEKSEAPKAEPVQEKSEPKVETEQVAAEKPDTNSETETKTADTAPKRAPNDPREVRRRQLEAQAQAQQEAES

SEQ ID NO: 7335 - protein, 911 aa, Zea mays
MAFKGLPRDSRGSLEVFNPDAPVSDRATTSPFLLPPAVASHPSLLAAGDGGDADVGRATQRAAEWGLVLQTDEHTGRPQGVVARPSGSNRTSESGNSIDERAAAAGAGRALPRVSEELRAALSAFQQTFVVSDATRPDHPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGNKDTALRPNGLPESLIKYDARQKDHARSSVSELLLALKDPRSLSESRNNTLKRKSQESAGSALVPGKRSSETGSRRNSHSGMRNSLQKISEVPEGGNKTRKSGLRSFMGLIGMGHGNVEKNILKPREDPLLDSDDERPDSFDDDFRKKEMRKGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGDVQYFIGVQLDGTERVREAAAKDGAILVKKTADNIDEAAKELPDANLRPEDLWANHSKPVLPKPHMKDTASWRAIQKVLENGESIDLKHFRPVRPLGSGDTGSVHLVELLGTGEYFAMKAMDKSVMLNRNKVHRATAERQILDMLDHPFLPTLYASFQTKTHICLIVDYCAGGELFMLLDRQPMKVLKEDAVRFYAAEVVTALEYLHCQGIIYRDLKPENILLHRDGHISLTDFDLSCLTSCRPQVFLPHDIDKKKKRRKSRSNPIFFAEPMRASNSFVGTEEYIAPEIITGAGHTSAVDWWALGILLYEMLYGYTPFRGKTRQRTFANILHKDIRFPASIQVSLAARQLIYRLLHRDPANRLGSYEGAMEIKQHPFFRGINWALVRAATPPELEAPLQDTLEATLPPPAADAAHTDMF

SEQ ID NO: 7336 - protein, 84 aa, Glycine max
HAYEGFKITVTDPDTALRTITREAKETGPDCQEVTKVEPAESEEVKDSFVNNIKRPMTPQPLKIKAYIEMKCLQFKRVLPIKEA

SEQ ID NO: 7337 - protein, 516 aa, Clarkia similis
RQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 7338 - protein, 382 aa, Haemophilus influenzae
MAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 7339 - protein, 527 aa, Clarkia similis
VEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGCPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 7340 - protein, 141 aa, Bordetella pertussis
MTTTRVQPISEPLDTSKTVFDMLGGEPGVRELVDRFYDLMDMESDFKALRDAHGPSLEQARDKLFWFLCGYFGGPDHYIERFGHPRLRARHLPFSIGEIERDQWVACMGRAMQDQQLPAALVDRLLQAFYGTADWMRNRAG

SEQ ID NO: 7341 - protein, 379 aa, Staphylococcus aureus
MAKRDYYEVLGISKDASKDEIKKAYRKLSKKYHPDINKEEGADEKFKEISEAYEVLSDDNKRATIDQFGHDGPQGFGGQGFNGSDFGGFSGFGGGGFEDIFSSFFGGGSQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 7342 - protein, 468 aa, Sinorhizobium meliloti
MEVPLPLFIVHHQHSPETCPARDPAKGTMLLNHLSRPSAARHGVLIKGEAVAQGSHSLFFIAEAADEAILQAFLAPLRQAGNVEVTAAMTCAAMVSSGGCEERPVDVSAEVLDPADACQDAVEAGLLIHSVNPLNGETSVPDLAGGAVMPNGRFYLRNHFDIPNLGGDNYRLSIGGLVERPLKLSMRELHNLHAESQVVTLECAGNGRSLFDPAVPGEAWGLGAVSTAEWTGVRLMEVLERAGLRAGATELTFRGADSGVVDGHDAPVRFERGLSLDQIRETDALLAYEMNGETLSPPHGYPLRLIVPGWYAVASVKWLTEIVVTDQPCEAYYQAEKYWYHWVRNGHDERAQVRLMNVRALISSPEEGENLPRGDTAIRGVAWSGAGNISRVDVSLNGSRWREARLVGERRRSAWQWWELITRLEETGPLTVRARATDMTGRTQPEHAEWNRLGYGNNSIHSVAARVI

SEQ ID NO: 7343 - protein, 755 aa, Phaseolus vulgaris
MECEVKLKGGDLHAEGVTETNAVGFDAMEDEQTLSVAEREMWLNSDQDEFLGVNEASMFYADFPPLPDFPCMSSSSSSSSAAPLPLKTTTCSTTTTATTATSSSSSSSSWAVLKSDVEEDVEKNHCNGSMQDQFDATALSSTASMGISQQQNPDPGLGGSVGECMEDVMDTFGYMELLEANDFFDPASIFQNEESEDPLIEFGVLEEQVSLQEEQHEMVHQQENTEEDRKVPVCGVIKGEEEGGGGGGGRVVDDEMSNVFLEWLKSNKDSVSANDLRNVKLKKATIESAAKRLGGGKEAMKQLLKLILEWVQTSHLQNKRRKENGSNNSNALQAQFQDPSAQTKENAHTSGSFAPESNSCFNNQTPWLNPQTFGTDQAPVMVPSQPYSQPVVGYVGDPYTSGSAPNNITVNHNHNNNPYQPGTDQYHMLESAHSWPHSQFNVASHYSQSYGENGLFTHGGFGGYANNQYPYQFFHGPGDRLMRLGPSATKEARKKRMARQRRFLSHHRNHNGNHLQNQGSDPHARLGNDNCTTGLVAPHQPNSAAANWMYWQAMTGGPGGPLAPVVPADPLAGQTVVDRTTMHTQNSHQNRAASDRRQGWKPEKNLRFLVQKVLKQSDVGKLGEIVLPKKEAETHLPELEARDGISITMEDIGTSRVWNMRYRYWPNNKSRMYLLENTGDFVRANGLQEGDFIVIYSDVKCGKYMIRGVKVRQQGVKPETKKAGKSQKNQHGTNASNTAGTAANNGRSSATETKS

SEQ ID NO: 7344 - protein, 240 aa, Brucella melitensis
MSKAGGNKGGSRTGGRGGAGSSNLHVRVKKKAGTIKESSRRWLERHLNDPYVHKSRQDGYRSRAAYKLIEINDRYNLLKKGQKIIDLGAAPGGWSQIAARIVGSTDENPQVVGIDYLHVDPLPGVILLEMDFLDDEAPQKLMDALGDKPDLVISDMAAPTTGHRRTDHLRTVHLCEVAADFAVSVLKPGGHFLTKTFQGGTENELLALLKQKFRSVHHVKPPASRAESVELYLLARDFKG

SEQ ID NO: 7345 - protein, 501 aa, Clarkia unguiculata
MASPALISETEAWKDLKAHLEGIKMTHLRELMGDTERCQSMMVEFDNIFLDYSRQQASPDTISKLYKLADAAYLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALTYGKTPEQLKKENVSEHLIPHKTFTGNRPSISILLPTLDAYRIGQLLAIYEHRVAVQGFV

SEQ ID NO: 7346 - protein, 364 aa, Unknown
  delta proteobacterium MLMS-1
MKKIVISTGGGDAPGLNAVIYAVTKSAYRRGWEIYGSKSGYRGLLDPDELIRLTPEKVEDIMPLGGTILGSTNKGDPFAMPVENLAGEIQTLDLSDRIMRNFRRLGFFCHIAVGGDGSLEIAHRFAVEKGMPVIGVPKTIDNDLEATQRTFGFDTAVSTATDALDKLHSTAKSHDRVMVVELMGRDSGWIALNAGISGGADVILIPEVPFDMNVVCQKINDNDLRDKNYSIVVVAEGAKAASMKKALCKKKVELGRSEELLGGIGDWVAEQIRCQTGKDTRSLTLGHLQRGGSPTTFDRLLALRFGGAAVRMAEQELFDHMVALKTPDMVPVPLAEAIKSRKKVQLDSDKLLTAREIGICFGDA

SEQ ID NO: 7347 - protein, 198 aa, Ashbya gossypii
MAAERVAQSEDKLTASGSDDEALDELLESLENDDSFLDRYREQRTEQLAQHFREARQNAASGDYGQLHTLEDEGALLALSTRTARVVIHFYLETFPRCQTMDSKLRKLAAKHMHTRFVRISVEKCPFLVQRLGIKVLPCVISYRDGLERDRLVGFQDLGNQPEDFPLAALERRLASIGMLPSGADALTVNRIDRDHDY

SEQ ID NO: 7348 - protein, 255 aa, Humulus lupulus
MASSAPATALRTISSSSPKLHNTRSPFSSSLSPPKSSLSFTKVLSPALISTPKLQITSNPSSKTYITCRSQASPSESEKPIKVHELRVYEINERDRSSPAYLRLSQKEVNSLGDLVPFSNKLYTGCLQKRIGITAGICILIQNKAEKKGDRYEAIYSFYFGDYGHLSVQGSYMTYEDTYLAVTGGSGIFEGAYGQVKLQQLIFPFKLFYTFYLKGIKEDLPEELLGVHVEPSPSVEPSPAAKACEAHAVIQSFTD

SEQ ID NO: 7349 - protein, 236 aa, Glycine max
MTKRYWNIILEEMMEAGVHFGHGTRKWNPKMSPYISAKRKGIHITNLIRTARFLSEACDLVFDAASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 7350 - protein, 380 aa, Clarkia unguiculata
MATPSLISETETWKDLKAHLEGIKKTHLRELMGDTERCQSMMVEFDNIFLDYSRQQASPDTINKLYKLADEAHLKQKIDRMYNGDHINSTENRSVLHVALRAPRNSAICSDGKNVVPDVWNVLDKIKDFSERVRSGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 7351 - protein, 222 aa, Unknown
  Synechocystis sp. PCC 6803
MGFFDLFGKKTAMVAPNEALPGRSATMPVPDKHFVNGNPLKAPFPQGMETALFGLGCFWGAERKFWQIPGVYSTAVGYAAGYTPNPTYQEVCTGMTGHNEVVLVAFDPQQVSYDQLLKVFWESHNPTQGMRQGNDVGTQYRSGIYTYSEAQQQAALASKQAYQQALQQAGYGEITTEILPAPDFYYAEDYHQQYLAKNPNGYCGLGGTNVACPIGTEVSLGA

SEQ ID NO: 7352 - protein, 112 aa, Kineococcus radiotolerans
MKLLTAIIKPHKLDDVKSALESYGIQGLTISEASGYGRQRGHTEVYRGAEYTVDLVPKVRVEVLVDDVDIADVVEVVVKSAQTGRIGDGKVWTQHVEDVVRVRTGEHGPDAL

SEQ ID NO: 7353 - protein, 254 aa, Humulus lupulus
MASAGPATALRTISSSSPKLHNTRSPFSSSLPPPKSSLSFTKALSPSLVSTPKLQITSNPSSKTLFTCRSQASPSESETPTKVQELHVYEINERDRSSPAYLRLSKKEVNSLGDLVPFSNKLYTGCLQKRIGITAGICILIQNKAENKGDRYEAIYSFYFGDYGHLAVQGSYLTYEDTYLAVTGGSGIFEGVSGQVKLHQLIFPFKLFYTFYLKGIKDLPEELLGVHVEPSPAVEPSPAAKACEDHAAIKSFTD

SEQ ID NO: 7354 - protein, 370 aa, Idiomarina loihiensis
MSFRLIIVIVGLLVSCFSMAQNSEPTKQKNEKVATFAGGCFWCVEEAFEQMPGVREVISGFSGGDEVNPTYEEVSAGKTGHTEAAQIYYNPDVVSYAALLQKLWRISDPTDNDGQFVDRGKQYRPAVFYHNDEQKRIAMESREWLDKNGPFPDPVVIEITPFKSFYKAEEYHQDYYDKNPVRYRIYTYNSGRYDFVEKHWGDTSDVDYQQFTNDNPTGKAEQQSFVKPSDSELKKRLTDIQYAVTQEDQTEPAFDNRYWDNERKGIYVDVVSGEPLFSSADKYESGTGWPSFTKPISPDAVVEKDDSSWFYTRTEIRSRKADSHVGHVFNDGPPPTGLRYCMNSAALRFIPLEKMEEEGYGDYIPAVTDD

SEQ ID NO: 7355 - protein, 396 aa, Carboxydothermus hydrogenoformans
MGVKISDSVTYVGKIDWELRRFHGEELSTHRGSSYNSYLIRDEKVALIDTAWIKFDKEYVKKLSEEIDLNKIDYVVALHGEIDHSGALPELMRHIPDKPIVCSANAVKSLKGHYHQDWNFQVVKTGDTLDLGSKKLIFIEAPMLHWPDSMMAYLTGEEILFSNDAFGQHYASESLFNDLVDQHELFEEALKYYANILAPFSARVVKKIEEVLALNLPVKMIAPSHGIIWRDNPLQIVNKYLEWAKDYKENQITIIYDTMWDGTRRMAEEIARGIKAADPEVTVKLYNCARSDNNDIVVEVFRSKAILAGSPTVNRNILYNLAGQLDLIKSLQFKGKKASAFGAYGWSGEGVKIITEILKEAGFEIVMEGIRELWNPDDEALKRCFEFGKNFAQAVK

SEQ ID NO: 7356 - protein, 671 aa, Idiomarina loihiensis
MCGIAGVFHHQTERAIEPQTLVNMAAIMHHRGPDGFGYEVQQDYGVGFSHARLSIIDLDEKRGRQPFISADKRLMLTHNGEFYDFKRIRADLTARGARFNSKSDSEIVLHLFERYGLEDTLKELRGEFAFGLFDAKDESLYLVRDRFGIKPLYWTETEHGVVFGSELKVLFAHPDVKREFSAEGLYHQLIQVMVPGSTAFEGINQVQPGYVVKLQRKNGKVVATEHKYWDVDFPPEESYPGADVDEESYIEGVRAKLLEAVQHRMTADVPVGCYLSGGIDSCAILGLASASTQTSVKAFTIGFDSADYDETPIAEEMAAATKADHHIMRLKADDLYDHFVKTLWHTERTIYNTLGVAKYLMSKEVHEAGYKVVMTGEGSDELFAGYPAFRKDMFLHGLDHLPEVERVEWQELLEKNNKLFKGAMLAREEFVSEAFNQKMGFTPSCVQPWLSCSSVALPLMSENKRKQVEGYDPSLAIANTLDKDMLDGRHPLDRAQYVWIKTMLEGQILTWGGDRVDMANSMEARPAFLDHHLAEYAFTVPPHLRIKGNKEKYVLREAMKGLLPETLYKREKFAFMAPPAHTDPEKWKAVEKLAEQFLNAEAVKSAGLLDYDEVVRTFERHQDENVPNEERVQLDAVINHMLGVQVLHHHFVATDVPAQAQQRATELGWTA

SEQ ID NO: 7357 - protein, 250 aa, Desulfotalea psychrophila
MVFPGLALPEHAPSISEELLYPDQKKLGLTPEFLFNRFVLYIEECRRLQAKYRDKIKISVAMEIETYSGYDTFVPSLMEQFSPEYLVGSVHFVDDMGIDYSAEQYNATAEKIGGIDKMYCHYFDIQFEMMERLRPSVVGHFDLVRIFDNDYQNRLQKPEIMSKIERNLEFIKKHDLIMDFNLRALTKGAQEPYISKAILERARELEIAVVPGDDSHGVSQVANHMSRAIEILSHHGFSTNWQKPRGAQTA

SEQ ID NO: 7358 - protein, 100 aa, Triticum aestivum
  misc_feature (67)..(67): Xaa can be any naturally occurring amino acid
  misc_feature (78)..(78): Xaa can be any naturally occurring amino acid
MGRRGARCYRQIKNKPYPKSRYCRGVPDPKIRIYVVGMNNKGVDEIPSCVHLGSWEKENVFSEAFEXSRIACTKYITXCLERLRLYSEVMVHPYHGLRIN

SEQ ID NO: 7359 - protein, 309 aa, Leptospira interrogans
MKAKSILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 7360 - protein, 924 aa, Mycobacterium leprae
MIDGAPPLEPSKEPTQHMELPDRLRVHSLARTLGTTSRRVLDVLSALDGRIRSAHSSVDRVDAVRVRDLLASQPNSPHELTAVPDNPVALEERDSRLVLETTVERPHYMPLFVAPQPIEVDDDSCADDDVESGDDSDVGDDEEQPDRPANRRRRRGRRGRGRGRGEQGGSDVQSDDVDGAVDSTESEDFDGQDFDESEDTEIGYDESGSSEAGNRRRRRRRRRKSGVGEDEGCAPDDPPNTVVHERTPRAAGRSASFDNGVNGTGSADIKGIDGSTRLEAKRQRRRDGRDAGRRRSSVLSEAEFLARRESVERVMVVRDRIRTEPPHPGARYTQIAVLEDGIVVEHFVTSAASASLVGNIYLGIVQNVLPSMEAAFVDIGRGRNGVLYAGEVNWEAAGLGGADRKIEQALKPGDYIVVQVNKDPVGHKGARLTTQVSLAGRYLVYVPGASSTGISRKLPDTERQRLKEILREVVPPDAGVIIRTASEGVKEEDIRKDVTRLQEHWEQIEAKTIQTKEKAAGAAVALYEEPDVLVKVIRDLFNDDFSGLVVSGDEAWNTINEYVNSVAPELVSKLTKYDPPIGPDGQHGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEVLARDRTRHQVSEVTSLGLVQLTRKRLGTGLVEAFSTSCPNCTGRGILLHTDPANSTPMVGRKSESGGRRSKRSKKNRSDETAVVKVPVHAPGEHPMFKAMAAGSSSVVVGGEDESNESGTELTGKIDEPLEEQAVAGLDDVDQEDFDTDEEDDLDDDEELDDEEDLGDDDEELDLDDDLDVDEDESDSEADLDSADVLDRSTLLIRNRSGFARPRRRRAAGRPAGPPIHVD

SEQ ID NO: 7361 - protein, 850 aa, Brassica napus
MKGIRKNYENSYTLSFLLVFFVLILLPPAFSINTLSSEESLTISSNRTLVSRGDVFELGFFKTTSSSRWYLGIWYKKFPYRTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVVWNVFWSSPNHQCDMYKICGPYSYCDVTTSPVCNCIQGFRPKNRQQWDLRISLRGCIRRTRLSCSGDGFARMKYMKLPETTMAIVDRSIGVKECEKRCLSDCNCTAFANADVRNGGTGCVIWTGRLDDMRNYVPDHGQDLYVRLAAADLVKKSNANGKIISLIVGVSVLLLLIMFCLWKRKQNREKSSAASIANRQRNQNLPMNGIVRSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDESWTVNQYTCSVIDAR

SEQ ID NO: 7362 - protein, 167 aa, Triticum aestivum
  misc_feature (133)..(133): Xaa can be any naturally occurring amino acid
APDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATXLKGWEHDSSVSPCALLLYLWPGPCFVICITSRKR

SEQ ID NO: 7363 - protein, 709 aa, Streptococcus agalactiae
MSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 7364 - protein, 232 aa, Arabidopsis thaliana
MATGLGFFKLSFLLSLLSGGSDLLGPDAESGVAQIGKFPPSCNRIECPSYELVHSGNGYEIRRYNNTVWVSTEPIPDISLVDATRTAFFQLFAYIQGKNEYHQKIEMTAPVISQVSPSDGPFCESSFTVSFYVPKKNQPDPAPSENLHIQKWNSRYVAVRQFSGFVSDDSIGEQAAALDSSLKGTAWANAIAKSKEDGGVGSDSAYTVAQYNSPFEFSGRVNEIWLPFELDV

SEQ ID NO: 7365 - protein, 536 aa, Chlamydia muridarum
MHGFTATEEEPTSEVQPGAILKGTVVDISKDFVVVDVGLKSEGVIPMSEFIDSSEGLSVGAEVEVYLDQTEDEEGKVVLSREKATRQRQWEYILAHCEEGSIVKGQITRKVKGGLIVDIGMEAFLPGSQIDNKKIKNLDDYVGKVCEFKILKINVDRRNVVVSRRELLEAERISKKAELIEQITIGERRKGIVKNITDFGVFLDLDGIDGLLHITDMTWKRIRHPSEMVELNQELEVIILSVDKEKGRVALGLKQKEHNPWEDIEKKYPPGKRVRGKIVKLLPYGAFIEIEEGIEGLIHVSEMSWVKNIVDPNEVVNKGDEVEVVVLSIQKDEGKISLGLKQTEHNPWDNIEEKYPIGLRVTAEIKNLTNYGAFVELEPGIEGLIHISDMSWIKKVSHPSELFKKGNTVEAVILSVDKESKKITLGVKQLTPNPWDEIEAMFPVGSDISGIVTKITAFGAFVELQNGIEGLIHVSKLSDKPFAKIEDILSIGDKVSAKVIKLDPDHKKVSLSIKEFLAHGGHAGQDAEEETSSNRD

SEQ ID NO: 7366 - protein, 430 aa, Staphylococcus aureus
MKTTIKQAKDHLNQDVTIGAWLTNKRSSGKIAFLQLRDGTGFMQGVVVKSEVDEEVFKLAKEITQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFTNHAESLEIQEQYVTHVVKSVLENCKLELKILERDTSKLEKVATPFPRISYDDAIEFLKAEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 7367 - protein, 312 aa, Chlamydia muridarum
MTHVKLAIIGSGPAGYTAAIYASRALLTPILFEGFFSGIAGGQLMTTTEVENFPGFPQGVLGHQLMENMKMQAQRFGTQVIAKDITSVDFSVRPFVLKSGEDTFTCDACIIATGASAKRLSIPGAGDNEFWQKGVTACAVCDGASPIFRDRDLFVIGGGDSALEEAMFLTRYGKRVFVVHRRDTLRASKAMVNKAQANEKIVFLWNSEVVKILGDSLVRSIDIFNNVEKTTVTMEAAGVFFAIGHQPNTAFLGGQLSLDENGYIITEKGSSRTSVPGVFAAGDVQDKYYRQAITSAGSGCMAALDAERFLEK

SEQ ID NO: 7368 - protein, 198 aa, Glycine max
VVGIIGNIIAGCLFLSPVPTFVRIWKKGSVEQYSAVPYLATLMNCMVWTLYGLPMVHPHSLLVVTINGAGCVIEIIYVTLFLLYSDRTKRLKVFLWLFLELVFIAVLTFVTFTLIHSVKKRSAVVGTICMLFNVAMYASPLSVMKLVITTKSVEYMPFFLSLASFGNGVSWTTYALIPFDPFIAIPNGIGTTLSVAQL

SEQ ID NO: 7369 - protein, 310 aa, Escherichia coli
AYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVAVIGGGNSGVEAAIDLAGIVEHVTLLEFAPEMKADQVLQDKLRSLKNVDIILNAQTTEVKGDGSKVVGLEYRDRVSGDIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 7370 - protein, 416 aa, Helicobacter pylori
MAYFLEQTDSEIFELIFEEYKRQNEHLEMIASENYTFASVMEAMGSVLTNKYAEGYPNKRYYGGCEVVDKIESLAIERAKKLFNCQFANVQAHSGSQANNAVYHALLKPYDKILGMDLSCGGHLTHGAKVSLTGKHYQSFSYGVNLDGYIDYEEALKIAQSVKPEIIVCGFSAYPREIDFKKFREIADEVGALLLGDIAHVAGLVVTGEHAHPFPHCHVVSSTTHKTLRGPRGGIILTNDEEIAAKIDKAIFPGTQGGPLMHVIAAKAVGFKENLKPEFKAYAQLVKSNMQVLAKALKEKNHKLVSGGTSNHLLLMDFLDKPYSGKDADIALGNAGITVNKNTIPGETRSPFVTSGIRIGSAALSARGMGAKEFEIIGNKISDILNDINNVSLQLHVKEELKAMVNQFPVYHQPIF

SEQ ID NO: 7371 - protein, 432 aa, Oryza sativa
MHLCTEAAVTRRRLLLLLLLLVTCSCLSARERSNSSSSSSRRVVRHLPGFDGALPFELETGYVEVDRIAGVRLFYYFIRSESSPADDPLLLWLTGGPGCSAFSGLVYEVGPLTFDVHGHGHGQLPRLLYKPESWTKRTNVIFLDSPVGTGFSYADTDAGFRTGDTIAVHHILVFLNNWFQEVHPDFLSNPLYIAGDSYSGMIVPAVTFGIATSSPKPSLNLKGYLLGNPVTDHNFDAPSKIPFAHGMGLISDQLYQCVKDIYGNHILEPYCTFASPHNPRIDKPFTSGTAEYTMSRIWANNDTVREALGIHQGTVPSWQRCNYDILYTYDIKSSVRYHLDLTTRGYRSLIYSGDHDMIIPFIGTQAWIRSLNFSVVDEWRPWFVDGQVAGYIRSYSNNLTFATVKGGGHTAPEYMPKQCLAMLARWVSGNPL

SEQ ID NO: 7372 - protein, 831 aa, Ralstonia metallidurans
MPLTRRDFIKQTAIAATASVAGVSLPTDAANFVTDSEVTKLKWSKAPCRFCGTGCGVTVAVKDNKVVATQGDPLCEVNKGLNCVKGYFLSKIMYGQDRLTKPLLRMKNGKYDKNGEFAPVSWDRAFDEMEAQFKRVLKEKGPTAVGMFGSGQWTVWEGYAASKLYKAGFRSNNIDPNARHCMASAVTGFMRTFGMDEPMGCYDDIEAADVFVLWGSNMAEMHPILWTRITDRRLSHPKTRVAVLSTFTHRSFDLADIPVIFKPQTDLAMLNFIANYIIRNNKVNKDFVNKYTVFKEGVTDIGYGLRPDNPLQKAAKNAGNPNDSKLITFDDFAKFVSKYDADYVSKLSGVPKKQLEQLAELYADPNLKVMSLWTMGFNQHTRGTWVNNMAYNVHLLTGKIATPGNSPFSLTGQPSACGTAREVGTFSHRLPADMVVTNPKHREEAERIWKLPPGTIPDKPGYHAVLQNRMLRDGKLNAYWVQVNNNMQAAANMMEETLPGYRNPTNFIVVSDAYPTVTALSADLILPTAMWVEKEGAYGNAERRTQFWHQLVDAPGEARSDLWQLMEFSKRFKVEDVWPAELIAKKPEYKGKTLFDVLYRNGQVDKFPLKETASDYNNYESKAFGFYVQKGLFEEYATFGRGHGHDLAPFDMYHEARGLRWPVVNGKETRWRYREGSDPYVKAGTGFQFYGNPDGKAVIYALPYEPPAESPDKEYPFWLATGRVLEHWHSGSMTRRVPELYRAFPNAVCFMHPEDAKALGLRRGVEVEVVSRRGRMRTRIETRGRDAPPRGLVFVPWFDASQLINKVTLDATCPISLQTDFKKCAVKIVKV

SEQ ID NO: 7373 - protein, 205 aa, Musgravea heterophylla
  misc_feature (14)..(14): Xaa can be any naturally occurring amino acid
  misc_feature (159)..(159): Xaa can be any naturally occurring amino acid
SSFDFMDGYDKPVXGRKINWMKAGILESDRVITVSPYYAQELVSGMDKGVELDNIIRKTGITGIVNGMDVQEWNPSTDKYIDVKYDATTVFDAKPLLKEALQAAVGLPIDGNIPVIGFIGRLEEQKGSDILAEAISQFIGENVQIVVLGTGKKPLEEQXEQLEIKYPDKAIGIAKFNVPLAHMIIAGADFMLIPSRFEPCGLIQL

SEQ ID NO: 7374 - protein, 205 aa, Musgravea heterophylla
SSFDFMDGYDKPVRGRKINWMKAGILESDRVITVSPYYAQELVSGMDKGVELDNIIRKTGITGIVNGMDVQEWNPSTDKYIDVKYDATTVFDAKPLLKEALQAAVGLPIDGNIPVIGFIGRLEEQKGSDILAEAISQFIGENVQIVVLGTGKKPLEEQVEQLEIKYPDKAIGIAKFNVPLAHMIIAGADFMLIPSRFEPCGLIQL

SEQ ID NO: 7375 - protein, 428 aa, Medicago truncatula
MAQILAPSTQCQARITKISPVATPISSKMWSSLVMKQNKKVARSAKFRVMAVNSGTINRVEDLLNLDITPFTDSIIAEYIWIGGTGIDVRSKSRTISKPVEHPSELPKWNYDGSSTGQAPGEDSEVILYPQAIFKDPFRGGNNILVICDAYTPQGEPIPTNKRHKAAEIFSNPKVEAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINTFSWGVANRGCSIRVGRDTEKNGKGYLEDRRPASNMDPYVVTALLAESTLLWEPTLEAEALAAQKIALKV

SEQ ID NO: 7376 - protein, 205 aa, Austromuellera trinervia
SSFDFMDGYDKPVKGRKINWMKAGILESDGVITVSPYYAQELVSGMDKGVELDNIIRKTGITGIVNGMDVQEWNPSTDKYIDVKYDATTVFDAKPLLKEALQAAVGLPIDGNIPVIGFIGRLEEQKGSDILAEAISQFIGENVQIVVLGTGKKPLEEQIEQLEIKYPDKAIGIVKFNVPLAHMIIAGADFMLIPSRFEPCGLIQL

SEQ ID NO: 7377 - protein, 203 aa, Porphyridium purpureum
MAAFVSGFGLARASAGRSSVCSKNAHVTMMAKSKAIPFLEAPAKLDGTLVGDVGFDPLGLSATLDVKYLRAAELKHGRIAMLAALGFVVQEILAPKQSGPFTEPDPFLAIYKVPVEGWYQIIAAISLVELVTFKENYDGSAEPGNFGFDPLGLGKDKSVFDKYALSELKNGRLAMIAWTAFAIQQIVTGKGVIKQLMEFQPLM

SEQ ID NO: 7378 - protein, 240 aa, Zea mays
  misc_feature (70)..(70): Xaa can be any naturally occurring amino acid
LGGRDHARWRVVRQHAHPDDDAFDSGGDKYLLAKTYFDCREYRRAEHVLQNQVGRKAVFLRCYAFCMSAXWREAENAVNQELVALEKELSTHRRTGSIDSFGLYLYGIVLHDKGCEGLTRKILVEPVNSYPWNWSAWSELQTLCTSSDILNKLNLKNRWMKDFFLASAYLELETHEEDFFLASADSFFGLSCTIDAGPQTVLLKEDFPIPVRVPFVTKKRKQYNIFSSLASLQDSSGTSC

SEQ ID NO: 7379 - protein, 578 aa, Kluyveromyces lactis
MQLARIIFQRGFLRTFGTVAKKEFINMSTQVELKRVATQDIQPVKPKQSKKSKIRKYKPKPLDPTSALGVLQFEIDEILKEFSLARDAILNDVGCILNEERDGPMHRLYHREVNSVEVLKMGANGEGLALIPNPVDLDKKQIALIPFALPGDVVRIKTFKTHPHYVECDLLEVIKPSSKRNNDLIQCRYFGKCSGCQLQYLTYEDQLAFKKRTVMNAYKFFAPRLMEDKLVPEIGETMRSPLEIGYRTKLTPHFDLPKRMKGNGERPALGFGHKGRPQWRGNADGGSGPMLDIEECIIGTKIINQGMTNERARFEREFTKYNKGATILLREHTKVIDPEIPVAEQLDDGSEDIEGKISYLQINDEENDKSLVKTCVTNTRQIVTEYINGYTFQFSAGEFFQNNNSILPSVTAYVRKNLQIEGSKPEDPHYLVDAYCGSGLFSITSSKGVDRVIGVEVSADSVAFAERNAKANGVENCKFIVGKAEKIFGSIDTPCDRTSVILDPPRKGCDDIFMKQLAEYNPARIVYISCNVHSQARDVEYFLKETENGKHYKIESLRGFDFFPQTHHVESVCVLSRS

SEQ ID NO: 7380 - protein, 267 aa, Sinorhizobium meliloti
IAVPGPVYSSQAAALEDADIVLFAMPSQAHRDAARSYGTAIGGRAIVVTCAKGMEQSTGQLLTDVLEEELPGRRIGVLSGPGFAADIASGLPTAMVIAAPDTAIATELAEVLSGRTFRLYPSADRTGVQLGSALKNVLAIACGIVEGAGLGDSARAALISRGLAEMSRFIVARGGEADTVRGLSGLGDLVLTATSHQSRNLRFGIALGKDGRAAAGSSELVEGAFAASVAARVAGALGIEMPVTEAVAAIVDGKLDVRSALEQLMSR

SEQ ID NO: 7381 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 7382 - protein, 1095 aa, Unknown
  delta proteobacterium MLMS-1
MIVDERNVDMLTNKRLELYDFAARHSMDELMTKVLDDAEAFVDSSIGFFHFVEKDQKTLSLQRWSTRSLRELCHMPGNKTHYDIDQAGVWVQAAREKRAVIHNDYESMPDRKGLPQGHARVIREIVVPVIRDNKVVAIMGLGNKPVDYDDEDLEVISFFADITWNLVEQKRTQEALQNSQARLKTITDAAQDAIIMMDTRGIVSFWNPAAETILGYTRDEAMGRDLHELIMPSRYRKNFQAAFPEFKKTGHGNAVGMTTELYAQTKDGREIPVELALSSVLIDDQWNAVGVVRDITEKKEAQEELQRHGRNLERKNVELNAARLEAEEATRAKSEFLANMSHEIRTPMNAIIGLSYLCLQTDLNNKQHDYLTKVHSSAQSLLGIINDILDLSKVEAGKLEIEHIPFALQDVTDHLTSIIHVKAQEKQLHFHVETAIDIPPFLVGDPLRLGQILINLCGNAIKFTSQGQVMLQIVLAEQTEQTEQTARIHFAIKDTGTGMTPEQISRLFQAFSQADSSTTRQFGGTGLGLVISKQLVETMGGEISVESEPGKGSTFMFTINLEKADPSRFEQPAVPSSDLGPRKIMVVDDNPTALELLESYLSDCNSTVDFAQSGAIALQKLQQTGSDEEPYDLVMLDLRMPNFSGVETAREIRRILPHRPPWLLLFSSFGRTEMHPHLDSGLFDAILAKPFSQQQLLLAIHKIFHDSKTPTPDQPDSTGIAADGRQLAGATLLLAEDNEINQQVACELLQPYGVTLAIAANGQQALDMLATDTYDGILMDIQMPVMDGVEATELIRQNPKYRDLPIIAMTANAFKSDQEKYLAAGMNDCITKPIRVKEMLATLGRWVKPAATSTAAPATVPEIVALTSPADQTGETAPAVCGNHFQSALTTAGIDVVAALESVGGDRELYGTILQKFCRGQRGTADKIRQALVAGQLKDGEIMAHTLKGLCLTIGARETGWLAAPVEEALAQKLPVTEVLPLLAPLEIALEKLLAGIEGALNPASVPAEPRSDEGEFDCVKARAMIIKAAIQIAEYDTEAAQTVAELRDLIGVGRQPEAEKLLASLTTMLERYDFDGSGAELEKLDRLIEDDDGC

SEQ ID NO: 7383 - protein, 113 aa, Agropyron mongolicum
MTEKKNRREKKNPREAKVTFEGLVTEALPNGMFRVRLENDTIILGYISGKIRSSSIRILMGDRVKIEVSRYDSSKGRIIYRLPHKDSKRIEDSKDSEDLKDGEDLKDTKDSKD

SEQ ID NO: 7384 - protein, 422 aa, Sinorhizobium meliloti
MPGLFERQLKHDSVIAGAIAREMGRQRSEIELIASENIVSPAVLAAQGSVMTNKYAEGYPGHRYYGGCQYVDLVEAAAIERAGMLFDASFVNVQPHSGAQANGAVMLALLKPGDTFMGLSLAAGGHLTHGARPTMSGKWFNAVQYGVRESDCLIDYDELEVKAIATRPKLIITGGSAYPRLIDFKRIRAIADSVGAAMMVDMAHFAGLVAGGVHPNPVEIADIVTTTTHKTLRGPRGGMILTNNQDVAKKVNSAVFPGLQGGPLMHVIAAKAVALGEALEDNFRQYARQMVANARALASALTERGYDIVSGGTDTHLILVDLRSKGVSGKDAEEALGRAGLTCNKNGIPFDPAPPAVTSGIRLGTPAATSRGFREAEFNEVGALIANVLDALGTEQSGEQERRARMSVHDLCAAFPIYSARH

SEQ ID NO: 7385 - protein, 479 aa, Escherichia coli; identical to SEQ ID NO: 422

SEQ ID NO: 7386 - protein, 377 aa, Escherichia coli
MSNGIVIIGSGFAARQLVKNIRKQDATIPLTLIAADSMDEYNKPDLSHVISQGQRADDLTRQTAGEFAEQFNLHLFPQTWVTDIDAEARVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGIQATLDRQRNIEVDAVIAATGLRPETALARRAGLTINRGVCVDSYLQTSNTDIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPM

SEQ ID NO: 7387 - protein, 396 aa, Kluyveromyces lactis
MSDGITDIDENQIQSTYDKVVYSFDDLKLKEELLRGIFGYGFVEPSAIQQRAILPIIEGKDVLAQAQSGTGKTGTFSIAALQNIDEKIKAPQGLILAPTRELALQIQKVVMALAIHMDVKVHACIGGTSLQEDSEALRGGAQIIVGTPGRVFDMIDRRIFKTDNIKMFILDEADEMLSTGFKEQIYNIFTMLPPTSQVVLLSATMPGDVLEVTSKFMKDPVRILVKKDELTLEGIGQYYVNVEEEQYKYDCLTDLYDSISVTQAVIFCNTRRKVEELTERLRENNFTVSAIYSDLQQQERDTIMKEFRSGSSRILISTDLLARGIDVQQVSLVINYDLPSNKENYIHRIGRGGRFGRKGIAINFVTNKDIGAMRELERFYSTQIEELPSSISELFD

SEQ ID NO: 7388 - protein, 119 aa, Medicago truncatula
MRQAGAYSGILNGGIGRTGPHSLPLARIKKIMKNSSEDVKMISGVAPIVFSKACELFIEELTRRSWIMAIDAKRRTLNKEDVASAVIATDIFDFLITLVSNSDSTDDTTVMQMETMNSS

SEQ ID NO: 7389 - protein, 488 aa, Unknown
  Shewanella sp. MR-7
MGSELLINVTPSEARVALVEHGVLQEVHIERRMKRGLVGNIYKGKISRVLPGMQAAFVDIGLDKAAFLHASDIVPHTECVADVEKGHFVVRDIAELVRQGQDIMVQVVKDPLGTKGARLTTDITLPSRYLVFMPGSSHVGVSQRIEQEEERSRLKKITLPFVDEDGGFIIRTAAEGVGEDELAQDAAFLRRVWSKVSERRQRRGVALLYQDLALPVRIVRDFVGTELDRIQVDSRRTFAELQAFAQEFMPEIADKIEHYSGPAPIFDLYDVENEIQRALGRKVELKSGGYLIIDQTEAMTTVDINTGAFVGHRNLEETIFNTNLEATQAIARQLRLRNLGGIIIIDFIDMLSDEHKTRVLNSLNSALAKDRVKTNVSGFSGLGLVEMTRKRTRESLEHVLCGECPACQGTGSMKTVETVSYEIFREIIRLNRAYDADEFLLYCSPAVYNSLSGDESHLVAELEVYIGKRIRLQNEPMYSQHKYDVVMM

SEQ ID NO: 7390 - protein, 82 aa, Australopyrum retrofractum
MFRVRLENDTIILGYISGKIRSSSIRILMGDRVKIEVSRYDSSKGRIIYRLPHKDSKRIEDSKDSEDLKDSEDLKDTKDSKD

SEQ ID NO: 7391 - protein, 273 aa, Magnaporthe grisea
MWPGQAMTLKVEKVLHHERSKYQDVLIFQSTDYGKVLVLDNVIQCTERDEFSYQEMITHLAMNSHPNPKKVLVIGGGDGGVLREVVKHDCVEEAILCDIDEAVIRLSKEYLPNMSAGFNHPKVKVHVGDGFKFLADYQNTFDVIITDSSDPEGPAESLFQKPYFQLLFNALTEGGVITTQAENQWLHLPLITKLRKDCKEIFPVAEYAYTTIPTYPSGQIGFMVCSKDPKANLKEPLRSWTQEEELEKCRYYSSDIHKASFVLPNFARKALQD

SEQ ID NO: 7392 - protein, 157 aa, Bacillus halodurans
MSIHEFSARLINGEEKALSDYKDQVLLIVNTASKCGLTPQYEELQILYETYKDQGFTVLGFPSNQFMNQEPGDHNEIAAFCERNYGVSFPIFEKVKVNGKEAHPLFQYLTSQQGGLFTEKIKWNFTKFLIDRSGNVVKRYAPSTSPIKIKDDIEELL

SEQ ID NO: 7393 - protein, 542 aa, Oryza sativa
MASPPTASASASEAAESGRRSAPGPIDVPSPRDHLHHLLDRRDTPRVVHVEGTTMQRQRGEAAGDAGAAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYRITEKQNKVSITDRMWARLLSSTNQPSFLSKKDVEDAKMEEERASKFFDGPPPNPKVEDKVASNGKAVK

SEQ ID NO: 7394 - protein, 242 aa, Prototheca wickerhamii
GGICRSGPSHESHPAKEAVVTMGGSHSKKSGATTDPLVTVLENKPSRSQATPPADTAPPPAKKNIVSSNITQVIGNTPLVRLNHLAETEGAKATILLKMESLEPNSSVKDRIGLAMIEDAEQSGKITPGKTTLVEPTSGNTGIALAFVAAARGYKLVLTMPATMSLERRIVLRAFGAQLVLTDPAKGMKGALLKAEEIAAATPDSYILQQFENPANPAIHYTTTGPEIWNDAGGDVDVFIAG

SEQ ID NO: 7395 - protein, 178 aa, Glycine max
  misc_feature (83)..(83): Xaa can be any naturally occurring amino acid
  misc_feature (86)..(86): Xaa can be any naturally occurring amino acid
  misc_feature (98)..(98): Xaa can be any naturally occurring amino acid
  misc_feature (113)..(113): Xaa can be any naturally occurring amino acid
  misc_feature (137)..(137): Xaa can be any naturally occurring amino acid
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 7396 - protein, 280 aa, Glycine max
MADLLEWSKQDKKRMLHVVYRVGDLDRTIKFYTECLGMKLLRQRDIPEEKYANAFLGFGPEESHFVVELTYNYGVTSYDIGDGFGHFAIATQDIYKLVEHIRAKGGNITREPGPVQGGTTVIAFVKDPDGYTFGLIQRPTVHDPFCQVMLRVGDLERSIKFYEKALGMKVVRKVDKPEYKYTIAMLGYGEEHETTVLELTYNYGVTEYSKGNAYAQIAIGTDDVYKSAEVVNQVIKEVGGKITRQPGPIPGLNTKTTSFLDPDGWKTVLVDNVDFLEELK

SEQ ID NO: 7397 - protein, 101 aa, Glycine max
MGRRPARCYRYCKGMPYIKSRYCRGVPDAKIRIFDLGRKRATADEFPFCAHLVSLENEQLSSEALEAGRISCNKYITTFGGKDSLHMRARVHPYFFFFPPP

SEQ ID NO: 7398 - protein, 246 aa, Gloeobacter violaceus
MPSPRGKVYLVGAGPGDPGLLTVRGKTLIEHCDAIVYDALVSPEILALIPARTERLYAGKRSGRHSLTQDEITERLIALVERHASVVRLKGGDPFIFGRGGEEVAALRAAGVAVEVVPGITAGIAAPAYAGIPLTHRDMSASVAFVTGHEAVETYRPEIRWGELARGAETLVIYMGVLQIESIVERLLAAGRAPETPVALIRWGTTPRQEVLTGTLATIAPRVRAAHFEPPAVIVVGEVARLAHTG

SEQ ID NO: 7399 - protein, 304 aa, Unknown
  Candidatus Desulfococcus oleovorans Hxd3
MSYITMKELLESGVHFGHQTRRWNPKMKPYIFGARNGIYIIDLQKTVRMFKDAYDFIGHVAEKGGSVLFVGTKKQARESIYEEANRAEMFYVHNRWLGGMLTNFQTIKKSIDQLHYLNELVNDGSIERYPKKEQAGLMRQREKLDSVLGGIQSMTRLPAALFVIDVRKEAIAVGEARRLGIPVVAVVDTNCDPDNIDYVIPGNDDAIRAIRLMSSRVADACIDGRKRFEEKKQAFEDKAEAETEEKPRPAPAAAAAAEDQKPVEREVISDGTDGPIVERIRKTFTSAADYQEPEEDADEENSEA

SEQ ID NO: 7400 - protein, 463 aa, Bacillus anthracis
MENTLVKSLYRDTDKYAGQTVQVSGWIRNLRDSKAFGFIELNDGSFFKSVQIVFDTELDNFKEIAKLPLSSSVKVEGKVIATPGAKQPFEIKAEKIDIEGLSDSDYPLQKKRHTFEYLRTIAHLRPRTNAFSATFRVRSIAAFAIHQFFQERGFVHVHTPIITGSDTEGAGEMFRVTTQDLNNVPKGEDGQVDESKDFFGKETNLTVSGQLNAEAYALAFRDVYTFGPTFRAENSNTTRHAAEFWMVEPEIAFAELGDVMNLTEDMLKYAMKYVLEHAPEEMEFFNSFVDKTVLERMNNVINSDFGRITYTEAIKVLQESGADFKYPVEWGIDLQTEHERYLSEEIFKRPVFVTDYPKDIKAFYMRLNDDGKTVAATDLLVPGIGELIGGSQREERMDVLVDRIKELGMNEEDYWWYLELRKYGGTKHAGFGLGFERFLMYITGMANIRDVIPFPRTPGSSEF

SEQ ID NO: 7401 - protein, 335 aa, Haemophilus influenzae
MITSQTPITVLGAGSYGTALAITFSRNGSPTHLWGHNPAHIAQMQTERQNYRFLPDVIFPEELHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRECKGE

SEQ ID NO: 7402 - protein, 502 aa, Oryza sativa
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPKQKKTPMTVSNPKEVPEYELNPLELEFRRGEEVTKGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIVRLNKISTSFTKQTRWRDTFKLPWKQASER

SEQ ID NO: 7403 - protein, 62 aa, Zea mays
  misc_feature (40)..(40): Xaa can be any naturally occurring amino acid
MSDIIPEMAICDFNLQPCGYSMNAVHGHALSTIHVTPKDXLSYARYKVLGSNPDSFSYGDLV

SEQ ID NO: 7404 - protein, 479 aa, Neurospora crassa
MSTYSLSETHKAMLEHSLVESDPQVAEIMKKEVQRQRESIILIASENVTSRAVFDALGSPMSNKYSEGLPGARYYGGNQHIDEIEVLCQNRALEAFHLDPKQWGVNVQCLSGSPANLQVYQAIMPVHGRLMGLDLPHGGHLSHGYQTPQRKISAVSTYFETMPYRVNIDTGLIDYDTLEKNAQLFRPKVLVAGTSAYCRLIDYERMRKIADSVGAYLVVDMAHISGLIASEVIPSPFLYADVVTTTTHKSLRGPRGAMIFFRGVRSVDAKTGKETLYDLEDKINFSVFPGHQGGPHNHTITALAVALKQAASPEFKEYQQKVVANAKALEKKLKELGYKLVSDGTDSHMVLVDLRPIGVDGARVEFLLEQINITCNKNAVPGDKSALTPGGLRIGTPAMTSRGFGEADFEKVAVFVDEAVKLCKEIQASLPKEANKQKDFKAKIATSDIPRINELKQEIAAWSNTFPLPVEGWRYDAGL

SEQ ID NO: 7405 - protein, 446 aa, Pyrococcus abyssi
MLCNQCSMSLSGGCTVRGVCGKDPDLNSLQDALIYGIKGTAAYYYHALEMGYDNPEIGHFLAEALYSTLTNVNFDKNRFIDLILENGRIHLEAMKLLDKAYTETFGLPKPVEVPTGTTEGHGIVVTGHSYKALYELLNQIREMGLEEEIKVYTHSEMLPAHSYPEIRKFKSLYGNWGGSWVYQRKEFAEFPGVIIGTSNCVQQPTKAYQDRIFTVGIAGLEGVPHLEDYDFEPAIKRALETPKMGKREGEKIVTGFHHTYILAMKDKLIELINEGKIRHIFVIGGCDVPNPKMSYYEKLTELVPRDAIILSAACGKFRYNRRDYGSIEGIPRFMDFGQCNNVYSIIEIALALAKELDMDINSLPVSIVLSWMEQKAIGILYTLLYLGVKGIYIGPKSPEFLTPRVFEILRKQFDLRLISEPEKDLREMLSKGISLEESAPLAEELD

SEQ ID NO: 7406 - protein, 132 aa, Glycine max
  misc_feature (32)..(32): Xaa can be any naturally occurring amino acid
  misc_feature (41)..(41): Xaa can be any naturally occurring amino acid
  misc_feature (77)..(77): Xaa can be any naturally occurring amino acid
  misc_feature (86)..(86): Xaa can be any naturally occurring amino acid
  misc_feature (107)..(107): Xaa can be any naturally occurring amino acid
YGCEKTTEGEGRIDMCLLRRASDDEEHSYMTXRILFMLKEXLSVGADYMRIDGIKAYAATYVTANMMLYARDMYLHXTPYATDAFXYTLIFERFFAQNSPMLTDTGXARVACSTYKAGEWDAACSTPLIPVA

SEQ ID NO: 7407 - protein, 177 aa, Listeria monocytogenes
MTKESLEKATFAGGCFWCMVKPFDTQPGIEKVISGYTGGHTVNPTYKEVCSGTTGHTEAIQITFDPAVFPYEKLVEVYWQQTDPTDAAGQFLDRGDSYRPVIFYHNEEQKEIAEKSKAALDASGRFKKPIVTEIAKAETFYPAEEYHQDFYKKEKAHYEGYQVASGRAAFIDANWKG

SEQ ID NO: 7408 - protein, 261 aa, Ralstonia eutropha
MNPPLKPGKVWLVGAGPGSPELVTVRAARVLERAQVWLVDDLVSPEMTCYASPGTHVEWVGKRGGRCSVSQDRILQLTLMHAMAGKEVARVKGGDPLLFGRGAEESAFLRAHGVPVEVVNGISSGQAAAQALGVALTHRAHCHGVSLVTAHTSDHGSPDWGALARSGTTLVIYMGMSRLAAIRDALLAANMLPGTLAAVVMHAGGNGQRCWTGTLATLGEALDAGLASPAVIMVGAVLSDALAPVHAPVHEEPAPQYGSPT

SEQ ID NO: 7409 - protein, 117 aa, Medicago truncatula
MRQAGAYSGIVNGGIGRTGPHSLPLARIKKIMKNSSEDVKMISGVAPIVFSKACELFIEELTRRSWIMAIDAKRRTLNKEDVASAVIATDIFDFLITLVSNSDSSTDATTLMQMESI

SEQ ID NO: 7410 - protein, 500 aa, Unknown
  Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 7411 - protein, 206 aa, Glycine max
IPFRSFSDARIGEVKRVTKETNVSVKINLDGSGVADSSTGIPFLDHMLDQLASHGLLDVHVKATGDIHIDDHHTNEDVALAIGTALLHALGDRKGINRFGNFSAPLDEALIHVSLDLSGRPHLSYNLDIPTQRVGTYDTQLVEHFFQSLVNTSGMTLHIQQLAGKNSHHIIEATFKAFARALRQATEYDPRRRGTIPSSKGVLSRS

SEQ ID NO: 7412 - protein, 154 aa, Kluyveromyces lactis
MSADHSRDPCPIVILNDFGGAFAMGVIGGCVWHGIKGFRNSPLGERRAGAVSAIKARAPVVGGNFGVWGGLFSTFDCGVKAVRKREDPWNAIIAGFFTGGALAIRGGWKHTRNSAITCACLLGVIEGVGLMFQRYAAWQAKPMAPPLPDQPMQA

SEQ ID NO: 7413 - protein, 113 aa, Elymus caninus
MTEKKNRREKKNPREAKVTFEGLVTEALPNGMFRVRLENDTIILGYISGKIRSSSIRILMGDRVKIEVSRNDSSKGRIIYRLPHKDSKRIEDSKDSEDLKDSEDLKDTKDSKD

SEQ ID NO: 7414 - protein, 476 aa, Yersinia pestis
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENADEDSARFYRSEGGGGVSDSGYAGKVRGKIEPLGFLFVRLDLLIRLSLLIRLNLFIRMNLLIILTLFFKLASIQASH

SEQ ID NO: 7415 - protein, 662 aa, Yersinia pestis
MAVLTHGSPTPSGAHFDGKGINFTLFSAHAEQVTLCLFDEQGQERQIAMPARTGDIWHGYLPGGKPGQRYGYRVSGPFEPSRGHRFNPHKLLIDPRTRALEGKVGDDPRFTGGVSQPDVRDSAAALPKCLVIHEEYDWQGDKPPAIPWGNTVIYEAHVRGLTQLHPDIPPELRGTYAALAHPALIEHLKTLGITTLELLPVQFHIDEPRLQKMGLSNYWGYNVLAPFAVDPDYASGREGISPLRELRDAVKALHNAGIEVILDVVFNHSAELDVFGPTLCQRGIDNASYYWLTPDGEYDNITGCGNALRLSHPYVTQWVIDCLNYWRDSCHVDGFRFDLGTVLGRTPAFDQHAPLFAALAADERLSACKLIAEPWDIGLGGYQLGNFPTGFSEWNDQYRDAMRGFWLRGEVPRGTFAQHFAASSRLFEQRGRLPSASINQITAHDGFTLLDLLCFNQKHNQMNGEENRDGSDNNHSNNFGCEGLVADAAIWQRRKACQRALLTTLLLSQGTPMLLAGDEQGHSQQGNNNAYCQNNILTWLDWGSADRALMTFTADLIRLRQQIPALTQDQWWQSGDSNVQWLDSQGQALSDAAWEQGCQQQLQILLSQRWLVLINATDHECEMHLPEGEWEGIPPFGVSDHAERLTTWRGSAHTICVLIKRD

SEQ ID NO: 7416 - protein, 267 aa, Agrobacterium tumefaciens
MAAQPHKAHADGTAGQNGRFDMSKAPTSTNRTGRKIGQKVKKTKLKASSRRWLERHINDPYVQRAKLEGYRARAAFKLLEINDKHQILKGATRIIDLGAAPGSWSQIASKVTDSTEDDIRVAAIDFLEIDPIPGVKILQLDFLDPTAPDQLMEAVGGTPDLVLSDMAAPTTGHQKTDHIRTMHLCEVAADFAVQVLAEGGHFLAKTFQGGTEKALLDMLKKNFKQVLHIKPASSRSESVEMFLLAKHFKGRRHEPAIDADAEESTED

SEQ ID NO: 7417 - protein, 378 aa, Dechloromonas aromatica
MSKRDFYEILGVNRDASDDEIKKAYRKLAMKHHPDRNPDNPGAEEKFKEAKEAYEILSDSQKRAAYDQFGHAGVEQGGMGGGGFGGGGGGFADAFGGIFDEIFGGRAGGSGGGRSNIYRGADLRYNLEITLEQAAHGTETKIRIPTMEVCEPCNGSGAKAGTQPKTCPTCGGSGQVRLQQGFFSIQQTCHKCHGTGRFIADPCKSCDGAGRIKQHKTLAVKIPAGVDEGDRIRLSGEGEHGVNGGPPGDLYVQIHLKPHAVFTRDHNDLHCEMPISFTAAALGGEIEIPTLDGAAAIKIPAETQSGRVFRLRGKGIKGVRSHTHGDLMCHVVVETPVNLTERQKELLRELEESSKDNSGKHNPRSKSWMDKVKDFFAE

SEQ ID NO: 7418 - protein, 319 aa, Listeria monocytogenes
MASEEKIYDVIIIGAGPAGMTAALYTSRADLDTLMIERGVPGGQMVNTAEVENYPGFDSILGPDLSDKMLSGAKQFGAEYAYGDIKEVVDGKEFKTVTAGSKTYKARAIIIATGAEHRKLGAAGEEELSGRGVSYCAVCDGAFFKNRELIVVGGGDSAVEEGTYLTRYADKVTIVHRRDKLRAQQILQDRAFKDEKVDFIWNSTVEEIVGDGKKVTGAKLVSTVDGSESIMPVDGVFIYVGLVPLTKAFLNLGITDDEGYIVTDEEMRTNLPGIFAAGDVRAKSLRQIVTATGDGGLAGQNAQKYVEELKESLEAEAAK

SEQ ID NO: 7419 - protein, 288 aa, Oryza sativa
  misc_feature (10)..(10): Xaa can be any naturally occurring amino acid
  misc_feature (64)..(64): Xaa can be any naturally occurring amino acid
MAAMVTTASXLLKTSFAGVRLPAAARNPTVSVAPRTGGAICNSISSSSSTPPYDINAIRFSPIXESIVSREMTRRYMTDMITYADTDVVVVGAGSAGLSCAYELSKDPSVSVAVIEQSVSPGGGAWLGGQLYSAMVVRKPAQLYIDELGVAYDEQEDYVAPYKTRRRSIQASNEMRRLLERTKGEADNDEDGKELIAKQAQRSAAPTGAGEKNRTGNEMNQGTHHAGGARDTRQRARRTHRQDAAHTKTSIHGQPATTQLAQATTPKQHAHGKVHKRATRQTEQRDHT

SEQ ID NO: 7420 - protein, 374 aa, Prochlorococcus marinus
MADFYQILGVSRDADADTLKRAYRKLARQYHPDVNKEPGAEDKFKEIGKAYEALADPETRARYDQFGEAGLGGAAGMPDMGDMGGFADLFETFFNGFGGQTPQGGRTQRRGPQQGDDLRYDLNVDFKDAIFGQQREITIPHLETCEVCRGTGAKPGTGPKTCSTCGGSGQVRRATRTPFGNFTQVAECPSCNGAGQIIADPCTSCGGNGVKQVRKKLRINIPAGVDTGTKLRVSGEGNVGLKGGPPGDLYVFIKVKNDSKLKRDGVTIYSEIAVSYLQAILGDTVEITTVDGNVNLKIPSGTQPNTTLSLENKGVPRLGNPVARGNHEVLVKVKLPTRITDEERELLEGLASQYSDKNINSSSGLFSKLFGKES

SEQ ID NO: 7421 - protein, 658 aa, Geobacillus stearothermophilus
MKYECIIDIPIEIGKRYLVYDHQGAVTDLQIGAVVRTAPFDDRFFYDGDLGVAYTREKTIFKVWAPTATEVKVKLIDPKTEKAEYIALERLEKGVWTTTVFGDMEGRYYTYVVCVNAVWREAVDPYAVAVSVNGEYGVIIDLAKTRTEKPPIPPITSPADAVIYEMHIRDFTIHPESGVTHKGKYLGLTEPETKGPNNTPTGLSYLKELGVTHVELLPFNDFAGVDERNPLQQYNWGYNPLHYNAPEGSYATDPNDPYARIRELKRAIHTLQSNGIRVIMDVVYNHVYIRDQSSFEKIVPGYYFRYDAYGNPSNGTGVGNDIASERKMVRKWIIDSVRFWVEEYHVNGFRFDLMGILDVETMKAVREMLDTLDPSILVFGEGWDLPTPLSSEQKATMQNAEKLPRIGYFNDYFRDSVKGSTFQLPDRGFALGDSDDREKVKVAISGSIGKKNGLFLHPTQTINYVESHDNHTFWDKMEIANGHESEQTRKKRQKLATAIVLLSQGIPFLHSGQEFYRTKQGIDNSYNAPDSINQIDWKRKSEHEDDVRYVQGLIRIRKSHRAFRFTTEAEINNHLFFLEPTPASIIAYHLRDVQQYGPWRDIIVIHHNQEEKQSVFLPDEEEWHVICDGIRSGTVPLFSVHKEINLDGIGTWVLVKQS

SEQ ID NO: 7422 - protein, 292 aa, Porphyromonas gingivalis
MKVALIQQANTADVCSNRERLAAKIREAARRGAELVVLPELHNGLYFCQTEDVQVFDRAETIPGPSTDFFGTIAREAGVVLVLSLFEKRAPGLYHNTAVVLERDGTIAGKYRKMHIPDDPAYYEKFYFTPGDLGFTPIPTSVGCLGVLVCWDQWYPEAARLMAMQGADILIYPTAIGTESTDLPAEQLRQRQAWQIVQRGHAVANGIPVVAVNRVGHEADPSGRTGGITFWGSGFVAGPQGELLAELSATEEAVEVVDIDPSRTEQVRRWWPFFRDRRIDAFSGLTERFLRG

SEQ ID NO: 7423 - protein, 349 aa, Agrobacterium tumefaciens
MVPIWRRKMETAMLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 7424 - protein, 834 aa, Oryza sativa
MAKSSADDAELRRACAQAVAASGARGEEVSFSIRVAKGRGIFEKLGRLAKPRVLALTVKQSTKGEAAKAFLRVLKYSSGAVLEGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQSLDKSCLGPLRKAYCHSLNLLLRREAREFANELRASTKAPKNPAVWLEGSNSGGQNGSSADTSTVSDAYSKMLTIFIPLLVDESSFFAHFMCFEVPALVPAGAPNAKSRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLIDKAYTKLVSTMFTTLDKIAHSDPKTADIVLIENYAAFQNSLYDLANVVPTLAKFYHEASESYEQACTRHISSLIYLQFERLFQFSRKVDELTYTIAAEEIPFQLGLSKTDLRRVIKSSLSGIDKSIGAMYRRLQKTLTSDELFPSLWDKCKKEFLDKYESFVQMVTRIYGNEPIMSVADMKDVLANF

SEQ ID NO: 7425 - protein, 472 aa, Staphylococcus aureus
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 7426 - protein, 321 aa, Eucalyptus gunnii
MGMAMGIKEKASSNPHNHKLRKGLWSPEEDEKLMRYMLTNGQGCWSDIARNAGLQRCGKSCRLRWINYLRPDLKRGAFSPQEEELIVHLHNILGNRWSQIAARLPGRTDNEIKNFWNSTLKKRLKMNSATSSSNESDLSNPQDIAAGIMPSFHAQYDVLATCMDSSPAPFPPMDNISAPNQFDPFPTLNNRCDTWEGVGFFTFPSGIAPVSMGDDSSYLNLEHAKVGLLGSEFSVPPLASSTTTTEENNYRSIGCGMDGKGENSFSNNNDSCFSNTTTASFKAEDDMSGFGNNLQAANLRIGEWDLEGLMDDLPSFPFLDF

SEQ ID NO: 7427 - protein, 147 aa, Cryptococcus neoformans
MIISKQNRRAIYEYLFKEGVLVAPKDFNRPSHPDLPTVRNLEVIKAMQSLNSKGYVKTQFSWQWYYYTLTEEGLAYLREFLHLPSEIVPQTHMKPVARQTGRPSGQREGAYRAPRGDREYRRRDDGEKEGGEYRPRFGGVARGAPAS

SEQ ID NO: 7428 - protein, 516 aa, Oryza sativa
MDAAHKRKRPDADDDGAAGAVDLSSLEGADDVEVLDLRAAKRLLLAFERRLRDNLEARMKHPDDPARFADSEIALHAETDRLRLLAGAPDLFPDLVPLGLASSLSSLLTHDNADLAAAAASLLADLTDSDDPDDLAGLHSLADALVEANALDLLVHNLSRFSEADPDEAEAVHHTLSVVENLLELRPQLADIVCDRTKLLRWLLARLKAREFDANKQYASEILAILLQDSPANQKRLGNINGVDGLLQAVAMYKSRDPKTSDEEEMLENLFDCLCCVLMPMENKERFVKAEGVELMIIIMKQKKLAYSSAIRTLDFAMTRFPPACERFVDVLGLKTAFAAFMGKIPVNKKNKKESYQEALEERVISLIASLFGGITKGSRRIRLLGKFVENECEKIDRLMEFYTRYSERVKAETERLDSLDLDDLEMDEDERYNRKLEAGLYTLQLIALILGHIWHSGNSQMRTRIELLLRQNKLTKDDVKDILEEYHDNIGDLDGPEEKERAQGRTKEIIASLSL

SEQ ID NO: 7429 - protein, 811 aa, Treponema denticola
MIIAIDGPAGSGKSTLAKMLAEHLNITFMNTGSFYRALALAVLRSFGGGNDGSGGQTPDLSDEKKWTSFAEKTELFYINGSMFLGNENVEAYLRSDAVESIVAPLSAIVPIRHILNKKIREEAAKTGAVCEGRDMTTVVFPDADIKFYLDASVEARAKRRFDQGTSNLSPEEIKKTILERDEVDKNKKEGSLKVAPDAVYLDTSDLNINEVYEKMLAEVSAIISASKSENINNKGLSMEKMEVVKDVEKDSNGNIQAQLQEEYLNNFEAPEAGTIKEGYVVAVNNGTVFVDVGGKSEGHIPLDEFDEEPKVNDKVTVLIEKTESSNGHLSVSKLKADRLILQKEFKQAYADKTPIDGTIAKQVRAGYEVKLGGGLTAFLPLSQADVSRVEKPETLVGVKSKFYIEKLSFNSRSGENIVVNRRKYMEGRTEKERDAFFQNTKIGDTVKGTVKSFTSFGAFIDLGGFDGLLHINDMSWGHVTRPKDFVKKGEEIELKVIRLDPENKRINLSLKHFTQDPWLQFEDKFHVEDIVTGTVTKTTDFGAFIELDEGIEGLAHISEFSWVKKINKPEDILKPGDKVTCMILGYDIQAGRVSLGLKQVTDNPWDTIEERYPVGTRLTRKVVKITNAGAFISLEEGIDGFLHADDISWIKRVKHPGSELEVGKEIEVIVIECDAESRRIRLGIKQLTDDPWEKFGAAYKVGSIVEGEVSSITDFGVFVKVPGDIEGLIHKQNLVESRDETPEEALAKYAVGDKIKAVVIEINPRNKKTAFSIKDFKRKQQQEEISQYMSTEQEDDDSSYTLGDLLKNKPE

SEQ ID NO: 7430 - protein, 292 aa, Pseudomonas syringae
MSRIVSVAATQMACSWDLEANIETAEKLVREAAAKGAQIILIQELFETPYFCQKPNADYLQLATTLESNVAIKHFQKIAKELQVVLPISFFELAGRARFNTIAIIDADGTNLGIYRKSHIPDGPGYHEKYYFNPGDTGFKVWQTRYAKIGVGICWDQWFPECARSMALQGAEILFYPTAIGSEPHDKTISSRDHWQRVQQGHAGANLMPLIASNRIGNEEQDGYDITFYGSSFIANQFGEKVAELNETEEGVLVHSFDLDELEHIRSAWGTFRDRRPNLYGAVKTLDGSLES

SEQ ID NO: 7431 - protein, 655 aa, Burkholderia vietnamiensis
MCGIDGFLNSVAFDEETARGTLARMTASLAHRGPDGQGMWVDPEAGIALGHRRLAIVDLSVQGRQPMASACGRYVLVFNGEIYNHRELRAELERTGRAPAWRGRSDSEVLVAAIAAWGVDATLRRATGMFAFALWNRASRVLTLARDRIGEKPLYYGRIGDALVFASELKALRGYPGFDGAVDRDALCLYLRQSSVPAPHTIYRGISKLPPGTFIQFEHARDTPRVRAYWALEQAIEAGRERPFDGNADDAVGQLDAVLRQAVARQMEADVPLGAFLSGGIDSSAIVALMQAQSAKPVDTFTIGFHEAGYDEAGYAKAVARHLGTRHTELYVTADHALAVVPKLPSIYDEPFSDASQIPTFLVSDLTRRHVKVSLSGDGGDELFGGYTRYFLTPRLWRKLHRVPAAVRARIAAALHALRPDHADQLAAVAQGAWGGVDARDGASRIGDRLHKLGHVMTAESRIGLYRLLMSSVHHPERLALAGQEPPTPLDTVSAWPAHLSFAEQAMAIDTLTYLPTDILAKVDRAAMAVGLETRMPFLDHHVVEFAWRLPAAVRLPQGQPKALLRRLLDQYVPRALIDRPKQGFCAPVDHWLRGALRDWAEALLEPSRLRAEGFFDAAAVERLWRQHLTGRMNWQHQLWTVLMFQAWLEGQRAA

SEQ ID NO: 7432 - protein, 334 aa, Eustoma grandiflorum
MEVQRVQEIASLSKVIDTIPAEYIRSENEQPVISTVHGVVLEVPVIDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSAINYQFWPKNPPAYREANEEYAKRLQLVVDNLFKYLSLGLDLEPNSFKDGAGGDDLVYLMKINYYPPCPRPDLALGVAHTDMSAITVLVPNEVPGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLNKLPQ

SEQ ID NO: 7433 - protein, 617 aa, Arabidopsis thaliana
MLLKTVSSSSSSALSLVNFHGVKKDVSPLLPSISSNLRVSSGKSGNLTFSFRASKSSTTDALSGVVFEPFKEVKKELDLVPTSSHLSLARQKYSDECEAAINEQINVEYNVSYVYHAMYAYFDRDNIALKGLAKFFKESSLEEREHAEKLMEYQNKRGGRVKLQSIVMPLSEFEHVDKGDALYGMELALSLEKLVNEKLLNLHSVASKNNDVHLADFIESEFLTEQVEAIKLISEYVAQLRRVGKGHGTWHFNQMLLEGVNSRELKQYRNLPIMASQTPNLECRMYEAKYPEVDMAVMIQVKNIADMGAYVSLLEYNNIEGMILFSELSRRRIRSVSSLIKVGRIEPVMVLRVDKEKGYIDLSKRRVSEEDIQTCEERYNKSKLVHSIMRHVAETLSIDLEDLYVNIGWPLYRRHGHAFEAFKILVTDPDSVLGPLTREIKEVGPDGQEVTKVVPAVTEEVKDALVKNIRRRMTPQPMKIRADIELKCFQFDGVVHIKEAMKNAEAAGNEDCPVKIKLVAPPLYVLTTQTLDKEQGIEILNKAIAACTETIETHKGKLVVKEGARAVSERDEKMLTEHMAKLRLDNEEMSGDEDSGDEEEDTGMGEVDLDAGAGIIE

SEQ ID NO: 7434 - protein, 335 aa, Citrus unshiu
MEVERVQAIASLSHSNGTIPAEFIRPEKEQPASTTYHGPAPEIPTIDLDDPVQDRLVRSIAEASREWGIFQVTNHGIPSDLICKLQAVGKEFFELPQEEKEVYSRPADAKDVQGYGTKLQKEVEGKKSWVDHLFHRVWPPSSINYRFWPKNPPSYRAVNEEYAKYMREVVDKLFTYLSLGLGVEGGVLKEAAGGDDIEYMLKINYYPPCPRPDLALGVVAHTDLSALTVLVPNEVPGLQVFKDDRWIDAKYIPNALVIHIGDQIEILSNGKYKAVLHRTTVNKDKTRMSWPVFLEPPADTVVGPLPQLVDDENPPKYKAKKFKDYSYCKLNKLPQ

SEQ ID NO: 7435 - protein, 448 aa, Streptococcus pneumoniae
MTSAKEYIQSVFETVKARNGHEAEFLQAVEEFFNTLEPVFEKHPEYIEENILARITEPERVVSFRVPWVDRDGKIQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGTVWTYAGNYDIALPCATQNEINGEAAKRLVAQGVICVSEGANMPSDLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 7436 - protein, 268 aa, Triticum aestivum
  misc_feature (160)..(160): Xaa can be any naturally occurring amino acid
  misc_feature (175)..(175): Xaa can be any naturally occurring amino acid
MAAGGMSREERWSLAGATALVTGGSKGIGHAIVEELAGHGARVHTCARSAAELEECRRRWEAKGLPVTVSVCDVSLRAHREQLVETVKQVFDGKLDILVNNAAQILAKPGVEWTSEEYSHLMATNFESCFHLSQLAHPLLLRASIAGGGSIVNISSLGGXLGFPGLTIYSMTKGXINQLTRSLATEWAQNKIRVNCVAPGATKSDMLNSVGTDRLPPKIKENELTRTPMRRAGEPEEVAAVVSFLCMPAASFVTGQVITVDGGRTISA

SEQ ID NO: 7437 - protein, 541 aa, Arabidopsis thaliana
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 7438 - protein, 363 aa, Triticum aestivum
MEEIGHHFGLGATAHGQHHSQLPWGSSPLSAVIAPPPQQQQQQQQSAGYLAHSPLSLNTAPPSGSHGGGSGCSNPVLQLANGSLLEACAKAAKEPSSSSYAADVEAIKAKIISHPHYSSLLAAYLDCQKVGAPPEVLARLTAVAQDLELRQRTALGSLGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 7439 - protein, 1064 aa, Clostridium perfringens
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEEEVLSIENSLKGVTLENGFLKINEEVASGTKIIVKAYDSLNDMTAYKEIEVREDGEKGTFVQFLKNDGLYYGENFSWNIWGFGENSSGKEFNLNIKTDLGVGAFVDEEKFIVRRRTWGYDWVNDWDEQTYTFYLGKEDRNLFCIYENNKILTSLKTAIEETTPKIQVALMDHKNTIKAYLSHKPLIGVKYGLYINGIKAKGVSTLVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVPRKENEGKYYLYRLYFNGLSKKGKHVNKITYAVDPYAVSVGVNGEKGALVDLFNKECVPEGWNKYNKPKLINKEDSIIYEMHIRDFTINENSGVSESLRGKFLGTVEEGTFYIDKESGNKVKTGLDHLKELGITHVHLLPVFDFASVNEEITKDENNRNWGYDPKNFNAIEGSYSTDPYTPSRRIIEFREMIKKFHDNGIRVILDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKVWQVIEGIKGSINSITYKPMESINYLEAHDNYTLWDQIVKSQNHSVEKGHYRDFNEENILDNLYVKEDLLGASILFTSQGIPFIQSGAEFLRSKDGDHNSYKSPDSINALNWAEKEKYIDVFNYYKDLISLRKNHSAFRMKNPEDIIGNLEVYFYDNNDTSGVIIAHYKNNANEDLWKDIVVIYNGTTIDDYNVISSMPKSSNGFWNIAVKSWALNQFGIERVSEDEIPKIKSHSMMILYDE

SEQ ID NO: 7440 - protein, 523 aa, Aspergillus phoenicis
MRITSAIASLLLVGTATSLQNPHRRAVPPPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 7441 - protein, 344 aa, Arabidopsis thaliana
MTTLFLLIALFITTILNPTSGESVGVCYGMMGNNLPSQSDTIALFRQNNIRRVRLYDPNQAALNALRNTGIEVIIGVPNTDLRSLTNPSSARSWLQNNVLNYYPAVSFKYIAVGNEVSPSNGGDVVLPAMRNVYDALRGANLQDRIKVSTAIDMTLIGNSFPPSSGEFRGDVRWYIDPVIGFLTSTNSALLANIYPYFSYVDNPRDISLSYALFTSPSVVVWDGSRGYQNLFDALLDVVYSAVERSGGGSLPVVVSESGWPSNGGNAASFDNARAFYTNLASRVRENRGTPKRPGRGVETYLFAMFDENQKSPEIEKNFGLFFPNKQPKFPITFSAARDGTAVE

SEQ ID NO: 7442 - protein, 72 aa, Treponema denticola
MAKEEAIEVEGIVKESLPNTMFRVELKNGHVILAHLSGKMRKHYIKIVPGDTVKVALSPYDLTRGRIIFRER

SEQ ID NO: 7443 - protein, 172 aa, Triticum aestivum
MGSEAGGGAAAIDLLRSAAPFLPDADLLLTPGTGLVLVDLVNGFCTVGAGNLAPVTPNKQIEKMVEESTRLAKVFCQRNWPVFAFLDTHHPDRPEPPFPPHCIIGSGEENFVPALEWLENDPNVTMRRKDCIDGYLASFEKDGSNVFSEWVAKFQIKTVRDPSYLNVRWKKV

SEQ ID NO: 7444 - protein, 421 aa, Peptoniphilus asaccharolyticus
MTDTLNPLVAAQEKVRIACEKLGCDPAVYELLKEPQRVIEISIPVKMDDGTVKVFKGWRSAHSSAVGPSKGGVRFHPNVNMDEVKALSLWMTFKGGALGLPYGGGKGGICVDPAELSERELEQLSRGWVRGLYKYLGDRIDIPAPDVNTNGQIMSWFVDEYVKLNGERMDIGTFTGKPVAFGGSEGRNEATGFGVAVVVRESAKRFGIKMEDAKIAVQGFGNVGTFTVKNIERQGGKVCAIAEWDRNEGNYALYNENGIDFKELLAYKEANKTLIGFPGAERITDEEFWTKEYDIIVPAALENVITGERAKTINAKLVCEAANGPTTPEGDKVLTERGINLTPDILTNSGGVLVSYYEWVQNQYGYYWTEAEVEEKQEADMMKAIKGVFAVADEYNVTLREAVYMYAIKSIDVAMKLRGWY

SEQ ID NO: 7445 - protein, 357 aa, Treponema denticola
MNDKIAIIGAGSWGTAVACSLGKNGHRVVLWSHTAGVADSINTEHINVKYLPKHKLPKTVSASTDMEEVCKDASFIFLASPSLYLTSAVEELLKFAPFSHDDGEMPYPTIAVLTKGFIPDENGEPQFIIDVLEKMLPDFYKNHLVYVAGPSHGEEVAEGKLTGLIAASQNPMCSIRCREILRSRSLLVYSSLDIIGVQVCAAAKNVVAVAFGVLDALTVTSDIFGDNTESLLLAAGLNEIQTIGRAMGATHPETFTSISGVGDLDVTCRSKYGRNRRFGNEIITKKILLSFENLDDLIKNIDKIGYLPEGVVACKYLNILAEKRNLKLPICSGLYKILNKELKPLDLIENLLQGDTK

SEQ ID NO: 7446 - protein, 664 aa, Nostoc punctiforme
MKVKVSYSPNLSEVNEVDLTTETPTRGEWLIGRSPDSDLVLDSPDISRVHAKFFVKAGNYYFSDLGSRNGSIFNGKQAEKDRPYSLSDGDIIRIADYVLILEAVAPAYEQPETVFRIIDPSLFSRPRSPENVSAANVVNPSPEVVSEVPAPITPEVETPSPEVSETSEVVANQPDDVIPVVEVIAPENIIQSPEAVSEVPHDVHDEIVDLQSVAPEVSADVEEVEIPEVSENDEEVSFTVAEAAIAAPENIIETSEEEITLPEVTHDEVTDFETALATESTFVQRRDTSSIPQATDHEDAEFEAALEAEVTFVQPRDIFHQVPATSPEDAELEAALEAEVTFVQPRDIFGEVSNEESTVLEVTHNENEVVDLDTPVAEEVGLEFGEFVNEVTEEEEIQPQETLSQDTQDINDELADLDILFTAEESVDIDEVEPSFAVDETGGEVSEALTEPDNIVVEVSSNQYIDLNNTNTEEASVNVDDVVLVSEVAELADIQSLETTKSEVPESISQTIEEVTEVEATQFDETPEEINVSEPPQVIIERNIVLIAHESKKSELAEFVSQHQEFFSQSFTITWPSVGEVLHQQAGITISQQTPAPISGGYQTIASLVGAGEILAVIFLRDLLQPQPGQANEEALLRLCTINQVLLATNLPTAEAIVHYLKHI

SEQ ID NO: 7447 - protein, 361 aa, Myxococcus xanthus
MRLGVLTGGGDCPGLNALIRGLVKRGTHEFGYEFVGIENGYMGLVEPGLAHPLTEEDTRGILPKGGTILGTSNKANPFSYATREDGHWVERDVSDQVLLRCEELGLDGLIAVGGDGTLSIAHRLVEKGLKVVGCPKTIDNDLSGTDQTFGFDTARLIVTEALDRLHSTAEAHDRVMVVEIMGRHAGFLTLESGIAGGADVILIPEIPYSVESVVEKIRRRSTRRRSFSIIAISEGAFPQGGELAVLDTAEAIPGRGVVRLGGSGKALADLLARHIEAEIRVTVLGHLQRGGSPSAADRVLATRYGCKVLDLVSAGQWDHMVALRAGEIIAVPLSESRKERRVDPAGELVRFTKSMGISFGD

SEQ ID NO: 7448 - protein, 380 aa, Ustilago maydis
MASNTSADAFERRTAEVKRVTNETKIEVSLSLDTHPTFAPQIINVKTGIGFLDHMLHALAKHGGMSLTLACDGDLWIDDHHTAEDCALALGAAFKKALGPVKGIKRYGTGHAPLDEALSRAVIDISSRPYCVAELGLKREKIGDLSCEMIPHVFHSFAMEAGVTLHVDCLRGDNDHHRAESAFKALALAIKEAITRTGSDDVPSTKGEYAAEKPKTSQLISAKIYADPLKLMYSYFHPFVLQAFCENVDEEKLFTLPGFHENVDTLYARVCPCMWLAFKDAADDERALSRQTRIACQMLCQAICHKQQPVKPRKAFSQGYNRREPELSELNEGWFMRHGNPWLVISTHTHTHTILQIVGQRQHLDRFRFMHLTPPGGGAG

SEQ ID NO: 7449 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKSTAKYFKGSVWNYDGKADIALPCATQNEINGKQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 7450 - protein, 200 aa, Schizosaccharomyces pombe
MASHLASIYGTEQDKVNCSFYYKIGACRHGERCSRKHVKPNFSQTILCPNMYKNPIHEPNGKKFTQRELAEQFDAFYEDMFCEFSKYGEVEQLVVCDNVGDHLVGNVYVRFKYEESAQNAIDDLNSRWYSQRPVYAELSPVTDFREACCRQHETSECQRGGLCNFMHAKKPSPQSFTRFGTSTKKVFGLKCSRRNEKGAQ

SEQ ID NO: 7451 - protein, 112 aa, Unknown
  Synechococcus sp. WH 7805
MKKVEAIIRPFKLEDVKLALVNAGIVGMTVSEVRGFGRQKGQVERYRGSEFTVEFLQKLKVEVVVDDARVDTVVTAIAEAAKTGEIGDGKIFISSVETVVRIRTGDRDGAAL

SEQ ID NO: 7452 - protein, 378 aa, Arabidopsis thaliana
MSSSTASATTGMKGKKPSIEIATSNPSLPEDLVVSCLARVSRLYYPTLSLVSKSFRSLIASPDLYKTRSLLGRTESCLYLCLRYSPEDNPRWFTLCRKPNRRTLSKEKNESSGNLLVPIPIINSPPLEWSSIVAVGSHLYAINGPIEDAPCSNVSFLDCRSHTWLEAPSMRVAHTNSQLDGKMYLAGSSENVDSLNCIQVFSTKTQTWKPVPFQKRIFGVGDLEGKIYTICRTECGQGVTIKPKDLTCDVVGFCGEKDWSSVCMIGNIVYFYRPNGEFLWIYSGKGESARRNLKGLEGLPKFDDYASVKLVDYGGKLMVLWDTYVPESESKEKMIWCAEISLQKKCNNEEIWGTVEWFDAVLTVPEDCKFVRAIAATV

SEQ ID NO: 7453 - protein, 590 aa, Pseudomonas syringae
MCGLAGELRFDHQPADLAAVERITHELAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHDDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTPNDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 7454 - protein, 432 aa, Yarrowia lipolytica
MTFSEPQKRISSAADVDSFKRSQPYATIISLLDKYSSTVQEHLLPPNEDELAASSKALVTLCRKLSALIDETPPLEGPRRFGNVAVRDWHDKMEAQTTALLTEAFPSINKDSIIELQYYLHGGMGSKQRLDFGTGHELSFMAFVGGLQKLGLLETDLPAPDVLFIFETYFVLVRKLIMTYSLEPAGSHGVWGLDDHSHLPYILGSAQKVSRSVTASTLLVPTKYDKECPPSSVMNPRIVQQQKTTNLYFAAIAFIYDIKSGPFYEHSPILYDISGIATWAKIHSGMIKMYIAEVLGKFPVVQHFYFGSELYPWKDTEGNDLPYSKVEDEEPVKPKLPLGFKSKKEPQTTPHARLPLMGPRGMPMETVERLARRDGQRAAREKEEREDRASGGASGTTGAPGATALPPTRAPGSSVPGGDAPGMAPTKAPWAK

SEQ ID NO: 7455 - protein, 656 aa, Burkholderia xenovorans
MHNNGLQSATGSAGSASGATPFHQGAMTLEEIKDAVAIANVPALLMVLHQFTGDDRWLETPYLPTRGKGLLDHDSGGLPEEIQLQIRHSAIDVIWKLQSGIAPKIVAPSPEKLIRMMSVYMGEEVDAIYGQMLSSEFARRVGAPVPGEDNTHVEPPEGFNVIVIGTGVAGVAAAERLEAMGVSYVILEKQKAAGGNWWQNTYPGCGVDTPSHLYSFSFAQVDWKKHFALRDDVQSYIAGSLRKVGAENRVRFDTEAVAAIYDEEKKIWQVHVKNQAGVSETLTANVVLSAVGVLNRPTLPKVAGLEKFQGTMFHSAEWNNAIDLKGKRVAVVGTGASSMQIVSAIGDRVGHLTVFQRSPQWVAPFDKFGLAILDPLRMLIQSCPLYRTWYWLRLFWQFGDKVIEALRKDPLWPHPERSVNARNDAHRDYFTRYLKEELDGRPDLFDKCLPTYPPFGKRILLDNGWFRTLRRDNVTLVTEAVTEVREHSLVSASGDEYAADVVIWATGFDVARFVSSMDVRGIGGVSLRTAWNDDDPRAYLGISVPGFPNFLMLGGPHSFPGSGSFMFFMEVQMRYISRLLKQMFKKGIVAVDAREDANNRYNELVDELHAKTVWTHPGMSTYYKNSKGRVVFVMPFLNVEYWEMVKNVNLEDYTVR

SEQ ID NO: 7456 - protein, 205 aa, Oryza sativa
  misc_feature (191)..(191): Xaa can be any naturally occurring amino acid
LNVAIRHNKSISRLSSLSFHTSSLVNSAAANTQQQQQSGPGHFGFYRQVELFYDRAAKILEEKLVADMTKTRLPDEEKLKKVRGILKIIKPCNHVLEIRFPIRRDNGELHMIEAYRAQHSQHRTPCKGGIRYSLDVNLDEVKALAALMTYKCACVDVPFGGGKAGVKINPKDWSEAELERITRRLTVELAXKGFIGPGIDVPAPD

SEQ ID NO: 7457 - protein, 214 aa, Gossypium hirsutum
MKVCNKNLFLSALLCIAVAGVLGQAPSNPPTSTPATPTPPASTPPPTTQAPPTPTATPPPVSTPPPTSSPPPVTASPPPVSTPPPSSPPPATPPPASPPPATPPPASPPPATPPPASPPPATPPPATPPPATPPPATPPPAPLASPPATVPAISPVQTPLTSPPAPPTEAPAPTLGAATPGPAGTDTSGANQMWTVQKMMGSLAMGWALLNLMV

SEQ ID NO: 7458 - protein, 165 aa, Unknown
  Photobacterium sp. SKA34
MAQQKAILAGGCFWGMQDLIRRQEGVISTRVGYTGGDVANATYPNHGSHAETIEITFDDDQTSFENILAYFFQIHDPTTTNRQGNDIGTSYRSAIFYTSEAQKNTAQDLIKRINASGVWPGTVVTEVVPASDFWQAESEHQDYLLHRPNGYTCHFPRPDWVLPEE

SEQ ID NO: 7459 - protein, 571 aa, Candida albicans
MPEDYEKYRMGSSNESHQKSVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGSELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWANVA

SEQ ID NO: 7460 - protein, 631 aa, Magnetospirillum magnetotacticum
MCGIAGIVADRPVSPGAVEAMTGRLVHRGPDDQGIWRSDDGCAVLGHRRLSILDTSAAGHQPMERDGLVTVFNGEIYNFVEVRAELVGLGEVFHTNSDTEVLLAAYDRWGPECFARFNGMFALAILDRRRKVLVCARDRFGEKPFLFAARPGLFAFASEYKALLAMAEIGRDFDPVPLLRFAHRPATGLDDERATLFPAILQLLPGERLELDLSTLDTRIDRYWTLARDPALGALGMGEAAERFRDLLTDSIRLRLRSDVAVGSCLSGGLDSGSIIMLARRLLGDDAPYHVFTGRFPGTRADEWDYARHTSQAAGAIVHQVEPSAAGLLADLPDFLWANELPVGSASQYAQYCVFRLAKEQGVTVLLDGQGADEILGGYEQYFARYLAGLPGPERGAEEAAIRARYPGALDSPRQALSKALPPRLRHWLAQISGKGSDLLFGLSPDLAEQVAKANAPPVVPQGWSPLAAELMRDSFSTHLPVLLRYGDRNSMAHSREVRLPFCDHRIAEFALSLDPKLLMGEAQTKRLLREAVKGILPEQVRTRWNKQGFLPPQDIWFAQGLIDEAERVIEDPSFARAGYWNVSWWRCAIRRFRAGETHLGWVLWRPLMLESWRRHFLERITAQPGVEALP

SEQ ID NO: 7461 - protein, 718 aa, Unknown
  Synechocystis sp. PCC 6803
MQEFDKSISFDGRDIRLKMGTLAPQAGGSVLIQSGDTAVLVTATRAKGRDGIDFLPLTVDYEGRLYAAGRIPGGFLRREGRPPEKATLISRLIDRPLRPLFPHWLRDELQIVATTLSMDEEVPPDVLAVTGASVAVILAQIPFKGPMAAVRVGLVGDDFIINPTYREVHNGDLDLVVAGTPAGIVMVEAGANQLPEQDIIEAIDFGYEAVQDLINAQRELMTDLGITLATSEPPPVNTAVEEFIANRASKKIITVLGQFDLGKDGRDAALDEIKATEVETAIAELPETDPVKQSVEEDPKLVGNLYKALTKKLMRKQIVDDGVRVDGRKLEQVRPISCEVGFLPRRVHGSGLFNRGLTQVLSLATLGSPGDAQDLADDLHPEDEKRYLHHYNFPPYSVGEARPMRSPGRREIGHGALAERAIIPVLPPQEDFPYVVRVVSEVLSSNGSTSMGSVCGSTLALMDAGVPIKKPVSGAAMGLIKEGDEIRILTDIQGIEDFLGDMDFKVAGTDSGITALQMDMKIDGLSMEVVSKAIMQALPARLHILDKMLATIREPRPELSPFAPRLLTLKIEPEHIGMVIGPGGKTIKGITEQTSCKIDIADDGTVTIASSEGERAERARQMIYNMTRKLNEGEVYLGRVTRIIPIGAFVEVLPGKEGMIHISQLTEGRVGKVEDEVGVGDEVIVKVREIDSKGRLNLTRLGIHPDEAAEARRNASRG

SEQ ID NO: 7462 - protein, 592 aa, Bacillus thuringiensis
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 7463 - protein, 401 aa, Streptococcus pyogenes
MNEFEDLLNSVSEVNPGDVVTAEVLTVDNGQANVVIEGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVIEEAAKEARAEVFSKISEGAVVTGTVARLTSFGAFIDLGGVDGLVHVTELSHERNVSPKSVVSVGEEVEVKVLSIDEEAGRVSLSLKATTPGPWDGVEQKLAQGDVVEGKVKRLTDFGAFVEVLPGIDGLVHISQISHKRVENPKDVLSVGQEVTVKVLEVNAADERVSLSIKALEERPAQAEGDNKEEKRQSRPRRPKRESRRDYELPETQTGFSMADLFGDIEL

SEQ ID NO: 7464 - protein, 334 aa, Glycine max
MGEIALPNGISNGNINGVNGQSHSLNGYRKSCWYEEEIEEDLRWCFALNSILHTGASQYQDIALLDTKPFGKALVIDGKLQSAETDEFIYHECLVHPALLHNPSPKNVFIMGGGEGSTARELLRHKTIDKVVMCDIDEEVVNFCKSYFVVNKEAFRDTRLEVVINDARVELEARDESYDVIIGDLADPIDGGPCYKLYTKSFYELIVKPRLKQGGIFVTQAGPAGIFSHTEVFSCIYNTLRQVFKYVVPYSAHIPSYADIWGWVMASDSPLDLSAEELDLRMRHRIKGENGYLDGKTFTSASTLSKTVRNSLDNETHVYTEESARFIYGHGKHA

SEQ ID NO: 7465 - protein, 136 aa, Prototheca wickerhamii
HEQLESIGLPLNTFNNRKPFTARIVSVDRIVGPKATGETYHVVLETRGEIPFAEGQSYGVIPPGSKVNSKGKEVPHGTRLYSIASTRYGDFFDGRTASLCVRRATYWDPETGAEDPAKKGICSNFLCDAKPGQEVT

SEQ ID NO: 7466 - protein, 336 aa, Dechloromonas aromatica
MSYQVTVQPSGKQFAAEADETLLDAALRQGLTLPYGCKDGACGACKGKVVSGTVDHGKAQAHALKDDEKAAGQTLYCCAKAQSDLVIECKQVSSAGDIPVKTLPSRIEKLEKLAPDVIELQLRLPASERLQFWAGQYIDILLKDGKKRSYSLANAPHDDALLQLHIRHVPGGLFTDQVFSTMKVRDILRFNGPHGTFYLREDSKKPMILLAGGTGFAPIKAIVEHAIAEQCERPMFIYWGAKARVDLYQNALPEQWTAEHGSIKYVPVLSEPASGEWAGRSGFVHQAVLADFADLSGYQVYACGAPVMIEAAKRDFMARGLPEEEFFADAFTFSTN

SEQ ID NO: 7467 - protein, 205 aa, Dechloromonas aromatica
MKRTRTSKAWMREHINDTYVQLARKEGWRSRAAFKLMEMDDKDKLLKHGEVVVDLGATPGGWSQVAVKRVGDGGLVFALDLLEMEPIHGVHFIQGDFREDEVLQQLEEQLGERRVGLVMSDMAPNMSGVPLVDQARIMHLAELGLEFSRVHLKPEGAFLVKVFQGTDYETFLKQMRETFKTVAVRKPDASRDRSPELYLLGRTLR

SEQ ID NO: 7468 - protein, 415 aa, Chromobacterium violaceum
MFAADQTIAKFDPELAAAIAAECQRQEDHIELIASENYTSPAVMEAQGSQLTNKYAEGYPGKRFYGGCEHVDVVEQLAIDRVKQLFGAEYANVQPHSGSQANQAVYFSILKPGDTVMGMNLGHGGHLTHGSPANLSGKMFNIVAYGLNDKEEIDYDDMERVAMETKPKLIIGGASAYALRFDFERMGQIAKKVGAYFMVDMAHYAGLVAAGLYPNPVPHADFVTSTTHKTLRGPRGGIILAKAEFEKSINSNVFPTLQGGPLEHVIAAKAVAFKEALQPAFKEYQQQVLKNAAIMAKTLAERGLRIVSGRTESHVFLVDLRAKGLTGKQADALLGRAHITVNKNAIPNDPETPFVTSGIRIGSPAITTRGFKEAEAIEVANMVADVLDNPNDDALIARIAEKATALCHRFPVYAK

SEQ ID NO: 7469 - protein, 549 aa, Porphyromonas gingivalis
MAKSALHLARMSYQPKMPASLQGAVKIIEGKATEAVSDKEEIAAIFPRTYGLPLISFAPGGERTEYPPTNVGVILSGGQAPGGHNVIAGLFDEMKLLNPDSRLFGFLMGPDGLIEHKYRELTAEVIDEYRNTGGFDMIGSGRTKLDKPEQFEAGLEILRELDIKALVIIGGDDSNTNACILAEYYASIDAGIQVIGCPKTIDGDLKNKQIETSFGFDTAAKVYSELIGNIQRDCNSARKYWHFIKLMGRSASHITLECALQTHPNICIVSEEVEANNYYLDDVVTYIAETVVRRSEAGMNFGTVLIPEGLIEFLPAMKRLIKELNEFLSQNDAEFKLIKRSAQRQYIKNKLSPENSRLYDSLPVDVARQLIADRDPHGNVQVSLIATEKLLADMTAQKLAEWAEEGRFQGRFSTLTHFFGYEGRCAMPSNFDANYCYCLGRAASILIAAGKTGYMAAIKNTADPVSEWEAGGVPMTMMMNMERRSGKMKPVIRKALVDMDGEPYRALREMRREWALSTEYVYPGPIQFFGPEHVCDSPTMTLRLEKNDR

SEQ ID NO: 7470 - protein, 503 aa, Spinacia oleracea
MGRHSSRKIRFSACRIVAEKLDIDFSDPDWKTEYQKDLENTFNLPHLKDVLDVKPRPSTFSLMHRDGSRWLRNENVTDRAEGPEDRKNDYVDIDDRTLLKVIKYASPTSAGAECIDPNCTWVEQWVHRAGPRKEIYFEPTKVKAAIVTCGGLCPGLNDVIRQIFFTLERYGVQKIFGVRYGFRGFFDPELPMKKLSREHVQDINLEGGSLLGTSRGGASTSDIVDSIEAKEIDMVFILGGNGTHAGANAIHNECRKRKMKVSVICVPKTIDNDILLMDKTFGFDTAVEAAQRAINSAYIEAHSAYHGIGLVKLMGRSSGFIAMHASLASGQVDICLIPEVPFTLDGPNGVLSHLEHLIRTKGAAVVCVAEGAGQELLAAPDLKDLSGNAVLGDIGVHFKNQIKSYFNEKGIHADVKYIDPTYMVRSVRANASDAILCTVLGQNAVHGAFAGYSGITMGICNTHYVFLPITEVIHTPRAVNPNSRMWHRCLTSTGQPDFSPRNC

SEQ ID NO: 7471 - protein, 499 aa, Spinacia oleracea
MEPKIVTGEGGYALDDVPHFSDYLTNLPTYPNPLQTNPSYSVTKQYFVDFDDTVVQKAVQHKDGPRGIHFRRQGPRQKVYFKPDEVTACIVTCGGLCPGLNTVIRELVCGLDYMYGVKNILGIECGYKGFYARNTLPLTPKTVDSIHKRGGTILGTSRGGYVTSKIVDSIQDRGINQVYIIGGDGTQKGASVIYQEVRKRGLKVAVVGIPKTIDNDIPIIDKSFGFDTAVEEAQRVGNAAHTEAESVENGIGLVKLMGRDSGFIAMFATLASRDVDCCLIPESPFYLEGEGGLYEFIGRRLRENGHMVIVIAEGAGEKVEERDPSGNKAFKDVGLWLSFMIKEHFAKTKLNITLKYIDPTYMIRAVPANASDNVYCTILAQSAIHGAMAGYTGCTVGPVNGRQCYIPFYRVIEKPNKVVITDRMWARLLSSTNQPSFMHPPKGAIIEGKQDEVVLSESAAEESNENEKCTPTSTSLSIHDNHVDDQYSMSNGSSELLLK

SEQ ID NO: 7472 - protein, 1330 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7473 - protein, 431 aa, Burkholderia vietnamiensis
MYSAAPVNLYTLNGNRMFDRAQSTIANVDPEIFAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYDAAEKLAQEHKPKLIVAGASAFALKIDFARMAQIAKSVGAYLMVDMAHYAGLIAAGVYPNPVPHADFVTTTTHKSLRGPRGGVILMKAEYEKQINSAIFPGIQGGPLMHVIAAKAVAFKEALSPEFKAYQQKVVENARVLAETLVKRGLRIVSGRTESHVMLVDLRAKHITGKAAEAALGAAHITVNKNAIPNDPEKPFVTSGVRLGSPAMTTRGFGPAEAEQVGNLIADVLENPEDAATLERVRAQVAELTKRFPVYR

SEQ ID NO: 7474 - protein, 593 aa, Prochlorococcus marinus
MSEVNKNLSKFEITKNFTCIRFLDQNKERFELEFNLEKGTSFNTFLIRSHEELFIIHPPEKQYLNSFKKVISSVCDQFKLDKINVISGHINPQIIETIKNLSTQFKNTTITCSNPGYKLISELWNQRNPNLENFVETKLPEINIIKKELNLELDNIYLELIPIPTARWPGGLIIYERNQEILLSEKIFSAHIASEDWSETNRVSTEVDRKHFYDCLMAPMSNQVVSIAEKIADYDIKTIAPLHGPAIEYSLKSFLNDYIRWGENLSTNNPKIALIYASAYGNTASIGDALAKGINRTSVEVESINCEFTSNDVLIKSIQNADGYLIGSPTLGGHAPTPIISALGTLLSEGNRDKPVGIFGSFGWSGEAIDLLESKLKDGGFRFSFDPIRIKFSPNKPKIKELEEIGTHFGRKIIKKAKKKPRKSDTGMITSKTDPKLQALGRVIGSLCVLTASKGKDKNNIKGAMLASWVSQASFSPPGLSIAVAKDRSVESLLQIGDSFALNILSEKDFKEPLKRFTKPFAPGEDRFQGLDIELTPNEQIIIPQSLAWLDASVKERMECGDHWVIYAEVLHGNILKSDSLTAVHHRKTGSNY

SEQ ID NO: 7475 - protein, 241 aa, Porphyra purpurea
MAIVTLAELLEAGVHFGHQARRWNPKMFPYIYTERNGIHIIDLVQTSQLLTEACEFVKQASSDGRKVLFLGTKRQAAGIIAQEAQRCDSYYVNQRWLGGMLTNWVTIKSRVTRLRQLEEQDSSGLIDQLPKKEAAVLRRELDKLRKHLNGIKNMTRLPDIVVVVDQKRETTAIQECLKLGIPTICILDTNCSPEIINIPIPANDDAIRSIKLIIGKIADAIYEGKYGQMEPTELISSAEDK

SEQ ID NO: 7476 - protein, 216 aa, Cryptococcus neoformans
MSVMELNGGSVVAMIGKDCVAIASDLRLGNQQVGIAANFDKVFPINDKLYCGLPGLATDVYTLREHLRFRVNMYRMKEEREITPKTFTHLLSSTLYEKRFGPFFLEPVVAGLPTPTSLEPHPRPYISTMDTIGCITTPKDFAVAGTAADKLYGIAEGLWEPDLEPEDLFETISQTLLSAVDRDALSGWGAVVNIINYSDTQSENGLRKLGEEVQVQ

SEQ ID NO: 7477 - protein, 637 aa, Medicago truncatula
MTKSVNTKTRVCCSYCEIILVFLVAASFSSPSPESDTIPKEFTLSVTKFRKRWNQQDPPNNVNPDNIEVVEATEGNHVNGEVADGKSKGGWTTAYILLANQALATLAFFGVGVNLVLFLTRVLRQDSAEAANNVSLWTGTVYIFSLLGAFLSDSYWGRYLTCAIFQLFFVLGLGLMSLTSWLFLIKPLGCGNEHSVCNEPTPLGIGLFYLSIYLVAFGYGGHQPTLATFGADQFDDKSIQQTNSREAFFSYFYFALNVGSLFSNTILVYYEDTGMWTLGFGVSLASAIIALISFLAGSRKYRYVKAYGNPVIRVIQVFVAATRKWNVEPAKEDQLYEVDGNVSAIKGSRKILHSQDIRFMDKAATRTVKDGNESGNQWRLCTVTQVEEAKCVLRMIPVWLCTIIYSVVFTQMASLFVEQGDVMNNKVGKFHLPAATMSVFDICSVLVCTGLYRQVLVPLAGKLSGNPKGLSELQRMGVGLVIGMLAMVAAGVTEFERLKQVQPGQKQSNLSIFCQIPQYVLVGASEVFMYVGQLEFFNGQAPDGIKSFGSSLCMASISLGNYVSSMMVKLVMIFTARGEEPGWIPNNLNVGHMDRFFYLIAALSALDLVIYVFCARWYKGVTNIEGSDNVGSQEDNV

SEQ ID NO: 7478 - protein, 1330 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRGSIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7479 - protein, 591 aa, Prochlorococcus marinus
MLASAQTSNSKLAQINNKLTVQSQNFADDSYAIRSLDWDRSRFDIEFGLRNGTTYNSFIIKGEKLAIIDTSHAKFEELWFEELLKEVNPQEVDYLITSHTEPDHSGLIGNLLELNKNITVVGSKLALKFIEDQIHVPFKKIEVKSGEFLNLGTNPNSGLEHNIEFISAPNLHWPDTIFSYDHSTHVLYTCDAFGLHYCSDEFYDTDQKEIYDDFRFYYDCLMGPNARSVLQAIKRIDKLPELKTIAVGHGPLLHNQVNFWKGKYQEWSSNKSKGNDFVSVCYISDYGYCDRLSQAISHGISKADAQVQLIDLRSSDPQELTSLISESKAVVIPTWPVDSDNELKESLGTLFAALKSKQFTAVYDAFGGNDEPIDSLANKLRELGQKEAFSPLRVKTIPDPIVYQQFEEAGTDLGQLINKKKNIASMKSLDSNLDKALGRLSGGLYVVTASQGEGSTFRQSAMVASWVSQASFSPPGITVAVAKDRAIESYMQVGKGFVVNILREDNYQKMFRHFLKRFAPGADRFADVDVISNIAKGGPVLSDSLAFLDCKVSSRLETPDHWIIYGIVENGNVSDLSCKTAVHHRKVANHY

SEQ ID NO: 7480 - protein, 359 aa, Helicobacter pylori
MKVLSYLKNFYLFLAIGAIMQASENMGSQHQKTDERVIYLAGGCFWGLEAYMERIYGVIDASSGYANGKTSSTNYEKLHESDHAESVKVIYDPKKISLDKLLRYYFKVVDPVSVNKQGNDVGRQYRTGIYYVNSADKEVIDHALKALQKEVKGKIAIEVEPLKNYVRAEEYHQDYLKKHPSGYCHIDLKKADEVIVDDDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKKGELKKYINDKKSH

SEQ ID NO: 7481 - protein, 86 aa, Unknown
  Acidovorax sp. JS42
MAKEELIEMQGKVDEVLPDARYRVTLDNGHQLIAYTGGKMRKFRIRILAGDLVTLEMSPYDLNKGRVTFRHIENRTRTTPPARRRH

SEQ ID NO: 7482 - protein, 1330 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVTQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7483 - protein, 99 aa, Pseudomonas putida
MKLVTAIIKPFKLDDVRESLSEIGVQGITVTEVKGFGRQKGHTELYRGAEYVVDFLPKVKIDVAIDDKDLDRVIEAITKAANTGKIGDGKIFVVNLEQA

SEQ ID NO: 7484 - protein, 468 aa, Methanococcoides burtonii
MEVRGEYEAIIYTGDTIHNVHSASEIQFISLNDAMIGFDSLKASSPLSSSSDKFELVGDIDIYNSDEFACEFHCGNVENMSILTRFLQDTFGLEKCSDDEMFQRFDSSLKAIRGVYAIACHIGDKVFLARDLIGVKSLWYDVSSGFAFASEKKFLEMAGLHEVVELDPRHILCYDFENDIIKSYDREFLQGLAEHQGSFVEIRNGFLSLLKEAVSKRVPDEDFGVMFSAGIDSTILALLCKGFAEAKGVKCNYYTVGLSGQVPSPDIACARKLADELELELNVHEIGLDTVEEYLSTVVPLIEDATVPKTGVALTMYAACRAAKEDGINVLFAGAGADELFAGYNRFKSSESVNEDCIRDIMEMHKVNTYRDDTVAAFTGTIVRYPYLDENFVEYALAIPKEYKISDEMNKIVLRKAGEELGLPKYVVERGKKAAQYGSSFDQALKKLAKRAGFANKTDYINSFQERR

SEQ ID NO: 7485 - protein, 502 aa, Oryza sativa
MSLRLRLAFRLLFCYCLLLAAAHPSSRRLLPLLVVSAAERTNVASLPGLDGALPSRFETGYVTVDEENGGELFYYFIESEGDPGADPVLLWINGGNRCSVLSALFFEIGENLNHHRSPAGAPPLTRLCAAGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLLQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSTYPNYLSYFWANSNNTRENLGIKKGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKFIGQGGSSGEAHYGRTCHRGPEQALDDY

SEQ ID NO: 7486 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 7487 - protein, 228 aa, Mesostigma viride
MKSVGLEEMMEAGVHFGHQTRGWNPKMSSYIYGNRNGIHLIDLVQTARLLSEACDFLFNAAKEGKEFLFVGTKSQASDIIASEALRAESHYVNQRWLGGMLTNWSTIKTRIRKLKDLEQKEKNGILDTLPKKEAAVLKRQLYKLRKYLSGLQDMKYLPDVVIIVDQKREINAVKECIKLGIPTISLVDTNCDPTLADLPIPANDDAIRSINLLVSKLADAIYEGQRVK

SEQ ID NO: 7488 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRFCQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 7489 - protein, 104 aa, Zea mays
  misc_feature (30)..(30): Xaa can be any naturally occurring amino acid
  misc_feature (69)..(69): Xaa can be any naturally occurring amino acid
GWRALYRAKSDCALDLARCTIWTKLCNKEXDSYRLCEASYAIYCVKIDNMTCGTTKLLLTMARILELSXKRLPMLLADAKYFHGTWIWYGAQTVCHRSCFERID

SEQ ID NO: 7490 - protein, 435 aa, Halobacterium salinarum
MTMASKSDSTHDESGDEAADSTEPESALETARRQLYHAASYLDIDQNIVERLKYPKKVHEVTIPIERDDGTVEVFTGYRAQHDSVRGPYKGGLRYHPDVTRDECVGLGMWMTWKCAVMDLPFGGAKGGVAVNPKELSPEEKERLTRRFTQEIRDVIGPNQDIPAPDMGTDPQTMAWLMDAYSMQEGETTPGVVTGKPPVVGGSEGREEAPGRSVAIITQLVCEYYDQPLDETTVAVQGYGSVGANAARLLDKWGATIVAISDVNGAMYEPDGIDTASVPSHDEEPEAVTTYADTVISNEELLTLDVDVLIPAALGNVITKENAEAIAADLVVEGANGPTTSTADSILADRDVAVIPDILANAGGVTVSYFEWLQDINRRAWSLERVNDELEAEMQAAWRAVKDEYENRDVTWRDAAYIVALSRIAEAHEARGLWP

SEQ ID NO: 7491 - protein, 651 aa, Ostreococcus tauri
MSQDPRDRPSGPPYLHPGMMGMPFPVGAPAMTPEQFQEQYGATLRRHQAQIAHAVAMNAAASANPAYAAQQAKLREFWREQMMEIQATHDFKNHLLPLARIKKIMKSDEDVRMISSEAPVLFAKACEMFVLELTMRAWAHAQENKRRTLQRGDIAAAITKTDIFDFLIDIVPRDEAGEGGGDDGENEGPSAPHSCRPYRAFPGHPRVLDTPSIFPRPRRSKPLRATRRLHRPSRTTSPKVARPRGAPFPSTHHITSPEVVSFSEDDVEITRLSMLAKTRPRRVSVGQTLLGLDQALPRSPRSPRPLSSRVRVGATLSKGSFDFDVTMATMTLSLRRFAAHSAAARAPGTKRSRTVVRGVVRGTHGRKRWTIVAKADGEPASVSASCSIDDPASCSLADLELMYVDALWNYYNGGKFTLTDEQYDRLREELNWQGSGFPTLRRYEIEFVQAAISYSRGEAVVDDAKYEELKRKVKAAGKRTDVTALLLYAKGKELLDEAEFELLSGEMKKLGIDVGMRGATCTLSQTSAELSNDPASVASMYSALAIAPFAVGLAPSILLGFVGVHLPASLSLGFALTVCAALTYKLVVYTNLQNAEILLGACPCCEMPIKQFFGGEAPLEKFEHKCSACGTVCTLNRPQRLIETAGGLGRA

SEQ ID NO: 7492 - protein, 563 aa, Psychrobacter arcticus
MESFAELFEASIEETGLDIERGSVITGTVVAIDNDWITVDTGLKSEGIVAREEFLSEEGELEVEVGDSVDVVVEAVDNGMGQTLLSREKAKRVETWNFLEKISDNDEIVKGIISSKVKGGFTVDIGSVRAFLPGSLVDVRPIRDTTHLEGKELEFKVIKLDQKRNNVVVSRRAVMEAENSAEREELLNKLEEGIEIEGIVKNLTDYGAFVDLGGIDGLLHITDMAWRRIKHPSEVVEVGQDLKVKVLKFDRERNRVSLGLKQLGTDPWDNVGGTYPVGSVVKARVTNLTDYGCFAEISEGIEGLVHVSEMDHTNKNIHPSKVVQVGDEVEVMILDIDEERRRISLGIKQTLANPWDEFDKKHERGDKITGTIKSITDFGIFIGLDGGIDGLVHLSDISWNETGEDAIRNYNKGDTVEAMVLSVDSEANRISLGVKQLTSDPFNEYLVNNDRGAIVNGKVKEVDAKGATIELADEVEAYLRASEIQRDRVEDATKHLTVGDDVEAKIISVDRKTRNISLSIKAKDEAEERQAIKELSSTTTTTTAAGSDAQPKTIGDLIKEQMQ

SEQ ID NO: 7493 - protein, 344 aa, Glycine max
MAQSHSGKTSSMTSILLLFMLLISNTGTTGAQSGVCYGRVGNNLPSPQEVVSLFKQYGFQRMRIYDRNHEVLQALRDSNIELLLDLPNIDLQYVASSQDNANRWVQDNVRNFWNVRFRYITVGNEVKPWDSFAQFVVPAMQNIQRAISNAGLGNQIKVSTAIESGALAESYPPSRGSFRSDYRTSYLDGVIRFLVNNNAPLLVNVYPYLAYIENPRDISLDYALFRSPSVVVQDGSLGYRNLFDAMVDAVYAALEKSGGWSLNIVVSESGWPSSGGTATSLDNARTYNTNLVRNVKQGTPKRPGRPLETYVFAMFEENQKQPEYEKFWGLFLPNKQLKYSINLN

SEQ ID NO: 7494 - protein, 447 aa, Yersinia pestis
MNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 7495 - protein, 938 aa, Porphyromonas gingivalis
MVREAKNLRARTKKISLHICRKHAPQSEDFRCVFLRQQVIDRDIEAMAKPYDFYIVWKLSYNHVFTIHPRHTILELPPVYPDTALVPFFIMRFSFFDHMISCEYIFHRKLFVCLHRKNKQKQKSNMRYVIVGGVAGGATAAARLRRIDEKAEIILFEKGQNISYANCGLPYYIGGVIKERENLFVQTPEKFGRLLNLDVRVQSEVLSIDRSDKQIRVREANGREYSEHYDKLLLSPGALPFVPPLPGVDSPGVFTLRNVEDTDAIKSYLDTHKVKRAIVVGGGFIGLEMAENLHARGIAVNVIEMAPQVMAPVDFSMATIVHAHLQEKGIGLYLGKAVKSIEKRGEVLTASLDSGEKIEAELILLSIGVRPNTKLAADAQLAIGPARGIRVNEYLQTSDPDIYAIGDAIEYPHPLTGKPWTNFLAGPANRQGRIVADNMHGQTLRSYEGAIGTAIAKIFDLTVAATGLPAKALKREGLPYESVTVQPNSHAGYYPNAYPLTLKITFHPESGMLYGAQCVGIEGVDKRIDSIAQIIKRKGGIADLMQTEQAYAPPFSSAKDPVALAGYVADNIITGRMKPLHWREMKEVDPNRVTLIDARPRQAYEVEHIPGAISMPVEEIRARIGEIPHDKPIYVYCAVGMRGYFASNILRQCGFSNVRNLIGGYRLYSTITADYSSAGQPATAQLPAKDSPSSHTQVPEVDACGMSCPGPILKLKQSIDQIAVGEQLCILATDPGFARDAQAWCDTTGHNLIRQETIKGKYKVTIEKTACKEEGTCVNETPSKGKTFILFSDDLDKALATFVLANGAAAMGQPVTIFFTFWGLNAIKKPHAVKAKKDIWGKMFGMMLPKNSKGLGLSKMNMFGLGAKMMRMVMKEKHVDSLESMRKQALENGVEFIACQMSMDVMGINREELLDEVSIGGVATYMNRAEEANINLFI

SEQ ID NO: 7496 - protein, 640 aa, Spinacia oleracea
RDIILAYMQNGEKLSPDHGYPVRMIIPGFIGGRMVKWLKRIIVTTTESDNYYHYKDNRVLPSHVDAELANSEAWWYKQEYIINELNVNSVITSPCHEEILPINAWTTQRPYTMRGYAYSGGGRKVTRVEVTMDGGDTWDICELDHQERGSKYGKPWCWCFWSLEVEVLDLLGAKEIGVRAWDESLNTQPEKLIWNVMGMMNNCWFRVKTNVCKPHKGEIGIVFEHPTQPGNKSGGWMARERHLEISDSGPTLKRTASTPFMNTTSKMYSMSEVKKHNTADSAWIVVHGNVYNATRFLKDHPGGSDSILINAGTDCTEEFDAIHSDKAKRLLEDFRIGELISTGYTSDSSSPGNSVHGGSVYSGLAGLAPITEAVPLRNVALNPRVKIPCKLIEKVSLSHDVRRFRFGLPSEDQVLGLPVGKHIFLCANVDDKLCMRAYTPSSTIDVVGYFDLVVKVYFKDVHPRFPNGGVMSQHLDSLSLGSIVDVKGPLGHIEYLGKGNFTVHGKPKFAKKLAMISGGTGITPIYQVMQAILKDPEDKTEMHVVYANRTEEDILLREELDKWADEFRDRVKVWYVVEKAEEGWKYDTGFISEKILRDHVPAVGDDVLALTCGPPPMIQFAVQPNLDKMGFDIKEQLLIF

SEQ ID NO: 7497 - protein, 259 aa, Magnetospirillum magnetotacticum
MLDLPIDLPEFLPGSVWLAGAGPGDPGLLTLLALHAIKSAEVVIHDALVDGRILALIPAAAEIESMGKRGGEASVRQAEITARMIHLAKAGKRVLRLKGGDPFVFGRGPEEALALAGAGVPFRIVPGITAGIGGLAYAGIPVTAKETNSAVAFVTGHGPDGEMPDAFDWDALARGAPVLVFYMGLKHLERLTSRLMAAGRRPDEAAALVCNAATERQSVLETTLAEAAGAVERAGLKPPALFVVGQVVALRRQLDWWRG

SEQ ID NO: 7498 - protein, 112 aa, Porphyra purpurea
MKKIEAIIRPFKLNEVKLALVKGGIGGMTVVKVSGFGRQKGQTERYKGSEYSIDIIDKIKIEIIVSDDKVNSITEIIIKTAKTGEIGDGKIFISDVEQVIRIRTNDLNSAAL

SEQ ID NO: 7499 - protein, 322 aa, Prochlorococcus marinus
MPIANDITSLVGQTPLVRLNRLPKAFGCKAEVLAKLESFNPTASVKDRIAGAMVVEAEKQGTIKPGETVLIEPTSGNTGIALAMVAAAKGYRLILTMPDTMSTERRSMLRAYGAELQLTPGKDGIQGAINLAKELVASISHSYLLQQFDNPANPQIHEATTAEEIWSDCEGKLDGLIAGIGTGGTITGCARVLKARNPALKIYAIEPSSSAVLSGKEPGPHSIQGIGAGFIPKVLDISLIDEVIEINDQEAMEAGRKLAKEEGLLSGISSGAALAAALKIGKRPEMENKRLVVVFPSFGERYLSTSMFNNLSTSQPKKDGYI

SEQ ID NO: 7500 - protein, 1330 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQDNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7501 - protein, 443 aa, Unknown
  Rosa hybrid cultivar
ETTLVELGRTLGLEECALWMPCRSGMNLQLSHTLNYEAQIGSTVPFSLPVVSEVFKSSQAMRIPYTCPLARVRPLVGRYVQPEVVALRVPLLNLSNFQINDWPDVSAKSYAIMVLILPTNSTRKWRDHELELVDVVADQVAVALSHAAILEESMRASDQLVEQNGALDLARREAELAIHARNDFLAVLNHEMRTPMHAIIALSSLLLETDLEDGSLDLDIGKFNLHGVFREAINLIKPIATVKKLSMTLILAPDVPVCAVGDENRLMQTILNVAGNAVKFTKEGYISVIASVAKPDSSRDWRPPEFYPASSDGHFYLRVQVKDSGSGILPQDIPHIFTKFAEPRNGSNRVKDGAGLGLAICKRFVNTMGGHIWIESEGIDKGTLVVFIVKLGICDNCGNTTIAHQKVPKGEANHGSADLIGYKPAFRDGYGLASTNPRYQRSL

SEQ ID NO: 7502 - protein, 135 aa, Chlamydomonas reinhardtii
MARTKQTARKSTGGKAPRKQLATKAARKTPATGGVKKPHRYRPGTVALREIRKYQKSTELVIRKLPFQRLVREIAQDFKTDLRFQSQAVLALQEAAEAYLVGLFEDTNLCAIHAKRVTIMPKDIQLARRIRGERA

SEQ ID NO: 7503 - protein, 270 aa, Oryza sativa
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGGMTVNGLYPS

SEQ ID NO: 7504 - protein, 537 aa, Oryza sativa
MELGLGMGMGLGDPPADYGSIAAVGLFVALICVCIVVGHLLEESRWMNESITALIIGLGTGGVILMVSSWKHSRILVFSEDLFFIYLLPPIIFNAGFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMHAFATLSFIAETFLFLYVGMDALDMEKWKIVGETYSPMKSIALSATILFLVLVARAAFVFPLSFLANLTKKTEEGKISIKQQVTYMMWVIQVIIWWAGLMRGAVSIALAYNKFTRSGHTQLPSNAIMITSTITVVLFSTMVFGLLTKPLIRLLVPARHLNRESSALSDPPSPKSFLDPLILNGSDADLEIGVGIRRPTSLRLLLASPTRSVHHYWRKFDNAFMRPVFGGRGFVPFVPGSPTERSVPLLQGNEN

SEQ ID NO: 7505 - protein, 1330 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIRAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7506 - protein, 622 aa, Unknown
  Rhodococcus sp. RHA1
MTVEQSSPTTLRRLSARLALIRDDTDDDKLSAGFLLVATILALVWANIGDSYESFWHTPVTIQISDNSISLDLKHWVNDGLMTLFFFVVGLEVKRELTIGELTDRARAAVPLLAAIAGLALPAVLFLILNPSGDEATAWGVVVSTDTAFVLGALALVGPRCPARLRVFILTLAVADDIGALALIAFFYTDDLRLGPLLLGCVGLLLIIQLRKLEVWRGVAYFIVAAGTWVAFYESGVHPTLVGVLIALILPVYPPRRSEVERAGELTRAFRQSPNSDYARAAQLGVLRAVSVNERLLRFYQPYTAFLVVPIFALANAGVVITGQTLADAARSPLAWGIVLGLVVGKLVGITAATALFSKLRPGSLPPGLTLSQIAGGSALAGIGFTISLFIVDLAIDSPELANEARVGVLTAAVIATVLGWALFRLSDTVHPPTEVVGLTLLRPVDPGRDHLRGPADAPLTLVEYGDFECPFCSKATGSIRDVRAHFGDELRYVFRHLPLDDVHPHARFAAQASEAAAAQGRFWEMHDHLFANSDALAEDEIFGYAAELGLDMDRFEEDIRRGTYVHRIDDDELDAESSDFRGTPTFYLGATGTDLARHSGPYDAATLIRKLEEARGADGAP

SEQ ID NO: 7507 - protein, 267 aa, Methanococcoides burtonii
MARDRRDTYYWRAKDEGYRSRAAYKLFQINEKHEVIKEDDTIVDLGAAPGGWLEVAKKISGGKIVGVDLRRIKEIEGVETIKGDITSDETIKKIIELVGEGGADVVICDAAPNLSGNWSLDHARSIDLTTSALECAKKILKPKGHFIVKVFQGDMFKEYMDKVRESFTYTRAFSPKASRPESAEIYVIGKKLLTAPLKIDDKFDVTIKKIGAKGNGIAFVEDFVVFMQDEVKKGENVRIKIVDVKPEFAFAIVIGRYDEELNEKNEE

SEQ ID NO: 7508 - protein, 457 aa, Shigella flexneri
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 7509 - protein, 1223 aa, Alternaria longipes
MAAETYSSVSAIIRNLARQHDPTRDPSFSAQVSANGAKTAANAIALPGPESEEKTQLEQELSALCSRIDFLEHKSSHAPNQQGQFPLTPAQEPPEEGALYTPAGVFRGNSGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYKVPDYVVGDSFRLRQIILNLVGNAIKFTELGEVKVAISMAQEQECDPDHYVFQFAVSDTGIGIRGDKLNLIFDTFQQADGSTTRKFGGTGLGLSISKRLVTLMGGRMWVESDVGKGSVFYFTCKVRLGKPAIQAIQPQLVAYKQHTVLFVDQGNTGFSDQIIEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNIALPAKGNDNGGASSSSGGLPSPGKKRPQLDTRGFTERGGGAQSPNLLAVDQTDNGSVERLLLRSHSS

SEQ ID NO: 7510 - protein, 446 aa, Unknown
  unidentified prokaryotic organism
MEYAVSVESFLSSLQRHNPHQPEYLQAVREVFTSLWPFIERNPAYREQALLERLVEPERIIQFRVSWVDDRGQVQVNRAFRVQFNSAIGPYKGGMRFHPSVNLSILKFLGFEQTFKNALTTLPMGGGKGGSDFDPKGKSQGRIMRFCQALMTELYRHLGPDTDVPAGDIGDGGREVGFMAGMMKKLSNNTACVFTGKGLSFGGSLIRPEATGYGLVYFTDAMLQRHGLGFEGMRVAVSGSGNVAQYTIEKALELDARVITVSDSGGTLVDEDGFTTEKLAHLAEIKNQRYGRVADYAAERGLTYLAGQQPWNVPVDIALPCATQNELDLEAARVIRNGVKAVAEGANMPTTIQATDAFLDAGVLFAPGKAANAAGLATSGLEMAQNAARIGWRAEKVDVRLQHIMADIHHACVEYGGEGKQTHYVHGANIAGFVKVAEAMLAQGVL

SEQ ID NO: 7511 - protein, 345 aa, Schizosaccharomyces pombe
MSEETSIPGIIASTPPISKDSRRNVSHWLQALAVFLHSVSLTLTASWYTVLWAFLPFWPFLIVYLIWLIYDDGFVTGKDRQKRWLRNAPPYRWFCHYFPIRLHKTTELDSEKNYIFGYHPHGIISLGAFGGFASEGADFSKLFPGINVSVLTLNSNFYVPVYRDYLMALNINSVSKKSCVSILSRKPGDSVLIVIGGAQESLLSRPGQNNLVLKKRFGFVKLAFLTGSSLVPCFAFGESDIFEQVDNNPRTRIYKFQEIVKKIAGFTVPFFYGRGLLNKTFGLMPWRKPINIVVGEPIDVPKKSHPTNQEIYEVHEEYIRRLEGLWNKYKDVFLPNRISELKLSA

SEQ ID NO: 7512 - protein, 395 aa, Zea mays
MAVLQVAAAAPPPVSVIGFEGFEKRLEISFSEAPVLADPSGRGLRALSRAQIDSVLDLARCTIVSELSNEDFDSYVLSESSLFVYPYKIVIKTCGTTKLLLAIPRILELAEELLLPLAAVKYSRGTFIFPEAQPSPHKNFADEVAFLNRFFGGLKSGGNAYVIGDSAKPGQKWHVYYAAEHPEEPVVTLEMCMTGLDKKKASVFFKTTADGYSLCAKEMTKLSGISDIIPEMEICDFDFEPCGYSMNAVHGPALSTIHVTPEDGFSYASYEVMGFNPGSFSYGDLVKRVLRCFGPTEFSVAVTIFGDRDNAKTWGTKLDAEAYACSNMVEQVLPFGGLLIYQSFTVTAETTHGSPRSVLHDFAGDIVKNRSESDAPWEADAVDESEERDVKKMKC

SEQ ID NO: 7513 - protein, 344 aa, Hyoscyamus niger
MATFVSNWSTKSVSESFIAPLQKRAEKDVPIGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 7514 - protein, 690 aa, Sorghum bicolor
MVTLLAFRLPPLFLLLAAAAAAAAADNGNMTEAEAAAMAALVNLKKSFTDPTGRLEAWSATSPFPPCDAASPWPGVQCYKGSLVGVRLTHMNLSGTFDFGAIAKLPRLHSVNLKHNALSGPLPASLGTLRGLRALYLSSNNFSGPIPADVFANMRWLKKLYLDNNRITGPLPADAIAKAPRLMELHLDRNQIDGPVPFKLPESLKRFNVSHNRLSGTIPQSVAERYDASSFAGNPGLCGSPGSDAAVCVAAGPALPPAFPPPTAADYMAMEEETSVFVVIGIILLVILLVSGAMVLMLRQDERNSVATAWDYYAGSTTTGGAGAGASGSSKSVADAASTTAAAPRAGEAVAVDMASGGSSSSHGGGGSSSGRRMGEFVLLNEDIPAFGLPDLMKASAEVLGNGTLGSAYKAAMRNGVTVAVKRLRDMNRFGRDEFEQHVHMLGQLRHPNVLPPVGYHYRKEEKLIVSEYMPRGSLLYILHGDQSPNRVILDWQGRVRIAVGVVRGLAFLHERLGIPAGRLVSMDGADFDAPPPPPPHGNLKSGNILLGADMEPLLVDYGFFPLVNAAQAPQAMFAFRSPEGTTRGVVSARSDVYCLGVVLLELVTGRFPSQYLLSARGGTDVVHWAATAVAEGGEAELVDPAIAAAGGDAAVRLLRVGVHCASPEPECRPSVAEAAWMVEEIGSAAGGAS

SEQ ID NO: 7515 - protein, 111 aa, Unknown
  Synechococcus sp. WH 7805
MSDSTAATFAISVELDGQSHQFQCSADQTVLSAAEAAGVAVPSSCCAGVCTTCAARILDGTVHQPDAMGVKEELRKDGFALLCVSYPRSDLKVMAGQEDALYEAQFGQYQK

SEQ ID NO: 7516 - protein, 999 aa, Oryza sativa
MAAARAPWLWWWVVVVVGVAVAEAASGGGGGGDGEGKALMGVKAGFGNAANALVDWDGGADHCAWRGVTCDNASFAVLALNLSNLNLGGEISPAIGELKNLQFVDLKGNKLTGQIPDEIGDCISLKYLDLSGNLLYGDIPFSISKLKQLEELILKNNQLTGPIPSTLSQIPNLKTLDLAQNQLTGDIPRLIYWNEVLQYLGLRGNSLTGTLSPDMCQLTGLWYFDVRGNNLTGTIPESIGNCTSFEILDISYNQISGEIPYNIGFLQVATLSLQGNRLTGKIPDVIGLMQALAVLDLSENELVGPIPSILGNLSYTGKLYLHGNKLTGVIPPELGNMSKLSYLQLNDNELVGTIPAELGKLEELFELNLANNNLQGPIPANISSCTALNKFNVYGNKLNGSIPAGFQKLESLTYLNLSSNNFKGNIPSELGHIINLDTLDLSYNEFSGPVPATIGDLEHLLELNLSKNHLDGPVPAEFGNLRSVQVIDMSNNNLSGSLPEELGQLQNLDSLILNNNNLVGEIPAQLANCFSLNNLAFQEFVIQQFIWTCPDGKELLEIPNGKHLLISDCNQYINHKCSFLGNPLLHVYCQDSSCGHSHGQRVNISKTAIACIILGFIILLCVLLLAIYKTNQPQPLVKGSDKPVQGPPKLVVLQMDMAIHTYEDIMRLTENLSEKYIIGYGASSTVYKCELKSGKAIAVKRLYSQYNHSLREFETELETIGSIRHRNLVSLHGFSLSPHGNLLFYDYMENGSLWDLLHGPSKKVKLNWDTRLRIAVGAAQGLAYLHHDCNPRIIHRDVKSSNILLDENFEAHLSDFGIAKCVPSAKSHASTYVLGTIGYIDPEYARTSRLNEKSDVYSFGIVLLELLTGKKAVDNESNLHQLILSKADDNTVMEAVDSEVSVTCTDMGLVRKAFQLALLCTKRHPSDRPTMHEVARVLLSLLPASAMTTPKTVDYSRLLASTTTAADMRGHDVTDIGDNSSSDEQWFVRFGEVISKHTM

SEQ ID NO: 7517 - protein, 637 aa, Magnetospirillum magnetotacticum
MCGLAGLFLPRHAALAEADIAAMLRVMRHRGPDGTGIHLSDDRRFQAGFTRLAIIDLATGDQPLVRNGGETVLLGNGEVYNYRELRAELAAKGHTFLTQGDMEAALESFMAKGRDFVHDLNGMYALAILERDDHRLTLVLDRLGIKPLYWARLGNGGILFASEIKALFASGLLRPLVDEVSVAAYLAHGYVPAPATLYKGVSKLPPGSIMSVDASGEVQIERYWRAAAATDLPGDEAGIRAHLVSILDDAVGLQLRSDVPVGAMLSGGLDSGLLVALAARRLDRPLKTYTVRFLGARVDETPLAAQVAERYGTDHTVFELETGSAAQLLPRLVWHADEPLADASLLPNHLINEVIGKETRVVLNGTGGDELFGGYGRYFQLPVEARWLRLPRPLRKAAEAMIGLGNPFLAWQLARAEKFGRDRGGYLHDHCALFPPPMAKLLGCTLPWPIPAQAAFADEYAGPLDSAALYAELNTYLPEDLLTLLDRTTMAHSVEGRVPLLDHRMVEAALAVPPHIRNPGGRQKALERAIAAEYLPDSLLSAPKQGFASPVPAWFESGGLAPLARRLLTSRRALERGWWSREGVERLLAQPGRHAFRLYSLLVLELTVRIHVEGAFAEAPAFGLAEMAEGEDAPCAA

SEQ ID NO: 7518 - protein, 514 aa, Burkholderia xenovorans
MTHETSELPSLARGSQPATIPDSRLPEPFCESARSLLKARAGFLLAWLCFIVIAWVLPTPQGLTHQGRATLAVVAWVAIVWISEAIPVGISGILLPMLLVLSHAVTPFPKAASGFAAPVVFLCLAAFLFSAIMQAAGLDRRIALVLLDKLKVRSANGVIWAMFIVNFVMSLVVPAANARAAALLPVTNGIIGLFGNSARERDARKAIVIQTLVYGSMISGMCILTAHLPNMVVSGLLEKQLGLRISYFSWLRLQWPYLGMFVLTQFWVQRYFKSRGVPVPGGRQAIIEERRKLPPVARQDLTVLLVFAFVGAMWATESLHHLQSEIVALIALALMFAPGVMRFGWKDIQERTIWGTLFLLGGALSLSSAISDSGLAQWAADHIYAVAHGYVWWMTLAIVMIGTHVIRIGMLSNVAAVTMIAPIALALAPRLGLHPVAFTMLISDTDSFAYLLPTQITAGVIAYSSGQFTTADYAKVGIVSVLIAIVYGICVMAPWYAYQGIPLWNPTAPWPFAH

SEQ ID NO: 7519 - protein, 417 aa, Pseudomonas fluorescens
MFSKQDQIQGYDDALLAAINAEEQRQEDHIELIASENYTSKRVMQAQGSGLTNKYAEGYPGKRYYGGCEHVDKVEALAIERAKQLFGADYANVQPHSGSSANSEVYLALLQAGDTILGMSLAHGGHLTHGAKVSSSGKLYNAVQYGIDTRTGLIDYDEVERLAVEHKPKMIVAGFSAYSKTLDFPRFRQIADKVGALLFVDMAHVAGLVAAGLYPNPLPYADVVTTTTHKTLRGPRGGLILAKANEEIEKKLNAAVFPGAQGGPLMHVIAAKAVCFKEALEPGFKAYQQQVIDNAQAMAGVFIKRGYDVVSGGTDNHLFLVSLIRQGLTGKDADAALGRAHITVNKNAVPNDPQSPFVTSGLRIGTPAVTTRGFKVTQCTELAGWICDILDHLGDADVEANVARQVAALCADFPVYR

SEQ ID NO: 7520 - protein, 319 aa, Actinidia chinensis
MEAFPVIDMEKLNGEERAPTMEKIKDACENWGFFELVNHGISHELMDTVERLTKEHYNKCMEQRFKEMVATKGLEAVQSEINDLDWESTFFLRHLPVSNISEIPDLEQDHRKAMKEFAEKLEKLAEQLLDLLCENVGLEKGYLKKAFYGSKGPTFGTKVSNYPPCPRPELIKGLRAHTDAGGIILLFQDNKVSGLQLLKDGEWIDVPPMKHSIVINIGDQLEVITNGKYKSVMHRVIAQPDGNRMSIASFYNPGSDAVMYPAPALVDKEEDQQKQVYPKFVFEDYMKLYAGLKFQAKEPRFEAMKAMENAVNLGPIATI

SEQ ID NO: 7521 - protein, 514 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEIQATLLKYAKLVHFARKMMSYFSIHMVRKITDHVVSEIWLSFHIEKEIIAQFFTFSDLDFKDCKYQLDAARGVSFLPGIKQRLLSFIFRKTWNEESDQTLRVQHLKKKFYFHFQDYVDLIIWKVSRSTEQNLAFFAVYNMETTDIVSLYQNSSEELYSLFEYFYDHFHTNPQNSSHGNFISSHSNNVHALDQLRTIKNKANSTSQQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 7522 - protein, 254 aa, Schizosaccharomyces pombe
ELHLQPEDLFKTFDEYVNEARRLKQNYGDQINILIGAETEYIRPESVELLKSLNTKYNLDYFVGSVHHVNSIPIDFSPELWQKALQHVGNNPEQLFIDYFEHQYDLMQRLHPLVIGHFDLICLFAPEDAKEVFKNSKSVWELIQRNIKYAVSYGGIFEINTSAFRKGWKTAYPQQRLLELMVEQGAQLTLSDDSHGPHQVGLNYHLAKSYLDKCGITSLCMIEKGPDGNGTVVKNVTVDNVWSKFVGTNGITNT

SEQ ID NO: 7523 - protein, 669 aa, Leptospira interrogans
MVEKESSVGKWQKEFFENIHLFKRSGMTEDEAKKILQKFLYLSSVTPMPPVMEVFKEPNLLESVGVYTSPEQRSREFMMEFLSPIMKQFTVEGVENLKAVKPLIGKYPVTLISNHLSHLDAPAIFHQLYNCSPEGKSIAEQLVFIAGRLAYEPDFTRLGLYMFGTLLVCSKRDMADNPSLSDLMTKINMRAFRHSQKLQSEGKIVAIFPEGTRSRDGRLMPFVETVYHYVANKVIIPISLEKTDKILPTTSLLFNQVNGKLVIGKPVLVGELSRKQMDSFPKEVEQLQFPEHGDKKQFLIDNLALLVGSNLNKHQHGTYRNLYKGDVPGKNILIKIPKEPEEKIVVIGASSMSIAVATLLANKDVLVYLYHPDQTYTEQCNTERRELKYYPLYKLPPNLVFTSDVEVLKTATLFIQGTNPWELINVYPEIQPYLNRNKAPFFNVVKGFTSTGLILDEVQNAFGLEDDRLGVIAGACYPDQIMERKISGFEIAASNATLIPRVQKLFTTGYIFPRPARIPTDVKGVQLGGALKTIYALAMGIVEGYFTQTLGGNVDNSLFHLSNRFFTEMTTIGTKMGGQPETFLGLSGLTDFMLSCFGTDAKDRKTGYDIAYGSSSEKMSNGFYGLKVMPNLMKISAETPVLSAAYEIVINKKDVNQIIEMLEGRLARV

SEQ ID NO: 7524 - protein, 203 aa, Glycine max
KKTNSKESARVFWCCANIVHAIELPNYTVILPEESDFQLRLYNESSWISARVSGTSFEQSYKLGFSRLYQYIHGANSNSSKIAFTAPVLTSVPSSPPGDGYIVRMFVSTHFQGKPPQPNPELKLRIEKWKTQCIAVRKFTGYAKDDNINKEIEALVTTLNKNSATIQDTSFYTIAKYNASSHNTADRLNEVWIKVSGVRTEYC

SEQ ID NO: 7525 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHANVSTKEMRQPGGTKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 7526 - protein, 390 aa, Psychrobacter arcticus
MAVGIENTIEEARFVEQARNFDIQRVIVKIGSSLLTNNGRGLDRTAIYEWAKQIAKLHKQGIEVLLVSSGAVAEGVVRMNLEERPKKLAALQACASIGQMGLIETWWSALIQHGIQSSQLLLTHDDLSNRSRYLNTTGALTQLLEWRVLPVINENDTITIDEIKFGDNDTLGAMAAAMVNADLYIILTDQEGVFTDNPRDNPNAKMIRQERAMADYLFDIAGDGGKLGRGGMLTKIRAGRLAAMGGCPTVIVSGAIDDVITRVVSGEAVGTLLTTNDQDKIIARKQWLAAHLRMSGSLIVDAGAAKAVVEHQKSLLPVGVSEVRGDFDEGDVVEIVHQDTGERIAVGQVNFSSRDACRVARERTEQFDRILGNNEERVVMVHRDNLALTM

SEQ ID NO: 7527 - protein, 464 aa, Borrelia burgdorferi
MDVGIYGLGVMGSNLALNIADNGFNVSVYNRDNEKTEIFVKQNSHKKINGFKDIESFVKSLKTPKKIILMVTSSAIEKVIEQILPFMNKSDIIIDGGNSHYKSTMRLEKELFAKDIYFVGLGISGGERGARFGPALMYGGSKSAYEILEPMLNKIAAKTKNNDICSTYIGENGSGHYVKMIHNGVEYADMQLISEVYFFMKKAFNLDNLKISEVFEKWNEGDLSGYLLEITSKILKYKENNEYLVDKILDIANQKGTGVWTAIDALESGVPVNLIVESVFSRFMSGLKHERIIASDLLKMDTSSFEFELSDWILDLYYALLVSKIVAYAQGFMMLKTASVNYGWDLNLGKISLVWREGCIIRSSFLDKIKLAYDKNPHLINLLFDDYFLDLLKNNHKSLRRIISKASEIGIPLPAFYASLSFLDSYSTNYLPSNLIQAQRDFFGAHSFERLDSKRGEFFHSAWQ

SEQ ID NO: 7528 - protein, 275 aa, Pseudomonas fluorescens
MIPQASLKVACQQVAPRIGDLKYNRALGAEAIRQAAARGAQVVVLPELVQSGYVFSDRNEALALSESLDGPTLSLWKTLAEELQVVIVGGFCERLDQERVANSAALVEPEGRLTLYRKAHLWDRENLIFTPGDEPPPVVATRFGPIAMMICYDLEFPEWVRLPALAGAALLCAPVNWPDGPRPLGERPAEMVRVQANAAVNRMFIAACDRCGEERGVNWVGGSTLVDADGYPLAGRDRESAEQLLLAELDLTQAWHKSISEHNHVHLDRRPALYQ

SEQ ID NO: 7529 - protein, 1209 aa, Unknown
  Synechocystis sp. PCC 6803
MINSGTLITKIEELQSTLAKMDIALGTVDEAIVWTDGTGQIQWCNTAFDHLMGKLHILILGKNLVELLPLHRNSQPLEVSHHPFTIIVATQQKFTDHYEFNQNGKWLHLEIMTSPLMNAQGAVLVIRDISDRHLQEQTLQQLNENLEKRVLERTQAVSLINNKLEQELRERKKTEIALKATTSRLEALIQNLQAGVLVENENGKIVLVNQVFCDLFGIDVPPEKLIGFDCRQSAQFAKILFEDPEAFIIGIDNILQNRQIVTNEELRLKDGRTFARDYVPIEVGNHHDGRLWLYRNITPQKQAEVSLRKQYQRTLLLKEITEEIRQSLDPVKIFQVAVSRLGQTLQVSRCIVHLYSDMPQPHLTCVAEYLIPGMTSMLDLNLLIADNPHLLRALNQDDAVQVDNLKMVPTAVPLQDFYNQLQVYSLLIIRTSYQDKTNGLLILHQCDRSRSWNTEEVELVKAVADQVGIALAQAKLLEQEREIRQQLIEQNKALMTATKAAEDANRAKSDFLATMSHEIRTPMNAVIGMTGLLLDTHLNTQQQQFTETIRSSGEALLSLINDILDFSKIESGQFKLEIHPFEIQQCVEECLDLVAPQAFAKKLDLVYQIEPQVPMAILGDLTRVRQVLVNILANAVKFTTSGSIQVRVSATVANQQQNKYTIQFSIKDTGIGISPDQQSALFKSFSQVNTSIARKYGGTGLGLAICKRLTEMMGGQIWVESYGEIAGNPPVDWAKTSKNNPLESTGATFYFTITAQSTTIVRRPNDLSCQLSLAGKRLLIVDDNQLSCEGLKQLVTAWGLQAQATTSGWEAFSWLRQGECFDLAIIDLQMEEVDGLQLAEALRTLPTGESLPLVILTPSPTSLAELSARTDISIAACLSSPIKKSLVYEVLCEVFKADETDNSLFNGDWRSGITEAVKRTCSPQEREARIKTLSPLRILLVEDNNINQRVALLMLEKLGYRPDIAGNGLEALQVLHQASYDVILMDVEMPEMDGLSATKAIRQDFPADEQPWIIAVTAYAMQGDRETCLAAGMNDYITKPIRENDLLDALQRIDFSVLSLTKNKPAPLSEPVVNVGLVNPVPEVLKADQLEENLVLDLSILTGIREMAGPDGATFLQVIIGDYLHTTPSLLEKLKTAIAAQEIDTVRATAHSLGSSSANLGAVEFAKQCKQLENLARSGMLSGVDGQYIQLEKEYEKVSQALALQLNPN

SEQ ID NO: 7530 - protein, 306 aa, Carboxydothermus hydrogenoformans
MRIYEDITQLIGKTPLLKLKRVTRGVKATVVAKLEYFNPGGSVKDRIAFNMIKAAEEQGLLDKDTVIIEPTSGNTGIGLAMVAAARGYRLIITMPETMSVERRMLLKAYGAEIVLTPGELGMTGAVNKALELAKEFPKAFIPQQFENPANPEIHRKTTAIEIWEDTDGQVDIVVGGVGTGGTITGVGEVLKAKKPEVKIIAVEPADSPVLSGGKPGPHKIQGIGAGFVPKVFNRDVVDEIIQVESDDAFAMAKKIAKEEGVLVGISSGAALWAALEVAKRPENEGKLIVVVLPDTGERYLSTPLFS

SEQ ID NO: 7531 - protein, 418 aa, Colwellia psychrerythraea
MTDFNIATMAQKAKQASRVAAQLNSSEKNALLNDIATAIENNSDAIIQENSKDIAAGREKGLSQAMLDRLVLTDKGIKDMSSAIREIVALTDPVGDVDKLSLRPNGIQVGKMRIPLGVIAMIYEARPNVTAEAAALCIKSGNAVILRGGSEAIHSNLAIAHCLHQVLTTHNVDEHIVCVIPDTSRSVIEQLLQQSDTIDLVIPRGGEGLIRYVSENSRIPVIQHYKGVCHLYIDKYADLDKAVNILVNGKTQKPSACNAFETVLVHSDISAKFLPLAAKALNDAAQVKVHACKNSIGFFPNAELATNEDYQAEYLAQEIAVKVVSSFDTAIGHINEFTSDHTEVIISQDISRSQKFIRQINSSVVMVNASSRFSDGNQLGLGSEIGISTSKLHAYGPMGLEALTTEKFVVFGDGQIRQ

SEQ ID NO: 7532 - protein, 353 aa, Agrobacterium tumefaciens
MNHLDRSALSFNQSDSALIRPPSSWREPENHLSQLITSPWYRLLHEVRCSIDGGTRIFFEGFGADNLHVPVTTGSVSSPMGLGSDSLPVRAIIQDKEIYLADSLQFLLELGIRIARRPVYYISSSFRGEDVDPTHLAEFSHSEVEIEGDLNEIIDLGGKYVSHLAQTLLDKCEGQILNSVGSLNHLQDVAKLKGNFPRLRHSDALELLHSEPRATKELLPGVATITRAGERQIMEVIGSPVWITHMPRKSCPFYQRPEEGSDACLSADLLLGPGEILGAGERCEDFLSTSRSVADHEVDPSPYQWYLEMKRSSPLRTAGFGLGIERFIMWALDVGDIRDCCLWLRKHGEVINP

SEQ ID NO: 7533 - protein, 476 aa, Magnetospirillum magnetotacticum
MALAALVGIILLPLPDGLQAAGLRMLAIMVFAVIIWMTEAVPYAVSAAVIVSLIALALGLGPALGDPTKLMGSSKALGMALSGFSNTAFALVAGAMFISAAMMITGLDKRIALVILSRLGARTGRVLAGVIFTGFALSFLVPSTTARVSCMVPIVMGIIVAFGVDKRSRFAAVLMIATAQADSLWNVGIKTAAAQNMIAVTFIEKQLHYTISWLEWFIAAAPFSAVMSVILYFVLMKLLPPEVDEIEGGKATIAAKLAELGPMSTGEKKLLSISLILLGFWTTEKVLHNFDTSTTTMVAITLMLVPRIGVMDWKDAQARIGWGTLILFGVGISLGQCLLDTGAAAWMAKYIVATFGMENFPALGIIAVLALFLIIVHLGFASATGLAAAMIPIIISVLQSIKTPGINVVGLTMIAQYVVSFGFILPVNAPQNMVVYCTETFESKDFIRTGIPITIIAYIMILVMSATYWRWLGLTG

SEQ ID NO: 7534 - protein, 174 aa, Lotus japonicus
MSKIMSTDPLVVGRVVGDVLDSFTTSMKLTVSFNNKQVFNGHEFFPSTINTKPKVDIGGGDMRSFFTLIMTDPDVPGPSDPYLKEHLHWMVTDIPGTTDATFGKELVSYEIPKPNIGIHRFVFVLFKQKRRQCVSPPSSRDHFNTRSFAAQNDLALPVAAVYFNAQRETAARRR

SEQ ID NO: 7535 - protein, 176 aa, Triticum aestivum
  misc_feature (14)..(14): Xaa can be any naturally occurring amino acid
MAVLSAADASPVSXAIGFEGYEKRLEITFSEAPVFADPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHIYY

SEQ ID NO: 7536 - protein, 319 aa, Bacillus anthracis
MKRIGVLTSGGDSPGMNAAIRAVVRKAIFHDIEVYGIYHGYAGLISGHIEKLELGSVGDIIHRGGTKLYTARCPEFKDPEVRLKGIEQLKKHGIEGLVVIGGDGSYQGAKKLTEQGFPCVGVPGTIDNDIPGTDFTIGFDTALNTVIDAIDKIRDTATSHERTYVIEVMGRHAGDIALWAGLADGAETILIPEEEYDMEDVIARLKRGSERGKKHSIIVVAEGVGSAIDIGKHIEEATNFDTRVTVLGHVQRGGSPSAQDRVLASRLGARAVELLIAGKGGRCVGIQDNKLVDHDIIEALAQKHTIDKDMYQLSKELSI

SEQ ID NO: 7537 - protein, 116 aa, Bacillus subtilis
MSGQMFKVEIVTRPANFEKLKQELGKIGVTSLTFSNVHGCGLQKAHTELYRGVKIESNVYERLKIEIVVSKVPVDQVTETAKRVLKTGSPGDGKIFVYEISNTINIRTGEEGPEAL

SEQ ID NO: 7538 - protein, 468 aa, Erwinia carotovora
MSKQQIGVVGMAVMGRNLALNIESRGYSVSIFNRSSDKTDEVIAENPGKKLVPSYTVEEFVESLEKPRRILLMVKAGEATDKTIESLKPYLEKGDILIDGGNTFYKDTIRRNRELSAEGFNFIGTGVSGGEEGALKGPSIMPGGQKEAYDLVAPILEQIAARADGEACVTYIGSDGAGHYVKMVHNGIEYGDMQLIAEAYALLKQALNLDNDELATTFSEWNKGELSSYLIEITADIFKKKDEEGKYLVDVILDEAANKGTGKWTSQSSLDLGEPLSLITESVFARYLSSLKDQRVAASKVLTGPTAQPFGGDKAEFVEKVRRALYLGKIVSYAQGFSQLKAASDENSWDLNYGEIAKIFRAGCIIRAQFLQKITDAYEQKADIANLLLAPYFKKVADEYQQALRDVVSYAVQQGIPTPTFSAAIAYYDSYRSAVLPANLIQAQRDYFGAHTYKRTDKEGVFHTEWLE

SEQ ID NO: 7539 - protein, 471 aa, Triticum aestivum
  misc_feature (41)..(41): Xaa can be any naturally occurring amino acid
SLTLGLFRVTFDEQRLYKKAFPTGPEFPGYRRPTRPFNDAXSGFNDDGWSIMAGDGIEDVVVACNSTKKIRSISNGVNAFEAPGGTICAKASMLLQSVPPAILVRFLREHRSEWADYSMDAYLASALKTSTCSFPGLRPMRFSGSQIIMPLAHTVENEEILEVVRLEGQPLSHDEVLLRVGIDMLQLCTGIDEKSVGSSFQLVFAPIDDFPDDAPLVSSGFRVIPLDMKTDVVSSGRTLDLASSLEVGSTAAQASGASPDDCNVRSVLTIAFQFPYELHLQDSVAAMARQYVRSIVSAVQRVSIAISPSQSGINAGQRILSGLPEAATLARWICQSYHYHLGVELLAQSDVAGEALLKMLWHYQDAILCCSFKEVPVFTFANKAGLDMLETSLVALQDLTLDKIFDEPGRKALFTEISKLVEEGHVYLPSGVCMSGMGRHVSFDQAVAWKVLGEDSGVHCLALCFVNWSFV

SEQ ID NO: 7540 - protein, 381 aa, Bifidobacterium breve
MADYYETLGIDRNASDDEIKKAYRKLSRKYHPDIAGPEFEDKFKEVNNAYDVLSNPDKRRMYDSGVDPNDPNAGAGGFSGAGFGDMGDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRNVGVTVPAGINDNARLRLANQGEVGEGGGAAGDLYIDIRIKADKQFTRDGDDLHCWIQVPMSWAVLGHDLSIDTFDGEQTVSIPAGCQPEDTVTLKGLGVTNIRNKDERGNLVAHVNVLIPTKLSESERGLIEQFAASHDSDATHVSQASRPQTGQKKGFFSKLKDVLS

SEQ ID NO: 7541 - protein, 288 aa, Shigella flexneri
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFQLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 7542 - protein, 492 aa, Helicobacter pylori
MELNQPPLPTEIDGDAYHKPSFNDLGLKESVLKSVYEAGFTSPSPIQEKAIPAVLQGRDVIAQAQTGTGKTAAFALPIINNLKNNHTIEALVITPTRELAMQISDEIFKLGKHTRTKTVCVYGGQSVKKQCEFIKKNPQVMIATPGRLLDHLKNERIHKFVPKVVVLDESDEMLDMGFLDDIEEIFDYLPSEAQILLFSATMPEPIKRLADKILENPIKIHIAPSNITNTDITQRFYVINEHERAEAIMRLLDTQAPKKSIVFTRTKKEADELHQFLASKNYKSTALHGDMDQRDRRSSIMAFKKNDADVLVATDVASRGLDISGVSHVFNYHLPLNTESYIHRIGRTGRAGKKGMAITLVTPLEYKELLRMQKEIDSEIELFEIPTINENQIIKTLHDAKVSEGIISLYEQLTEIFEPSQLVLKLLSLQFETSKIGLNQQEIDAIQNPKEKTPKPSNKKTPQHERARSFKKGQHRDRHPKTNHYSKKPKRR

SEQ ID NO: 7543 - protein, 436 aa, Bacillus cereus
MIGRGWDDMFCYQCEQTPTGGCKVMGVCGKNETIASLQDTIVFGLKGIAAYRTHAAQLGYTDGFVDATTQEALYMTLTNSNFNEQEHIDMAMKVGKSALRVMELLDEAHTNHFGVPEPVQITQNRVEGKAIVVTGHNLFALEELLKQTEGKDINIYTHSEMLPAHGYPQLKKYKHLKGNIGKAWYDQRRLFEKFTGAILATTNCVMPIKGSYSDRFFSYDIAGLEGVQKIENDDFTPLIQKALELSEVHMESDEQLVTGFHHHTVLSLAPEIINAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGPKAPEFISPGVLDVLQETFGLKLITNAAEDIGMMLS

SEQ ID NO: 7544 - protein, 499 aa, Francisella tularensis
MQIVWFKRDLRVTDNLALSLASEKGDILPLYIIEPELWQQPDMSHRQYLFLSECLEELNTELTKLGQSLAIMLGDAVEIFEQLIQKYNIKNVWSHQETWNDWTYQRDIKLEKFFKQNNIVWHQPYQNGVVRCLADRDNWALLWHQHMSEKIIRAPTKLKFICENQIKIPTAESLGLEYDDCYKRQKGGRIRALRILDSFLYQRGCGYTKEMSSPVTAFKSCSRLSPYIAFGVISLKEIYQKANQRKNEIKESSVKNKTKWLSAMRSFLSRLRWHCHFMQKLEDQPSIEYENLHSAYDQLRTEPLNQQCFEAWKTGNTGYPMIDACMRALIATGWLNFRMRAMLMSFASYHLWLDWRVTSLYLARLFTDYEPGIHYSQVQMQSGTTGINSIRIYNPIKQSIDQDPNGEFIRRWLPELENVSNENIHTPWLEKHNSLDYPDPTIDEKQARKFAADNIYKIRKSSKNSQETKNIVKKHASRKTSRKIKSKQHKVESIQGELF

SEQ ID NO: 7545 - protein, 734 aa, Robiginitalea biformata
MRHTIALIFLVSCFSAGWGLHAQLPLQEEREFDVYINQARVYWNRDDLELALEELDKAAEWAEEQQSEKDLIDCYHYFALIYLDMDKEETAQFNNGRAALMLEEIEYPYGTAVHYYINAKILYTEGNFFQAIFQLNEARQRTNDRNLLNRITLLEADNLRSIDKYEQAETNYNSLLVNTDPYEREFLRARAYLGLARLDLVQELLPEGIENAQYALDIAESNGFTTEYILANELLANMFEQTRQFDQALASTRHLMHFKDSVRGLAREKAQLETADRIQTEYMSKEIQRQDEEIQELSESANRSELTAILSSAFLIIISLLAVSLYRNNQIKLKTNDLLHTKNRELHAARDAAVQAMEAKTNFLSTVSHELRTPLYAVTGLTHLLLEENPSKEQQEHLKALKFSGDYLLNFINDILQINKIDADKLEMLEIEFNLKKILTEVMNSLQQTAKESKTEMILDFDPEIPSHLMSDPVKLSQVFMNLMGNALKFTKNGEVLVLARLVRKEDDRARVYFEVRDTGIGISEEKQKTIFDSFEQGSIQINREYGGTGLGLTIVKSLLGLFGSTIQLESTLGQGSSFFFELDFKCKDDLIDEVPFEVTPKEYDFKGLHLLIVEDNKINQVITRKMLAKKEISSDIANNGTEAIQLASSNSYDGILMDIHMPGISGVEATQEIRKFDPETPIIALTAISLDDSLEAFYAAGCNDVVTKPFKPEVFYQKIGENILEPKLRKTLS

SEQ ID NO: 7546 - protein, 321 aa, Burkholderia pseudomallei
MDTIVPFLSDSTARWLPLALSEQVSGKAPLAVMCMGQAIVLFRDAAGAVRAMEDRCAHRRAPLSLGRVTPEGRLQCGYHGWTYDGASGTCVAIPNLSPHERVPAHYAARAYETLERDGYVWARAARGVDTREPAAAAARATRCAQRFAGCATVSLAYDDYVAALADGPHLLMRIAGLRITDYVIADPEPRGGRLAMERGVTWAARRHDHRFGAHYPWTLRLTPPQDGAPASVEIDTRDGAPMLWASVAIAPAARGATNLLWRGGVAADTGGAGPALFRLWARLRRSPFAMLEHVDGHALAKLDASCSRAWPRAQHARVIPV

SEQ ID NO: 7547 - protein, 154 aa, Bacillus cereus
MGYVEELRKIVGHRPLILVGAVVLVINEHGYVLLQQRTEPYGKWGLPGGLMELSESPEETAYREVYEETGIEVKNLRLINVFSGANYFTKLANGDEFQSVTTAYYTDEYDGDFVMNKEEAVQLKFFPLTELPDYIVGSHKKMISEYMKIMEKKL

SEQ ID NO: 7548 - protein, 553 aa, Desulfovibrio vulgaris
  misc_feature (406)..(406): Xaa can be any naturally occurring amino acid
MFCFQCQETAKNTGCTVKGMCGKPEETANLQDLLIFVLRGIAIYGEKLKELGQPDRSNDDFVLQGLFATITNANWDDARFEAMISEGLARRDKLRNAFLAVYKAKNGKDFSEPLPEAATWTGDSTAFAEKAKSVGILATENEDVRSLRELLIIGLKGVAAYAEHAAVLGFRKTEIDEFMLEALASTTKDLSVDEMVALVMKAGGMAVTTMALLDEANTTTYGNPEITQVNIGVGKNPGILISGHDLKDMAELLKQTEGTGVDVYTHGEMLPANYYPAFKKYPHFVGNYGGSWWQQNPEFESFNGPILLTTNCLVPLKKENTYLDRLYTTGVVGYEGAKHIADRPAGGAKDFSALIAQAKKCPPPVEIETGSIVGGFAHHQVLALADKVVEAVKSGAIKRFVVMAGXDGRQKSRSYYTEVAENLPKDTVILTAGCAKYRYNKLNLGDIGGIPRVLDAGQCNDSYSLAVIALKLKEVFGLDDINDLPVSYDIAWYEQKAVAVLLALLFLGVKGIRLGPTLPAFLSPNVAKVLVENFNIKPIGTVQDDIAAMMAGK

SEQ ID NO: 7549 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNELRLTGHHETADINTFLWGVANRGASIRVGRDTEKEGKGYFEDRRPASNMDPYVVTSMIAETTLLWNP

SEQ ID NO: 7550 - protein, 338 aa, Solanum tuberosum
MAFLSSLVASLLLVGLLIQITGAQSIGVCYGKIANNLPLDQDVIKLYNANNIKKMRIYYPDTNVFNALKGSNIEIILDVPNQDLEALANPSNANGWVQDNIRNHFPDVKFKYIAVGNEVDPGRDSGKYARFVGPTMENIYNALSSAGLQNQIKVSTATYSGLLTNTYPPRDSIFREEYKSFINPIIGFLARHNLPLLANIYPYFGHTDNTNDVPLSYALFNQQGTNSAGYQNLFDALLDSMYFAMEKLGAQNIEIIVSESGWPSVGHPAATLENARTYYTNLINHVKGGVEPPKNPGRTIETYLFAMFDENQKDGNPSEQHFGLFYPDKRSKYQLNFN

SEQ ID NO: 7551 - protein, 177 aa, Listeria monocytogenes
MTKESLEKATFAGGCFWCMVKPFDTQPGIEKVVSGYTGGHTVNPTYKEVCSGTTGHTEAIQITFDPAVFPYEKLVEVYWQQTDPTDAAGQFVDRGDSYRPVIFYHNEEQKEIAEKSKAALDASGRFKKPIVTEIAKAETFYPAEEYHQDFYKKEKAHYEGYQVASGRAAFIDANWKG

SEQ ID NO: 7552 - protein, 300 aa, Cytophaga hutchinsonii
MQDLHSDIQFLFIINPISGTAQKHKIPELVHRILKADPSTIKIVLTRYAGHGRELAAEAVAQGIPNVISVGGDGTMNEIASSLLHTNTRLGIIPMGSGNGLARHLNIPLDISKAIDLLNNFSVTTIDSGNINGKPFFCTAGIGLDAQVSKVFDELPTRGLKTYTKAFIKKVRSYKGDDLKIRLNDNQEISGRFLLTTFANSNQFGNNAFIAPEASLTDQQLNLVLLKPVNVLQAIEKIYKLFSKQLHNDKDTTQLLFHKIEITKNETGPAHIDGDPVLLDKTIVVRCDPKSLHVLTPAAH

SEQ ID NO: 7553 - protein, 450 aa, Unknown
  Nocardioides sp. JS614
MAGSAGARPAAAEDENTNSLHPSALRERIPEMGLKEYWYPAIEAKKVKSGKPTTVKMLGQDLSFFRGKDGNVVATSSTCPHRGASLAHGKCHFAGTITCPYHGWTFDETGACVAVLGEGPESRIPGMPDARVRSYPTQTHKGIVFAWMGESDPAPIEEDVPPQFFNDEFLIQVSVTSWNCNWRPAFENLLDSHVFYVHRNSVHLMMMDAANLLIASKMGPRRPRPRVVNGRALMYPPGALGFADAFVGTGAKHAAEKATATEVKTWPPAPEAGLQDSYPGLGGAQWPKSDRRVAWHKVYGATKKVMPTPFKRDPLEIDPEWKDAHLPCTFQVSYSDHIYSRITVPIDAETSRVFYFHATMPLTRTKRIWDHVYFEVFQNWMMNYNFSGQDEKVVRHQAYDTPETFSATDVFPLTLRKLILENARDFHLKDGHDTEWPDAAGATSAKEDSK

SEQ ID NO: 7554 - protein, 149 aa, Oryza sativa
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRDFRESESTGFNVSSLSY

SEQ ID NO: 7555 - protein, 89 aa, Rubrobacter xylanophilus
MAKTHRVTFKKSGVTIEVAEDEYILEKAEEAGLDLPYDCRSGTCTTCMQRCLEGEVDQDLAFAISEEELEEGYRLICIGSPLSDVVLDA

SEQ ID NO: 7556 - protein, 203 aa, Coprinopsis cinerea
MLGRLKSLLSLSGPVIDPSKFRASMSTASGQPEIATFASGCFWGVEHIFLKHFPPSENKGILKTAVGYTGGKETASNPDYKSVCSGSTGHAEAVRIEFDPSIVSYDQLVEFFYRTHDPTTLNRQGADTGTQYRSAIFTHSQTQEEIAKRVTEEVQQKHFTPIGKKIVTEILPAGKWWDAEDYHQLYLFKNPSGYQCPTHRLHW

SEQ ID NO: 7557 - protein, 78 aa, Chara vulgaris
MSKQNLIEIEGLVTESLPNAMFRVCLDNGCEVLTHISGKIRKNYIRILPGDRVKVELSPYDLTKGRITYRLRSKNTNT

SEQ ID NO: 7558 - protein, 745 aa, Unknown
  Bradyrhizobium sp. BTAi1
MDQRTDRGDALTRAALNLRKAKISEGRPFPLGATWDGLGVNFAIFSAHATKVELCLFDETGDTELERIELPEYTDEVWHGYLPTARPGTVYGYRVHGPYEPDAGHRFNPNKLVIDPYAKQLIGNLRWGPELFGYQLDHADKDLSFDDRDSAPLMLKCRVIDPAFTWGTSRKPEIPWERTIFYEMHVKGFTKLHPLVPEADRGTFAGLAHHDIPAYLRSLGITSAELLPIHAFIDDSYLIEKGLRNYWGYNSIGFFAPEPRYLKTPLATEFKTMVNQFHANGIEVILDVVYNHTAEGNELGPTLSFKGIDNASYYRLMPEQKRYYINDTGTGNTVNLSHQRVLQLVADSLRYWATEMRVDGFRFDLATILAREPYGFDEGGSFLDACRQDPVLSSVKLIAEPWDIGPGGYQVGQFPPGWAEWNDKFRDTARAFWKGDGGTLADFAKRISGSGDLFNKRGRRPWASVNFITAHDGFNLNDLVSYNDKHNEANGEDNRDGHSNNHSWNCGVEGPTDDPQIIGLRERQKRNLLATMLLSHGTPMLLAGDEFGHSQGGSNNAYAQDNETTWLDWMGIAPQGRALREFTRKLIAMRKAFPILYRSRFLVGSHNEDLGVKDVTWLAPSGEEMTTEQWTDDNARCFGMLLDGRAQETGVKRRGSDATLLLIYNAHFDVVNFTLPAVPEGHNWLALIDTNQPDAQLQSFSFGHVYAVTGRSMLALGLSSEQQPMRSLRHGLGALLDIAEAPLPG

SEQ ID NO: 7559 - protein, 2233 aa, Streptococcus pneumoniae
MGKGHWNRKRVYSIRKFAVGACSVMIGTCAVLLGGNIAGESVVYADETLITHTAEKPKEEKMIVEEKADKALETKNIVERTEQSEPSSTEAIASEKKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPTKVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQLPSTGSAASQAAVAAGLTLLGLSAGLVVTKGKKED

SEQ ID NO: 7560 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 7561 - protein, 707 aa, Neisseria gonorrhoeae
MMFNKYVKTFQYGNQTVTLETGEIARQAAAAVKVSMGDTVVFVAVTTNKEVKEGQDFFPLAVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYINGVYVLNPTKAELAKSQLDLVVAGTSKAVLMVESEAKILPEDVMLGAVVYGHDQMQVAINAINEFADEVNPEVWDWKAPETNEELVAKVRGIAGETIKEAFKIRQKQARSAKLDEAWNAVKEALITEETDTLAANEIKGIFKRLEADVVRSQILDGQPRIDGRDTRTVRPLNIQTGVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKISQDKIRDVIGKGGETIRSITAETGTEINIAEDGTITIAATTQEAGDAAKKRIEEITAEVEVGKVYEGTVVKILDNNVGAIVSVMPGKDGLVHISQIAHERVRNVGDYLQVGQVVNVKALEVDDRGRVRLSIKALLDAPVREENAAE

SEQ ID NO: 7562 - protein, 262 aa, Chromobacterium violaceum
MAQLPAPEAPSRLLPLLRQRCEEAAADGAHLLLLPEMWSTGYAPAKMSAAHAWSDDAPVLAEVARLAAELGLAIGLTYLARRDGALRNRLRLHGADGSIVLQYDKVHICDFTDGTETALQGGDGFACADVALGGETVRVGAMICFDREFPEAGRALMRQGAELALVPNACPMREDAELGDVRLQQLRGRALENRFAVALCNYPAPQYDGASCLVDARGRLLAAGDRRPGLLLAELDLAELRRWRAEQDEVWGEAALRPSCYR

SEQ ID NO: 7563 - protein, 274 aa, Thermotoga petrophila
MRGRCTKLRVAAVQMLPAIGDFEGNLERIEQFIEMAVSEGAEVVVFPELTISGYTWDEAILKRGALFFSEVAKKKLLKLSREGQILIAVGTPRIVLGKLRNSLVIFKKKKELLFYDKTHLFRGEKNVFEPGEYFLVFSYRGVVFGTLICYEIGFPEISRILTFKGSKVILSAFAFGKARGHTYDVATRSRAVENGVFLVASSMCGEGFVEFVGRTRIVGPNGKVMNEIESGEGLICENLDPDAVYHYRYSEEGDSHAYLRNYMSHLYTLQKGRL

SEQ ID NO: 7564 - protein, 1791 aa, Unknown
  Candidatus Desulfococcus oleovorans Hxd3
MGIKKFFDRLLSPPPDTARIQELLRTEEHYHLLANHIHEVIFTMDMDFKYTYISPSVEHQRGFTVEEAIHLPFDKNVTPASVEKIIDLVTRGISANREGRGPTPPQTITIEVYCKDGSTRWSELTGDFLYDKNGNPTGLIGVSRYVDDREEVREELIRFKQAIDGTSEAIGFSTPSRHHVYHNKAFARLFGYDTPEDLETAGGPVTRFKDPRTAEDLFSTIVSGRPWSGEVVMIDRNGREFIALHRADAIRDRNGEITLLMGSIIDISALKKRDTEFRQQESLYRLLAENTSEIVSIIDLKDLSHRYLSPSVEKIRGFTLEEAMGHSLDQVLAPASHELAITAITEELARDGQPGVDPDRHRVLELEQLRKDGSTVWTELVASFLRDTEGKPTSILTAARDITERKKAEAAIRESETRYRMVAENIGEVIYIFDLNALRYTYASPSVRHTYGYTVEESLSLPIDKVFTPDSINRILETIEKELALEGKPGVDPDRHVTLELEQYHKNGSVLWIETTVKGLRDETGRLVSVVGVSRDITERKKAEAAIRQSEARYRLLAENISEIIYIFDITRLQYAYVSPSVSTVCGYTPEELLTIPLDTLVTPSSFDRVVERLTEELQKNGKSGVDPDRAVTLELEVYHKDGSLLWMETTVKAVRDETGHPGLVAGVARNITERKTAEAAIREREKLYRLLADNITEMISIIDIETQKHLYISPSVEHVRGFTVEEVLVQPFDRIFTSESYRLAMATLAEEIEKDGKPGVDPDRAVTLELEQFRKDGSTIWTEVVVTFLRDASGRPASMLAAARDISERKRAENAIRKSEERYRMLAENISEVIYILDSDTFTFRYVTPSVEKLHGLSPEVFMKLPLARVLTPETLAKVTRTIQTELAQDGSPGLDPDRFVSLDMEAYRADGSTVWVENTARFLRDDNGRPVSILGVARDISERKRAETAIRKSEERYRMLAENISEAIFTIDLATLKHTYASPSVKQMYGFTPEEFIARPIEQVIVPKSLDRLIVAVAAELDKDGKPGVDPDRNVTLELELYRKDGSSVWVEASAKALRNADGELVAALGVARDISERRKAEQALRESEEKFRTLVEKTNELIFSMSPKGVYTYMSPNVKELMGADAADVVGRNYAENIHRDDRPSCEADVRTLVETGVLPEGREYRVQHKNGSWRWHETSLSAQKDKAGNVASIIGIARDVTDRKASEAAHNRLLSWHAGINRIHDRLLSADNLEDRLKVITDGVVDSFDSLLCRIWIMGAPDRCDGRCPHGRDKKSARLCRGVSQCLHLTASSGDTDRTDGYYSRVPLGYEGIQWIEGREVPGFLTNDAQNTPIVKDRDWIDKNSIVSFTGRQLRDNAGNVIGALVSFATHAVDREEYEMYSNLANTASQVVLSSLAEASTKQAKEAAEAASRAKSEFLANMSHEIRTPMNGVIGMTDLLLDTDLTEEQLEYAESVRSSAESLLVIINDVLDFSKIEAGKLKLEEIDFDLEKLLKEVNDTMAPRARRKRIRHDVILKEEVPSLLKGDPVRLRQILFNLCENAVKFTEAGSVKVAVSAPHQTDTTATLLFEVTDTGIGIAPEHHQAIFESFSQVDASTTRQYGGTGLGLAITKRLVSLLDGEIGVTSEPGKGSTFWFTLALEKQPQQKAGDSVGETPVPAFSGSIRPLRILLVEDSAISRRVLLQMLDKMGHTATIAVNGAEAVKLFSRQSFDMVLMDIQMPVMDGIAATKQIKSMQKETGKKVPVIAITANAMAGDRERILSQGLDDYVAKPVKMETLADAIRRNTV

SEQ ID NO: 7565 - protein, 174 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGNTPGYYDGRYWTMWKLPLFGCTDSAQVLKEVEECKKEYPGAFIRIIGFDNTRQVQCISFIAYKPPSFTEA

SEQ ID NO: 7566 - protein, 347 aa, Bacillus cereus
MKDLIIIGAGQAGLTMGYYLKQEGYNFLLLEAGKRVGDSWRNRYDSLQLFTPRSYSSLPGMALIGEKNEFPYKDEIATYLEEYARHFQLPVQLQTEVLKIKKEKEIFELHTPTEILQTKKVIIASGAFQQPFIPSVSANLSSHIFQIHSSQYKSPSQIPKGKVLVVGGGNSGMQIAVELAKTHEVTVSISHPLTFLPLQLFGKSIFNLLEKVGLLYAEINTKRGRWFQKRKDPIFGFEGKKLIRNGAIKLQEKVVSASRNNIMFQNGDTYSAESIIWSTGFVQNYNWIEIEQAVNEKGFPNHIKGISPVKGLYYIGLPWQSQRGSALICGVGKDAEYVLSEIKKIDQ

SEQ ID NO: 7567 - protein, 335 aa, Unknown
  Rhodococcus sp. RHA1
MARPVRVVVLGAGSWGTTVAGLAAHNTPTLLWARNSDTADEINNEHRNSRYLGDRPLPDSMRSTADLVEAAHEADVLVVGVPSHAVRSTLAQIANEVRAWVPVLSLAKGLEPGTRLRPTEVIAECLPGHPVGLLAGPNIAREIVDGLAAASVVATQDVRVATALQPLFASAVFRVYRNTDVLGCELGGVLKNIVAIASGMADGLDVGDNTRAMVLARGLAEMTRLGEAMGANPRTFAGLTGVGDLIATCMSPSSRNRRVGEYIARGMTVDEAVAKLGQVAEGVKTAPTVMELARDYNVEMPIAAEVEAVVAGRQTPEGAYRGLRKVAAGGEHEVA

SEQ ID NO: 7568 - protein, 236 aa, Glycine max
MANGGDELKLLGMWASPYVVRVQLALHLKGVSYEYVEEDLASKSELFLRSNPVHKTVPILIHNGKPVCESQVILQYIDEAFAGVGPPLLPADPYERAVARFWAAYVEDKLLAPWGKVFRVKTDEERAEWTRQTAAALGPLEDGLRECSKGKGFFGGDCVGYVDVLLGSMVPWVRATERLSGDKLIDAGKAPLLAAWMERISELDAAKAVFQDVDRVVEYAGAIQARLSAAAAASTQ

SEQ ID NO: 7569 - protein, 310 aa, Neisseria gonorrhoeae
MKIANSITELIGNTPLVKLNRLTKGLKAEVAVKLEFFNPGSSVKDRIAEAMIEAAEKAGKINKNTVIVEATSGNTGIGLAMVCAARGYKLAITMPESMSKERKMLLRTFGAELILTPAAEGMAGAIAKAQSLVDAHPDTYFMPRQFDNEANPEVHRKTTAEEIWNDTDGKVDVFVAGVGTGGTITGVGEVLKKYKPEIEVCAVEAGASPVLSGGEKGPHPIQGIGAGFIPTVLNTKIYDSIAKVPNEAAFETARAMAEKEGILAGISSGAAVWSALQLAKQPENEGKLIVVLLPSYGERYLSTPLFADLA

SEQ ID NO: 7570 - protein, 706 aa, Solanum lycopersicum
YFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 7571 - protein, 615 aa, Magnetospirillum magnetotacticum
MCGIAGFVGDGDRDILAAMAGAIAHRGPDGEGLWIDPERAVHLAHRRLAVIDLEGGAQPMWSGDGRIGVVFNGEIYNHRALRRDLESLGHVFASDHSDTEVLIHGWRQWGRDLPGRLNGMFAFAIHDRERGSLFLARDRFGEKPLYVVERPGLFAFASEISALLRHPGVPAEADALAIRKFFAYCLFPAPHTPFKAIAKLPAGHWLELSLSGLTTERGCYWRFAIEPEETGRSETELAEELRALLDASVRDRLESDVPLGIFLSGGIDSSAMLALAARHRPAASLDGFSIGFTEASFDESAFARRMAAEVGCRHHVETCDLDAARRDLPDLLARLDEPSGDPSILPTSLLCRFARRSVTVALSGDGGDELFGGYDPLTALAASRRYRALVPGAVHPAIEALAGLLPPSDANMSLDFKIQRWLRGVGREPSMWLPGWMGALSPSEIDQVFGSRLAPEELYSEAIERWEACASPDPIDRALDYFTAFYLQDGILTKSDRASMQVALEVRAPFLDNDVADFARRLPSRFKVAGGQRKVLLKKAVRGLVPDALIDRPKKGFGIPLARWLRDMDPPTAGTPLLDDAWLRQRWERHRTKRQDCRHGLWCWLALERRFSTVN

SEQ ID NO: 7572 - protein, 648 aa, Methanococcus voltae
  misc_feature (133)..(133): Xaa can be any naturally occurring amino acid
MTEFKVVHTVCPYCGTGCGIDLVVKDGKLVDTHPFKRHPVNQGKVCIKGNYCYEFVHSEDRLTVPLIRKNGELVESTWEEALDLIASKLKGYNPDEVGFFSCARGANEESYALQKFARVVMKTNNVDHCARIXHAPTVTGLGECFGSGAMTNSIGDLAEADVLFIYGSNTFEAHPLVARSIVKAKDNGTKIIAIDPRKTHTSKMADIHMKLIPGSNIDLMNAIMNVIITEGLTDDEFIKNRTENFDELKEVVSKYTPEEVAKISGIPAETIREAARLYANADKAAIMYCLGVTEYTFGVDNVKSCCNLAMITGNLGERGAGVNPLRGQNNVQGACDMGALPNVYPGYQKVGEMTSKLEELWGVEGLSPEVGLMGEEKMVADADIKKVKNALGKLDFLVVKDIFLNDKGKLADVVLPAACWAEKDGPFTNTERRVQRIRKAVEAPGEAVPDWVVVKELAQRMGYGDKFAFESASDIFDEMAKVIPQYAGMSFERLGIDGLQWPCKTPDHPGTVFLHEGKFLRPNGLGKICPVEHKAPAEMASEEYPLILTTGRIIFHYNSGTMTRRCESITNEIDENFIEMNIEDANNLGIKAGETVKVSSKRGDVKAIARVSDDIVKGVVYMSFHFNEEPTNKLTNSAYDPVSKTRRT

SEQ ID NO: 7573 - protein, 161 aa, Bacillus thuringiensis
MIREGEERRVYILGYIEELRKVVGTRPLILVGSAIIILNDNQEVLLQYRSDTYDWGVPGGAMELGETTEETARRELFEETGLNAKIMQFIGVLSGKEVYFQYPNGDEIFNVIHLYQGHHVSGELRLDHEGLQLQYFPVDKLPNLNKTTEKILQKFLYALTE

SEQ ID NO: 7574 - protein, 232 aa, Saccharomyces cerevisiae
MADYDSAKYWSKQGARRGLQKTRYYCQICQRQCKDANGFQSHNKSPSHLRKISQVTAEDARRYNIQFEKGFLQLLKQRHGEKWIDANKVYNEYVQDRDHVHMNATMHRSLTQFVRYLGRAGKVDVDMDIDDTSENVEGPLLIRIHPSSLSSPSEDGMLRSQQEEQEVIAAELLKRQLNRAKRQTEKVYQPEMKSEISGDSTLKRVQVTFHGNGRVNKKKKKVPPRKDGIKFR

SEQ ID NO: 7575 - protein, 439 aa, Magnetospirillum magnetotacticum
MTESHKSERIRPLVQVIGEVPASTGPKAKVALVRGPVVMTANALNNEAVPALGLAYVAGFLRAHGYDPLFLDGIAEGLNRTYPLDNYPGYWAQGLTIDEIVARIPEDTEVIGFSVMFSGEWPVQRDLIRAVRIRFPHAFLVGGGEHITALTEYSIRDSGLDACVLGEGEFTFYRLLEARSAGEDLSVVGSIAYLDAEGRFVVTSEPTRVRDIDNIPWPWWPEGYLEGFWTAGKSYGVQTARDMPMMISRGCPFQCTFCSNPRMWTTRYSLRAVDDVIAEMKHYIAHYGATAFQLYDLTAIVKKDWAVDLCQRMIDEGIAVKWSLPSGTRSEALDEEVLTLLRQTGCNYLVYAPESGSPRTLERIKKKISLDKLTESALIAKKVGLVIRCNLIIGFPHETRRDVFDTVRYGLYLAVQGCRRGLHQHLLALSRQRTVPRIG

SEQ ID NO: 7576 - protein, 575 aa, Trichodesmium erythraeum
MVAITDPVKNRLTIETNKIASDTMAIRSLDWDRDRFDIEFGLQNGTTYNSFIIQGEKTALVDTSHGKFRQLYLDTLLGLIKPTEIDYLIISHTEPDHSGLAKDIIELAPQITVVGAKIAIQFLENLTHIPFKKQIVKNGDQLDLGNGHVLEFVSAPNLHWPDTIFSYDRKTQTLFTCDAFGMHYCSDKTYDETLSDIEADYKFYYECLMAPNARSVLNAMKRMKALGDINTIATGHGPLLRHNLVELTNRYQEWSQAKSKAEKTVAVFYISDYGYSDRLSQAIAHGIIKTGVAVEMMDLKSADPQEVRELVEMAKGIVIGAPPSTGPIATTAEIGISTILAAANKKQTFGLFESGGGDDLSIYPLAIQFKGLGLKQAFPNITIKETPSELTYKLCEEAGTDAGQLLSIKENIKQMKSLDSGLDKALGRLSGGLYIITASKGEVSSAMLASWVVQASFKPLGVSIAVAKDRAIEALMQVGDRFVLNVLREDNYQYLMRHFLKRFKPGADRFAGVNTQTANNGSPILSDALAYLECEVATRMEASDHWIIYATVDNGRVSDSDVLPAVHHRKVGNHY

SEQ ID NO: 7577 - protein, 475 aa, Ostreococcus tauri
MGGDAGTRSATTTRATVRILGDAASAVDVREAYAFGVELGRGQFGEVREVVDTSTGRALACKSISKRGLKSESSREMVRNEVVELVSVHEDATHVHLIMEKLDGPEWFDAITEQFDEAPYSEAEAAAQFRNVARTVEYLHAMDVMHRDLKPENFVLKSKEKDSPICAIDFGLSTFFLPDQEFTELVGSPYYVAPEVMGYKYSNEADVWSCGVILYILLSGVPPFWGSSEKQIFDEIKRYKTGATSLDFASEPWPSVSDAAKELVQGMLTVNRKDRMTIEDVLSHPWLADPGVAPKTALDNIVLQRFKNFAGMDKFKRFGLHAMARSMPEEEVIGLGVMFKELDKDKSGKITIVELRQGLKLQSAEAAAQLEEVVASVDLDGSGDLDYEEFIVATIARSKRESRAAVQRAFDFFDIDGDGSITADEFQRALESLSPVERTNLGDVNELLAAADTNGDGVIDFDEFMAAMSSDTDAR

SEQ ID NO: 7578 - protein, 556 aa, Psychrobacter arcticus
MSQQYTIADYLFDRIAEAGASEVFGVPGDFNLTFLDNIIASDKLRWVGNTNELNAGYAADGYARERGFAAMVTTFGVGELSAINATAGSFAEYAPVLHIVGAPSTALQDSKRRIHHSLGDGVFNHFIKMVEPVTVARAQITPENAASEIDRVIRLILKKHRPGYLMLSPDVARQPIYPPTTKLVDSQEDITSQAALADFKQALIAFLPNKTTTLMADLMVHRLGLQNQLKALIADTDIPYTTLSWGKTLLDENSDRWAGTYAGVASRPVVKDAVENCECLIKIGVQYTDTTTAGFSQDIDENVVVDLHYERASIAGKNFAPIALKDALKTLHEVMTSDINIVPKQFYKEVKPHEQHGKDNEAIRQDDLWHIIADHLDHNNLVFAEQGTAYFGISDVRLPEGVTCYGQPMWGSIGYTLPASLGAAIASPSKRSVLLIGDGSALLTIQEIAVMIQERINPVIVLINNDGYTVERAIHGENQRYNDIPKCDWQAMPKAFGATEENSLMLKVATAGELKASLEKAAATTDKLVMLEVIAAKHDIPPLLADISAALKPKAD

SEQ ID NO: 7579 - protein, 458 aa, Bacillus cereus
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 7580 - protein, 387 aa, Zea mays
MIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFFLGETFPIPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKA

SEQ ID NO: 7581 - protein, 442 aa, Zea mays
MPNGGGKRWLLLLPLSRWVLLLGSLQLPAVGGSGHVVTRMRGFDGPLPFYLETGYVEVDEQQGVQLFYYFVRSERDPYEDPLLLWLSGGPGCSGISGLAYEIGPLKFDARGQGEFPTLLYRPETWTKVSNIIFVDSPVGTGFSYAKSEEGLETGDTKQVKQLVIFLRKWLQDHPRFVMNPLYIAGDSYSGLIIPTLALEIDRSIELGEKIFSGLKGYIAGNPLTGGQFDTDSQIPYFHAMGLVSDELYKCTRDINKQYILDPACPDDDLLSPKTVAETDGTSRLMLESADFLLGSKCAEALYILSYAWGNDDTVQESLGIRKGTIGAWKRYSHALPYNYDIQSVVDYHSRLATKGYRALIYSGDHDAVVPHVGTQAWIRYLNLTIVDDWRPWYVGGQVAGFTRSYASGLTFATVKGAGHVAPLYKTLECQKMFITWISGNPL

SEQ ID NO: 7582 - protein, 237 aa, Brassica napus
GIRTRKAYKALSLSLLLFPLSSASAMFSQSSALLVRPNLVGFTLSPPGKASIASSSLPRFLRMESQSQPLQSISCASSPSNNLSQATPSSSLIESARIGEVKRVTKETNVSVKINLDGTGVADSSTGIPFLDHMLDQLASHGLFDVHVRATGDVHIDDHHTNEDIALAIGTALLKALGERKGINRFGDFTAPLDEALIHVSLDLSGRPYLGFNVKIPTQRVGNYETQLVEHFFQSLV

SEQ ID NO: 7583 - protein, 311 aa, Mycobacterium tuberculosis
MTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 7584 - protein, 605 aa, Oryza sativa
MELALVGNPSNGVAKPSCNSVGSLPVVSSNAVINPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 7585 - protein, 429 aa, Solanum lycopersicum
MENGTKGKLTVSSSLQIEQPLPPSKLWKIIVVASIAAGVQFGWALQLSLLTPYVQLLGIPHRFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKSGKMRTANAFFSFFKAVGNILGYAAGSYSRLFKVFPFSKTKACDMYRANLKSCFFIAIFLLLSLTTLALTLVRENELPEKEELEIDEKLSGAGKSKVPFFGEIFGALKDLPRPMWILLLVTCLNWIAWFPFFLYDTDWMAKEVFGGQVGDAKLYDLGVRAGALGLLLQSVVLGFMSLGVEFLGKKIGGAKRLWGILNFVLAICLAMTILVTKMAEKSRGHDAAGTLMGPTPGVKIGALLLFAALGIPLAVTFSIPFALAS

SEQ ID NO: 7586 - protein, 73 aa, Oryza sativa
NRILHHTIGLPDFSQELRCFQTITCYQAVINNLDDAHEQIDTAIATALRESKPVYISVGCNLAGLSHPTFSRE

SEQ ID NO: 7587 - protein, 266 aa, Unknown
  Halobacterium sp. NRC-1
MAAKELADRDVDVTIIEKNNYLGGGFWLGGFLMNKLTVRSPAEAVLDDLGVPYEYDEENDGLAVADAPHACSAMITAACDAGARIQNMTEFTDIVVRDDHAVAGAVVNWTPVHSLPRELTCVDPIALEADVVVDATGHDAVVVSKLHERGVLEADGIEHVEEHATGMDQSGDGEYGAPGHDSPGHDSMWVADSEDKVVEQTGKVHDGLVTAGLSTATVHGLTRMGPTFGAMLLSGKVAANAVMDELAVDEPRVDLPSTAAPAADDD

SEQ ID NO: 7588 - protein, 159 aa, Unknown
  Synechococcus sp. WH 5701
MAVNVSDVVVRGATGGEQRLGDFAGQVLLIVNVASRCGFTRQYAGLQKLQDSYGPRGLQVLGFPCNDFGAQEPGTLPEIQQFCATTYGASFTLFDKVHAKGVKTAPYDLLTTVEPAGDVEWNFEKFLVGKDGTVLARYKSAVEPDGAELTAAIEAALAA

SEQ ID NO: 7589 - protein, 482 aa, Aquifex aeolicus
MELIFEKSKKGRKGYKLPELDVEEVNIKEYLPEEYLREELDFPEVSELDVVRHYTNLSHLNYAVDTTMVPLGSCTMKYNPRINEELVNKKEFLNVHPLTPEEYIQPLLKLVYELKELLKELGGFAEVSLQPAAGAHGELLGLLLIHAYHQDRGNKEKKVVLIPDSAHGTNPASAAICGFDIKVVKSDKKGELDFEDFIKKLDERVAALMITNPNTLGIFERKIKEIAEELHKRDALLYMDGANFNALVGRFKPGEWGVDVMHFNLHKTFSTPHGGGGPGAGPVGVSERLKPYLPVPQIEYDGKKYYLNWNIEKSVGKILAFHGHFLVWLKALAYILTYGKDIKKVSEYAVLNARYLKHLLKGVFKDPYPESPCMHEFVLSATNLTKYGVRASDVAKRILDYGFYAPTMYFPLIVREALMIEPTETENPDTLKKFALILRKIVKEAKEKPEILKKAPHRTPVRRIKEAEANRNLILKFKDIKE

SEQ ID NO: 7590 - protein, 264 aa, Unknown
  Synechocystis sp. PCC 6803
MDSQNSSFSPAVYFVGAGPGDPDLLTIKGQKLLQAADLVLYADSLVPKQILADVRPQAECVATGNKTLETIVPLMITAVRQGKIVVRLHSGDLTLYSAIHEQMQALGEADIPFVCVPGISAFQAAAAILNCELTVPDLVQTIVLTRISGAASAVPEREELAGLAYHQASLGLYLAARHVEKAQNQLLEHYPGDTPVAVCFRVGWPDEKIWLVPLAEMAALSLRENLIRTTLYLISPALKTDLPRRSRLYHPDHSHLFRPVRPLL

SEQ ID NO: 7591 - protein, 304 aa, Saccharomyces cerevisiae
MSTSHCRFYENKYPEIDDIVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEELYKTIAWPLSRKFGHAYEAFKLSIIDETVWEGIEPPSKDVLDELKNYISKRLTPQAVKIRADVEVSCFSYEGIDAIKDALKSAEDMSTEQMQVKVKLVAAPLYVLTTQALDKQKGIEQLESAIEKITEVITKHGGVCNITMPPKAVTATEDAELQALLESKELDNRSDSEDDEDESDDE

SEQ ID NO: 7592 - protein, 326 aa, Streptomyces coelicolor
MSTAKDVRDVIVIGSGPAGYTAALYTARASLNPLVFGGAIFVGGSLTTTTEVENFPGFPDGVQGPELMENMRAQAERFGAEMVDDDIVAVDLTGDVKTVTDTAGTVHRARTVIVATGSGYRKLGVPKEDELSGRGVSWCATCDGFFFRDRDIVVVGGGDTAMEEATFLTRFARSVTVVHRRSALRASQVMQNRAFSEDKISLAFDSEVATLHEENGMLSGMTLRDTLTGETRELATTGLFIAIGHDPRTELFKGQLHLDSEGYLMVESPSTRTNVPGVFGAGDVVDHTYRQAITAASSGCAAALDAERYLAARSDTSVSAEVVAVA

SEQ ID NO: 7593 - protein, 236 aa, Eucalyptus globulus
MTRRYWNINLEEMMEAGVHFGHGTRKWNPRMAPYISAKRKGIHITNLTKTARFLSEACDLVFDAASRGKQFLIVGTKNKAADSVARAAIRARCHYVNKKWLGGMLTNWSTTETRLHKFRDLRTEQKAGRLNRLPKRDAAMLKRQLSHLQTYLGGIKYMTGLPDIVIIVDQQEEYTALRECITLGIPTICLIDTNCDPDLADISIPANDDAIASIRLILNKLVFAICEGRSSYIRNP

SEQ ID NO: 7594 - protein, 361 aa, Mannheimia succiniciproducens
MKFGTSTLTQGTPKLNRAHMIEIVRQLAQLHQEGYRLVIVTSGAMAAGRHYLNHPKLPPTIASKQLLAAVGQSQLIQTWEQLFAIYDIHIGQLLLTRADIEDRERFLNARDTLHALLDNRIIPVVNENDAVATAEIKVGDNDNLSALVAILVQAEQLYLLTDQQGLFDSDPRKNPQAKLIPVVNEITDHIRSIAGGSGTTLGTGGMSTKITAADIATRSGIETIIAPGNRENVIADLAHGEAIGTKFTVQTDKLESRKQWLFAAPSAGILTIDQGAENAILEQHKSLLPAGIVNIEGRFSRGEVVKIRTQQGKDIALGMPRYNSDALYLIQGKKSQNIEKILGYEYGSVAIHRDDMIVLNK

SEQ ID NO: 7595 - protein, 1195 aa, Gibberella zeae
MDDLLNLELLSLVSKVTSEVQNHLGVGEKTVAEFLIAKRTECNSFDEFRDNLETSTPGLPPSLVESIDRLVLALHPKFKGKAKDEQKEHPSRTLQEKEKVFSGLALPDKEPARDDGADAIDDTLALLEGLEPKAKKEKPTRKRSRSPENDQKEFRRRRRDRSRSRERRKRDKYRSRSRSQERGDEDWRDGYRDSRKDRRGRKRHDDDDRFRNAPAPEVDDSPQLHKVYQGHVTGLKDFGCFVNLHNVKGRVDGLVHVSRMSTGQRVNHPSDLVTQGQEVWVKVTSLDKDQNGRDRVGLSMKDVDQQNGQDLEPQVRMSTGANMEALGGGARDGFAEPSGMPRNDMGPPRRQKKRMTSPERWEIRQLIASGVAKASDYPDLEEDYNATLRGDGELELEEDVDIEVREEEPPFLAGQTKQSLELSPIRVVKAPDGSMNRAAMSGTNLAKERKELKQQEADAAAKDEPKENLSQQWQDPMADPDKRKFASDLRNARKNQPAEDVPEWKKAVIPKGQSLGKRTNMSIKDQRESLPVFAFRTQLIKAVHENQILIVVGETGSGKTTQLTQYLAEAGFANDGMIGCTQPRRVAAMSVAKRVAEEVGCKLGEEVGYTIRFEDCTSPSTKIKYMTDGMLQREILVDPDMSRYSCIMLDEAHERTIATDVLFALLKKTLKRRPDMKVIVTSATLDADKFSAYFNECPIFTIPGRTFPVEVLYSREPESDYLDTALVTVMQIHLTEPKGDILLFLTGQEEIDTACEVLFERMKALGPNVPDLIILPVYASLPTEMQSRIFDPAPPGSRKVVIATNIAETSITIDEIYYVVDPGFVKQNAYDPKLGMDSLVVTPISQAQANQRAGRAGRTGPGKCFRLYTEAAYQSEMLPTTIPEIQRQNLSTTILMLKAMGINDLLHFDFMDPPPINTMLTALEELYALSALDDEGLLTRLGRKMADFPMEPSLAKVLIAAVDLDCAEEVLSIVSMLNIPTVFYRPKEKQSQADQKKAKFHDPHGDHLTFLNVYNSWKTSGYSAPWCFENFIQARSMRRAKDVRDQIVKIMDRYKHPIRSCGRATEKVRRALCAGFFRNAARKDPQEGYKTLIEGTPVYLHPSSALFGKQAEWVIYHELVLTSKEYMHCTTSIEPKWLVEAAPTFFKVAPTDRLSKRKKAERIQPLYNKFATEDDWRLSAQRKGGRGGGGGGTWG

SEQ ID NO: 7596 - protein, 116 aa, Escherichia coli
GPGSMKLVTVIIKPFKLEDVREALSSIGIQGLTVTEVKGFGRQKGHAELYRGAEFSVNFLPKVKIDVAIADDQLDEVIDIVSKAAYTGKIGDGKIFVAELQRVIRIRTGEADEAAL

SEQ ID NO: 7597 - protein, 231 aa, Brassica napus
MELAGLSFLKLSFLLSLLSGGSDLLNPISEPGLVGKFPPTCNRIECPNYEVVHAGNGYEIRRYDTTVWISTEPIQDISLKDATRTAFFQLFAYIQGKNEYHQKIEMTAPVISQVSPSDGPLCESSFTVSFYVPKKNQPDPAPAENLHIQKWTPRYVAVRQFSGFVSDYNVGEEAAALSASLEGTAWANAIEKSKEDGGVGADSAYTVAQYNSPFEFIGRVNEIWLPFQMDD

SEQ ID NO: 7598 - protein, 413 aa, Listeria monocytogenes
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGVLYNFVEYGVREDTKEIDYDIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTTYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVATLTNEYPLYPSL

SEQ ID NO: 7599 - protein, 311 aa, Streptococcus pneumoniae
MHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 7600 - protein, 249 aa, Unknown
  Burkholderia sp. 383
MGKVYLIGAGPGAADLITVRGARLLAQADVVLHDALVEPAMLDYAPNARRIAVGKRCGQRSTAQHFINKQIVDAAREHAHVVRLKGGDPMLFGRAEEEMRALEAAGIDYEVVPGITAALAGAATLKRSLTLRGVSRSVAFATHSRAPGSDEIREAARADSMVYYMGRDSAPGIAQELIDAGRAPATPVAIVEACSTARERTLTLTLAQMAAGDAQAWLDPAEPSLLMIGDAFAERAGQAKAGDALRNAA

SEQ ID NO: 7601 - protein, 957 aa, Salmonella enterica
MTQTLSQLENRGAFIERHIGPDAAQQQEMLNAVGAESLNALTGQIVPKDIQLATPPQVGEAATEYAALAELKAIAGRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVAADVHPQTLDVVRTRAKTFGFDVIVDDADKVLDHQDVFGVLLQQVGTTGEIHDYGTLISELKARKVIVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQGMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHGSRNEGHRDICLIPASAHGTNPASAHMAGMQVVVVACDKNGNIDLDDLRAKAEQHAANLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASRLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 7602 - protein, 174 aa, Streptomyces violaceoruber
MATDVTTATAKPPLATIDSAHFRRVLGHFPTGVVVITAMADGEPAGLAVGSFASVSLDPPMVGFFPGKSSTSWPLVQRAGSFVVNVLGDHQQDVCRAFATSGGDKFTGIPWHRASNGAPALHDVIAWIECDIDTVTDAGDHWFVLGRVRDLALSTNTKSPLLFFQGRYARVGAA

SEQ ID NO: 7603 - protein, 278 aa, Burkholderia pseudomallei
MTPRAASAAPAGTCARRGSMRMGKVYLIGAGPGAADLITVRGARLLEQADVVLHDALVEPAMLDYAPRARRIAVGKRCGQRSSAQHFINKQLVDAAREHAVVVRLKGGDPMLFGRADEEMRALEAAGIDYEVVPGITAALASAAALKRSLTLRGVARSVAFATKSRAPGSDEIREQVSADSLVYYMGRDNAPGIARQLIDAGRAGATPVAIVEACSTPRERMLTLTLADMAAGAAQAWLDPAQPSLLMIGDAFAERAPRLADEPPGDAGGKRGMRDAA

SEQ ID NO: 7604 - protein, 401 aa, Pisum sativum
MISSLRQPSISISGSDVVLRKRHATLIQLRPQSFSPFSSREKSQRSVVSTKKPLHLACLGVGNFGSVKNFESEASFGQSDLVKCGAYEADRSEVEGGDGTPSEAAKKVKIGIYFATWWALNVVFNIYNKKVLNAYPYPWLTSTLSLACGSLMMLISWATRIAEAPKTDLEFWKTLFPVAVAHTIGHVAATVSMSKVAVSFTHIIKSGEPAFSVLVSRFILGETFPVPVYLSLLPIIGGCALAAVTELNFNMIGFMGAMISNLAFVFRNIFSKKGMKGKSVSGMNYYACLSILSLAILTPFAIAVEGPAMWAAGWQTALSEIGPQFIWWVAAQSIFYHLYNQVSYMSLDEISPLTFSIGNTMKRISVIVSSIIIFHTPIQPVNALGAAIAVFGTFLYSQAKQ

SEQ ID NO: 7605 - protein, 691 aa, Zea mays
MEASAGSSPPHSQENPPEHGGDMGGAPAEEIEGEAADDFMFAEDTFPSLPDFPCLSSPSSSTFSSNSSSNSSSAYTNTAGRAGGEPSEPASAGEGFDALDDIDQLLDFASLSMPWDSEPFPGVSMMLENAMSAPPQPVGDGMSEEKAVPEGTTGGEEACMDASEGEELPRFFMEWLTSNRENISAEDLRGIRLRRSTIEAAAARLGGGRQGTMQLLKLILTWVQNHHLQRKRPRDVMEEEAGLHVQLPSPVANPPGYEFPAGGQDMAAGGGTSWMPHQQAFTPPAAYGGDAVYPSAAGQQYSFHQGPSTSSVVVNSQPFSPPPVGDMHGANMAWPQQYVPFPPPGASTGSYPMPQPFSPGFGGQYAGAGAGHLSVAPQRMAGVEASATKEARKKRMARQRRLSCLQQQRSQQLSLGQIQTSVHLQEPSPRSTHSGPVTPSAGGWGFWSPSSQQQVQNPLSKSNSSRAPPSSLEAAAAAPQTKPAPAGARQDDIHHRLAAASDKRQGAKADKNLRFLLQKVLKQSDVGSLGRIVLPKKEAEVHLPELKTRDGISIPMEDIGTSRVWNMRYRFWPNNKSRMYLLENTGEFVRSNELQEGDFIVIYSDVKSGKYLIRGVKVRPPPAQEQGSGSSGGGKHRPLCPAGPGRAAAAGAPEDAVVDGVSGACKGRSPEGVRRVRQQGAGAMSQMAVSI

SEQ ID NO: 7606 - protein, 393 aa, Solanum tuberosum
YAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 7607 - protein, 553 aa, Daucus carota
MNRNSINILNYMQFTDAYLDKYGVLMTLELYSNNISGPIPSDLGNLTNLVSLDLYMNSFSGPIPDTLGKLTRLRFLRLNNNSLSGPIPMSLTNITTLQVLDLSNNRLSGPVPDNGSFSLFTPISFANNLNLCGPVTGRPCPGSPPFSPPPPFIPPSTVQPPGQNGPTGAIAGGVAAGAALLFAAPAMAFAWWRRRKPREHFFDVPAEEDPEVHLGQLKRFSLRELQVATDTFSTILGRGGFGKVYKGRLADGSLVAVKRLKEERTPGGELQFQTEVEMISMAVHRNLLRLRGFCMTPTERLLVYPYMANGSVASCLRERQPSEPPLDWPTRKRIALGSARGLSYLHDHCDPKIIHRDVKAANILLDEEFEAVVGDFGLARLMDYKDTHVTTAVRGTLGYIAPEYLSTGKSSEKTDVFGYGIMLLELITGQRAFDLARLANDDDVMLLDWVKSLLKEKKLEMLVDPDLENNYIDTEVEQLIQVALLCTQGSPMERPKMSEVVRMLEGDGLAEKWDEWQKVEVIHQDVELAPHRTSEWILDSTDNLHAFELSGPR

SEQ ID NO: 7608 - protein, 400 aa, Glycine max
MLVPHHPSMLIAPQNTSAENHDNIMEGQKQLHHFDESLMPNQSNIPSQFIWPDHEKPCLTPPELHIPPIDLKCFLSADPQALSTVCAELSEACKKHGFFLVVNHGVDSKLIAQAHKLIDDFFCMQLSQKQKAQRKIGEHCGYANSFIGRFSSKLPWKETLSFHYSADKSRKTVEDYFLNVMGEDFKQFGSVFQEYCEAMSKLSLGIMELLGMSLGVGRECFRDFFEGNESVMRLNYYPPCQKPELALGTGPHCDPTSLTILHQDQVEGLQVFVDGRWYSVAPKEDAFVVNIGDTFMALSNGMFKSCLHRAVVNNKIVRKSLAFFLCPNRDKVVTPPKDLISYENSRTYPDFTWPSLLEFTQKHYRSDTKTLDAFSRWLLEKNNPNRGAPTNVPWPTKSIN

SEQ ID NO: 7609 - protein, 196 aa, Oryza sativa
NILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 7610 - protein, 332 aa, Francisella tularensis
MQKNILVLGAGAWGTALALQLAYRGHNVRINSWKAEHNEQMLKDNNNHKYLPSIEKFPSRLKAIQDWQANIIEFDSILVATPSSGFKNTILELKECILPQQNIISATKGFCHDSYALLSEIAEDILPTTKFALLTGPSFAKELANQLPTAVVVASKDINYARYVQELFSNENFRCYTTTDIIGAQVGGAVKNVLAITAGIAAGMEFGVNAHAALITRGLAEIKKLGLKLGANSETFIGLSCLGDLLLTCSDNQSRNRRFGLYLGQGMTIQQALKEVNNVVEGYFTAKAVYNLAKKHNVEMPLVFATYRILYEAADPRDIVKELMTRQLKNEN

SEQ ID NO: 7611 - protein, 519 aa, Unknown
  Bacillus sp. YN-1
MVLEPQIKSQLNQYLQLMEGDVLLKVSAGNDKVSEDMLSLVDELASMSSRITVEKTNLERTPSFSVNRPGEDTGIVFAGIPLGHEFTSLVLALLQVSGRAPKAEQNVIDQIKNIEGEYHFESYISLSCQNCPDVVQALNLMSVLNPGISHTMIDGAAFKDEVESKDIMAVPTVYLNGESFTSGRMTVEEILAQLGSGPDASELADKDPFDVLVVGGGPAGASSAIYAARKGIRTGIVADRFGGQIMDTLSIENFISQKYTEGPKLAASLEEHVKEYDIDVMKLQRAKRLEKKDLIEIELENGAVLKSKSVILSTGARWRNVGVPGEQEFKNKGVAYCPHCDGPLFEGKDVAVIGGGNSGVEAAIDLAGIVNHVTVLEFMPELKADEVLQERLNSLPNVTVIKNAQTKEITGDDKVNGISYMDRDTEEVHHIELAGVFVQIGLVPNTDWLDGTLERNRFGEIVVDSHGATNVPGVFAAGDCTNSAYKQIIISMGSGATAALGAFDYLIRNTTPAESAAAK

SEQ ID NO: 7612 - protein, 354 aa, Streptomyces coelicolor
MTQHTDVVVIGGGQAGLAAGYHLRRQGLDFVVLDAQAAPGGAWQHTWDSLHLFSPAAFSSLPGRLMPPQPGKEYPDAGHVVAYLNDYEKRYDLPVQRAVRVIGVHDDGRLLRVETDSGTWRARAVISATGMWWRPFLPAVPGREDFEGRQLHTVSYRRPQDFAGQRVIVVGGGNSGAQIAADLAHDTELTWVTQRPPRYLADDIDGRALFDAATARRRALDDGRTDTGGVASLGDIVAVPPVREARDAGRLKASPMFARLVRDGVVWDDGTRAPADAVIWCTGFRPALSHLSPLGLRGSRGHIDTVGTRAAADPRLHLLGYGDWTGPASATLIGVGRPARDAAREIAEFLGGEG

SEQ ID NO: 7613 - protein, 295 aa, Rickettsia typhi
MSKISPINIKELLDAGVHFGHKTSRWNPKMASYIYGERDDVHIIDLRQSAALMSVALNAIYETVKKDGKILFVSTKIQASDIIAEYAEKCGQYYVNNRWLGGMLTNWKTIACSIEKLEKLEKTLESEETRVCYTKKEILDMSRKKDKLLLSLAGIRNLNSKPDLLVVIDTNKEHIAINEAVKLNIPIVAVVDTNSNPDNINYPIPGNDDSIRSIRLYCSLFADAALQGLEESMKVSGVDIGTMQEHTDKALTSKTISKLKQTKKFSKTQNIDEETNTEFDQALSDACENKNSDNT

SEQ ID NO: 7614 - protein, 314 aa, Zea mays
MSSSSSSSSSSAATVFPRSPQLPPPVLVENGLTPLHQLTPVAAAAPAAEQLCYVHCYFCDTVLVVSVPTSSLFKTVTVRCGHCSSLLTVDMRGLLFPGTPTDTVAGAAPPPAADTSTTTTTITTAPPPANSVNNGQFHLPHSLNHPYHQSLLVDEISSAANPSLQLQLEQHGGLGGLILGGSRNTAAPPPPQPPAAGKGAKEPSPRVNPAVNRPPEKRQRVPSAYNRFIKDEIQRIKAGNPNISHREAFSAAAKNWAHFPHIHFGLMPDHQGLKTTSLLPQDHQRKDGLLKEGLYAAAAAAAAHAAANMGIAPY

SEQ ID NO: 7615 - protein, 713 aa, Burkholderia mallei
MSLFNKIVKEFQWGQQKVRLETGEIARQASGAVIVDIEDTVVLATVVGAKSAKPGQDFFPLTVDYIEKTYSAGKIPGGFFRREGRPSEHETLTSRLIDRPLRPLFPEGFYNEVQVVIHVLSVNPEIPADIPALIGASAALAVSGLPFNGPVGAARVAYVNNEYVLNPTREQIKASRLDLVVAGTERAVLMVESEADQLPEDVMLGAVVFGHEQMQTAIDAIHELVREGGKPEWDWQPAPKDEALNARVTELAQPELLAAYQIRDKQARLTKLKEVYAATSAKLEEEAVAAGTVAADKATVGNILFDLEAKIVRGQILNGEPRIDGRDTRTVRPIEIRTGVLPRTHGSALFTRGETQALVVATLGTKGDEQIIDALEGEYRERFMLHYNMPPFATGETGRVGSPKRREIGHGRLAKRALVACLPSADEFGYSIRVVSEITESNGSSSMASVCGGCLALMDAGVPMKAHVAGIAMGLILEGNKFAVLTDILGDEDHLGDMDFKVAGTADGVTALQMDIKIQGITKEIMQVALAQAKEGRMHILGKMKDAVAGANTQLSEFAPRMITIKINPEKIRDVIGKGGSVIRALTEETGTTIDISDDGVVTIASTNSEGMAEAKKRIENITAEIEVGHVYEGTVLKLLDFGAIVNLLPGKDGLLHISEIVNERVKDINDYLKEGQQVKVKVIQTDEKGRVRLSAKALLNEAAAQADTPPQQ

SEQ ID NO: 7616 - protein, 737 aa, Yersinia pestis
MLKKILPVLITLAIVHNTPTAWAAEAPKTDSFYLPKSLDLSPLRLHNIESNPYGKDFNYAQQFKTLDLEAVKKDIKTVLTTSQDWWPADYGNYGPFFIRMAWHGAGTYRIYDGRGGADGGQQRFEPLNSWPDNANLDKARRLLWPIKKKYGAKISWGDLMVLTGNVALESMGFKTLGFAGGREDDWQSDLVYWGAGNKMLSDNRDKNGKLPKPLAATQMGLIYVNPEGPNGKPDPVAAAKDIREAFARMAMNDEETVALIAGGHTFGKAHGAASPEKCLGAAPGEAGLEQQGLGWANKCGSGNGKDTITSGLEGAWTTDPTHFTMQYLSNLYKHEWVLTKSPAGAWQWKPKNAANVVPDATDPTKFHPLMMFTTDIALKVDPEYKKITTRFLENPEEFKMAFARAWFKLTHRDMGPAARYLGDEVPKETFIWQDPLPAANYKMIDSADISELKDKILKTGLSDTKLIKTAWASASTFRGTDFRGGDNGARIRLAPQKDWPVNDPAELHSVLAALMEVQNNFNKDRSDGKKVSLSDLIVLGGNAAIEDAAKKAGYSISIPFTPGRTDASQEETDVSSFAVLEPTADGFRNYYDAKRNTLSPIASLIDRANKLELTVPEMTVLIGGLRVLDVNSGGSKAGVLTNTPGQLNNNFFVNLLDMSTKWTKSPKAEGYFDGYDRKTGKLKWTASSVDLVFGSNPELRAVAEVYASDDAKEKFVHDFTKVWEKVMNLDRFDIKNN

SEQ ID NO: 7617 - protein, 470 aa, Pseudomonas aeruginosa
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 7618 - protein, 973 aa, Unknown
  marine gamma proteobacterium HTCC2080
MKKMLINATQPEEIRVAIVDGQRLNDLDIENRSRGSTKANVYKAKITRVEPSLEAAFVDFGAERHGFLPLKEIAHQYYRSTAPEGEGKTRIKDVLKEGTEVIVQVDKEERGTKGAALTTYISLAGRYMVLMPNNPKAGGISRRIEGDDRTELRDALSQLNIPDGMGVIIRTAGVGRSPEELQWDLDYLLQLWSSISSASDENKAPVLLYQESDVIIRSIRDYLRDDVDQVLIDDKAAWQQAHDFVTMVMPKYAQRIRYYEDATPLFNRFQVEGQIESAFQREVRLPSGGSIVIDPTEALISIDINSARATKGSDIEQTALQTNLEAADEVARQLRLRDMGGLVVIDFIDMNANKNQRAVENRIRDALEVDRARVQVGRISRFGLLEMSRQRLRPSLGEISAMVCPRCTGKGTIRDTKSLALAILRLLQEEAAKDRTGEVRAVVPVEVAAFLLNEKRSAVNDIESSSGVRVLIIPNPHMETPHFDVIRLRDDEVEESTTLSYEVAIETPDPIAVRDEVSAIPAAPQPLVRGVTPQEPAPVAAEPEAPAPMAETRDIKQQPKTESPQKTGILTRMWGALFAPAPSEEADIETLTETEDSGHEESSEPKENANRQRRSRGGRNRTRSRRPDSDVQAEDTDEVDQTTVDADESDSSESNDDTDDRPKRNRRRRGRRGGQKRPLSDSSDVEANEGEEHTGEDDIDDAVDNDVQAAVAEESKESARHRPSDKRSEGRRRRQRGPKPDIQAETQADTAGTVTDAPVAGTDENDAPIENAVSAEANQVPAPALSSVTDQIDLLAGTPEGAKQTEEPMVAASSVTAQETDEANVTDEANVNDDTAQSTQTAESEPAPVTDAVAATSEEIASKEETVKPEEIIATAATIAPATAEVDRSGLTDAGRAVNDPRVEPKPIGEVNVATLRQALFLEQEAPPVSIVSRDIPRASNDPRGPKAGLAFTAAKRSPDESNEDTVPDAQAN

SEQ ID NO: 7619 - protein, 196 aa, Solanum lycopersicum
MEGNNSSSKSTTNPALDPDLDSPDQPGLEFAQFAAGCFWGVELAFQRVGGVVKTEVGYSQGNVHDPNYKLICSGTTEHAEAIRIQFDPNVCPYSNLLSLFWSRHDPTTLNRQGNDVGKQYRSGIYYYNDAQAQLARESLEAKQKEFMDKKIVTEILPAKRFYRAEEYHQQYLEKGGGRGCKQSAAKGCNDPIRCYG

SEQ ID NO: 7620 - protein, 260 aa, Glycine max
MDHQGHSQNPSMGVVGSGAQLAYGSNPYQPGQITGPPGSVVTSVGTIQSTGQPAGAQLGQHQLAYQHIHQQQQHQLQQQLQQFWSSQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHPSQVGAAGVIMGKPVMDPNMYAQQSHPYMAPQMWPQPPDQRQSSPEH

SEQ ID NO: 7621 - protein, 396 aa, Unknown
  Magnetococcus sp. MC-1
MNRWLKNMLHNEAASGVLIFLAAVAAMLIENSSLEPYYNSFLNIPVAVQFSELKIAKPLLLWINDGLMAVFFLLVGLELKREFLEGQLAQPANVVLPVVGAVGGIVGPALIYVMFNYTNPVALQGWAVPTATDIAFAMGVLALLGKRVPAAIKLFLLTLAIIDDLVAIVIIAIFYTSDLSVGSLTVAGGAIALLFLLNRIGVKGIAPYVLVGMVLWVAVLKSGVHATLAGVVLAMAIPIKGETPEHGSPLHALEHDLHHVVGLVILPLFAFANAGVSLAGLGLNVLLEPVAMGIGLGLLLGKQIGVMGAVWLANLLGVAKKPESLSWTQLYGVALLCGIGFTMSLFISSLAFEHSGAQVVAGAADAGHARLGILSGSLVSGVLGYLVLRFSLARKG

SEQ ID NO: 7622 - protein, 66 aa, Zea mays
PRGLGQKKETGDKAPKACDPFERLGVGFVKKPEEGKTKGLAFTKDPECSGAEKFAHPIGAGTFSAS

SEQ ID NO: 7623 - protein, 237 aa, Glycine max
MSSGKQETAAVRVLGRWPSPFVIRVLIALGLKGVDHELVEEAAGNKSELLLASNPVHKKIPVLLHHGRPVSESLIIVQYVDEAWASQAPALIPSDPYARAAERFWAQYVDDKFPTAIRVLRGRLDGDKEEAAAQVCAALQHLEVAFVECGQGKDYFGGDGVGYLDIALGSHLGWVRAVERIAEIRLLDAAKVPKLAAWADRFCAHPAVANAMPNVDRFVEFSVKNDGVLKAASANSK

SEQ ID NO: 7624 - protein, 381 aa, Fulvimarina pelagi
MKADYYETLGVSRNVDDRELKSAFRKLAMKYHPDRNPGDTDAEARFKELGEAYEVLKDPQKRSAYDRFGHAAFQNGGGGGAGGFRGDFSSSMADIFDDIFGEMMGGRGRARQSGGTSGRERGSDLRYNMEISLAEAFSGKTAEISVPTTIQCDVCTGSGAKPGTTPSSCPTCGGVGRVRAAQGFFSIERACPTCQGRGSVITDPCNKCGGDGRLPEERTLQVNIPEGIEDGTRIRLAGEGEAGLRGGPAGDLYIFLSIAPHEFFQREGADLYCSVPVSMTKAALGGAFEVQTIDNGTARVKLPEGTQTGKQFRLKGKGMPVLRSPQTGDLFIQVMVETPQNLSKRQRELLEEFDEIGSKDNSPQSNGFFSRMKDFFENLSD

SEQ ID NO: 7625 - protein, 1033 aa, Vibrio fischeri
MNNWENFFRLNENRMAPRAYFFSYDSVQAARTFQRELSSHYQLLSGQWTFNFFTNPLLVPEEFYSQHMSDWGNITVPNMWQMEGHGDLQYTDEGFPFPIDVPFVPSDNPTGAYQRTFTLGETWNNKQIIIKFDGVETYFEVYVNGNYVGFSKGSRLTAEFDISEFAQQGENLLSVRVMQWADSTYIEDQDMWWTGGIFRDVYLVGKEQVHVQDITIRTDFDENYQSATLSCKADLENLTNNSVSNYSLGYALFDGQTVVSEGTVNSLSFDANHCVDINIDMESPTHWTAENPYLYQLILTLKDENGKTLEIIPNRVGFRDIKVRDGLFYINNKYVMLHGVNRHDNDHLKGRAVGMDRVEKDIVLMKQHNINSVRTAHYPNDPRFYELCDVYGLFVMGETDVETHGFANVGDLSRITNDPAWEHVFVERIERHIHAQKNHASIIMWSLGNESGYGCNIKSMYDAAKAIDDTRLVHYEEDRDAEVVDIISTMYSRAQLMNAFGEHPHNKPRIICEYAHAMGNGPGGLTEYQNVFYKHDSIQGHYVWEWCDHGILAKDENGTEFLKYGGDYGDYPNNYNFCMDGLVYSDQTPGPGLKEYKQVIAPVKIRAKDTANGVFTVDNKLWFSNLDDYTITAEIRAEGETLQSTTFKVEGLTENSSRDIEITLPELDGRETFVNFTVRKNSRTLYSEANHDIAVYQVQLKENTEQLPVFTNSNAIALDITASRLDYVVKGLNFALTFSKVNGKLTSWVVNGDELIASAPKLNFFKPMVDNHKQEHEGLWEPAHLQIMQEHFRSIDLDASNGKATFTVTSIIAPPVFDFGMRCTYVYEINKEGQLNIQLSGERYGDYPHVIPVIGLDLGINNDFDQVQYYGRGPEENYQDSQQANMIDVYQTTIADMFENYPFPQNNGNRQHVRWASLANRHGNGLFVKPEQEINFSAWFYTNQNIHEAQHTIELEKSGYITLNLDHKLMGLGSNSWGSEVLDSYRVYMDKFQYALTLVPFQQGGCSPKALANHTFISNTAFTSKTTIEGGEK

SEQ ID NO: 7626 - protein, 452 aa, Fusarium sporotrichioides
MEEYTVKQVAEHNKPDDSWLIIHGKVYDVTRYIRDHPGGADVLVEAAGIDASEDFDNAGHSEDAFEIMEDLCIGKIKGFEKKKPKLKPLAPITTPKAVSGGSSSLSTLASFTLVLVAGVGAYYFGRRHELSVPNWVLAYLRNDSAGSSFIKGAIVGSGSIAITNAVLAQRFTTLAMKSKPFTSYPAHMKVPKRTQHDTLLQRGLLDPVAYSPLPLVEKTQITPNVLRLTISLPTTSTVLGLPIGQHVTIKADVLGKTVARSNTPVSNNSDLGILELVIKVYPDGKLTHNYLAHLEVGNEVLFRGPKGAMKYQPNLCKKIGLIAGGTGITPMFQVIRAVCEHDRDTTEISLIYANRTEQDILLREELDKFARRYPKNFKVYYILDEPPSDWEYGSGYVTQELMKEKMPPPNMDSKVFLCGPPGMVNASKKGLVGLGYEQPGASAKMSDQIFVF

SEQ ID NO: 7627 - protein, 575 aa, Glycine max
MKKKNIETKIIKKTKSDEEKWVHDASVDYKGRIPLRASTGVWKASLFVLAIEFSERICHFGIATNLIMYLTKVMHEDLKTATKNVNYWVGATTLMPLIGGFVADAYTGRFRMVLFSSLLYLKGLSLLTMSQFIPSLKPCNNEICHWPRKVHEVVLFLALYCVALGTGGFKPCLQSFGADQFDDDHLEERKKKMSFFNWWNFTLCTAMLLGATVIVYVQDFVSWGVSYLILSMFMALTIIAFYEGKRFYRYRSTEGNPFMLILQVLIAAIRKSNLSCPSNPDSLYEFPKSEKSQGRLLSHTCRLRFLDKAAIVEGKYTEHRDQNPWRLATVTRVEETKLILNVIPIWLTSLIIGICIAQGSTLFVNQAASMNLKIINSFKIPPASMTSVSAISPIIAIPIYDKIIVPIMRKVKGNERGISVLWRVGIGLAFLVIAMVVAALVETKRLRMVEHDETMSVLWLIPQYLILGIGADSLSLIGLQEYFYDQVPDSVRSLGVGLYLSVVGVGFFLSSFLIITVDHVTGKNGKSWIAKDINSSRLDKFYWMLAVINAFNLCFFLFLAKGYTYKTVQRKTREI

SEQ ID NO: 7628 - protein, 467 aa, Bacillus licheniformis
MRNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKAKGIGYLGIGISGGEVGALKGPSIMPGGDRDVYEKAAPILTKIAAQVEGDPCCVYIGPKGAGHFVKMVHNGIEYADMQLIAEAYTFLREKLLLPIDEIADIFDTWNQGELKSYLIEITAEILRKKDERTGAPLIDVILDKTGQKGTGKWTSLQAIDNGIPSSIITESLFARYLSSLKDERTAAENVLAGPETEERPLDQNVWIDRVRQALYMGKVCAYAQGFAQYKMTSDLNGWHLPLKDIALIFRGGCIIRAQFLNLISEVYDKQPDLSNLLVAPDFAEKLKEYQSGLRKVVCEGISSGISFPCLSTALSYYDGYRTGRSNANLLQAQANYFGAHTYERTDMEGVFHTDWY

SEQ ID NO: 7629 - protein, 887 aa, Unknown
  Azoarcus sp. EbN1
MSFAVKSNITWVGKQDWELREFHGAEYSTHKGSSYNSYLVREEKVALIDTVWSPYAQEFIDNLEKEIDLHKIDYIIANHAEIDHSGALPALLARIPDTPIYCTENGVKSLKGHFHKDWNFKVVKTGDTLDLGNGKQFVFVEAPMLHWPDSMMTYLAGDAVLFSNDAFGQHYASEQMFNDLVDQEELRAECLKYYANILTPFSARVAAKIHEVLSFKLPLEMICTAHGVIWRDNPAQIVEQYLAWADDYQENQITLIYDTMWNGTRQMAEAITKGIRSADPSVEVKMFNLAISDKNDVLTQVFKSKGILVGSPTVNNGMLPHVAALLEEMRGLRFRGKHAASFGSHGWAGGAVDRIAQRLEEAGFKVSGGIEAVWKPTDGALDECLAFGRRVAQQWRGDYVPVEAGDSAPASAFARQPVRPAAKPVAAATATPNVAEADGGSMRCRTCGWVYDPAKGESGQGVHAGTPWSEVPETFLCPECLLGKTEFEPLHPRRDGAADASRGDGLQPAPVVIIGGGSATYQLVRAFRAQDQDTPVLVITADAGADYPKPQLVHGFSRKLGPSDLVQRSPEELAREFNVTIKTHTRVDSIDAEAKTISFAGEIQPYRDLVLALGATPWIPPLEGNAVDRVITLNNLADYETYLHQLSQGKRVLVIGAGLTGTEVALDLAEGGQQVWLTDIAPRTLAKVLPEFVSQELEARLVQKGCRLHLGQNIVSIDSSAGGATVRLSDGETFEVDTVVSAAGVRPRTELAEAAGLQVNRGIRVDPQLQSSSAHIYALGDCAEIEGRVLPFMHPLSLAAQALAKTLAGERTGLRLPAMPTMVKTPAMPIQVGGVTVADGLQWTVDADETGLTGKAVNDEGELVGYVVTGKHLGNGMALLQQLPALL

SEQ ID NO: 7630 - protein, 136 aa, Wolbachia endosymbiont
MQEIILTGEKIKFLESLNEGDIIEGKIKSITHYGVFVGIHESDVVGVIDGLLHITDISWSRVSHPSAVFTCGQTIKVKIIKIDKENAKISLGVKQLEDSPWQDAESKYPVDSVHKGYVTSIEDYGLFVELRPGIEV

SEQ ID NO: 7631 - protein, 577 aa, Legionella pneumophila
MNSEVDTLFAQAYKLQYEGHLPQAISLYEQILAQSPKHTETLHFLGLTYAQLGDMENAILYFLQARKINPNDVGILNNLANAYKKAGQLDEAIKYYQQAIEIKPEYVQAHNNLAATYALLNNYQKALHHYVIAVNTEPDFSAAHFNLGLLLLKNQQLSAAKTQFNNVIALNPQHREAQFYLGILHLEDNLLSEAEQAFQKVLEQDHEHVQSLINLGVIALKREQNQLAVDYFTKALALDNEDIDARNNLAATFMHHDRFENALMHYDVLLKKEPDNLEYLYNSGVAQMALGHLNEATLLFDQILTLQSDHTPSLNNLAAIYLKMDMRETAREYLERALAINPDDVVSRHMLNAITGATSVDTTEKYAQNLFNNYALYYDQHMQGELHYKIPHHIGRLIHQLQLLQTSHSLDLGCGTGLTGIVLREISKHLTGVDIAEKMIARAKEKNIYDLLVCSELIDFLRKDKNDYDLAVAADVLPYFGNLDDIFNSINQHLKQEGYFIFTTEISTTTPWKLESSARFSHQPEYIESLINKYQFHLIKQEKIPGRTQNKQVLEVMLYCVKKSASRFVANRTYENP

SEQ ID NO: 7632 - protein, 669 aa, Oryza sativa
  misc_feature (160)..(160): Xaa can be any naturally occurring amino acid
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHXGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQVYLGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFIASAFAAARRARHAGTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAVSSVPARAGVSIAHLPMFAAWTDA

SEQ ID NO: 7633 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAKAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 7634 - protein, 282 aa, Solanum lycopersicum
MTGGKEIIDKIKEKVGLSSSDTGRGKSKMSKNITHGYHMVEGKSHHTMEDYVFAQFKQVDENELGLFAIFDGHLSHEIPEYLRSHLFNNILNEPNFWAEPESAIRKAYRITDTTILDKAADLGKGGSTAVTAILINGQKLVVANVGDSRAVIYKNGVAKQLSIDHEPGREREIIEGKGGFVSNFPGDVPRVDGQLAVARAFGDKSLKMHLSSEPDVVVELIDDDTEFLILASDGVWKVLSNQEAADCIKDIKDARSAAKHLNEHALARGSTDDISCVVVRFQ

SEQ ID NO: 7635 - protein, 571 aa, Striga hermonthica
MCGILAVLGVSENSQAKRSRIIELSRRLRHRGPDWSGLHNHQNCYLAHQRLAIIDPTSGDQPLYNEEKTVFVTVNGEIYNHKELREKLKSHVFRTGSDCEVIAHLYEEYGEEFVNMLDGMFSFVLLDTRDNSFIAARDAIGITPLYIGWGLDGSTWFASEMKALSDDCERFMTFLPGHIYSSKSGGLRRWYNPPWYAEQIPSAPYEPLVLRAAFEKAVIKRLMADVPFGVLLSGGLDSSLVASVASRYLADSPAAQWGTQLHTFCIGLKGSPDLRAAREVADYLGTRHHEFHFTVQEGIDALEEVIYHIETYDVTTIRASTPMFLMSRKIKSLGVKMVLSGEGSDEIFGGYLYFHKAPNKEEFHEETCRKIKALHLYDCLRANKATSAWGLEARVPFLDKEFIDVAMGIDPEWKMIRPDLGRIEKWILRNAFDDEEKPYLPKHILYRQKEQFSDGVGYSWIDGLKDHANQQVTDAMLANANFVYPENTPTTKEAYYYRTVFERFFPKNAARSTVPGGPSVACSTAKAVEWDASWSKNLDPSGRAALGVHVAAYDEAKMAGEGPTANGSPKE

SEQ ID NO: 7636 - protein, 258 aa, Ralstonia solanacearum
MTPPNLNLFDLSGRTALITGASSGIGFALAGGLARAGARVVLNARGPEKLAQAADSLRAQGADVHTAAFDVTQSTAVAEGIARVEAELGPIDILVNNAGMQRRAPLEQFETDQWHELMKTNVDSVFLVGQAVARYMIPRGRGKIINICSVQSELGRPGIAPYTASKGAVKMLTKGMAIDWGPHGLQVNGLGPGYFKTELTQALVANAEFTAWLVGRTPSRRWGDVEDLTGAAIFLASKASDFVNGHILYVDGGVTATL

SEQ ID NO: 7637 - protein, 382 aa, Pseudomonas syringae
MSAPVVIVGTGLAGYNLAREFRKLDADTPLLLITADDGRSYSKPMLSTGFGKNKEADGLSMAEPGAMADQLKAEIRTHTRISGVDPGHKRLWIGEEAVYYRDLVLAWGAETIRVPVEGDASDAVFPINDLQDYARFRAAAAGKRRVLILGAGLIGCEFANDLMLGGYEVDLVAPCEQVMPTLLPPAAAAAVKAGLESLGARFHLGPLLTRLQRADEALQAHLSDGQVIDCDVVVSAIGLRPRIDLAAAAGLQTGRGILADRQLQTSHANIYALGDCAEVDGLNLLYVMPLMSCARALAQTLAGTPTAVKYGPMPITVKTPACPLVVSPPPRGTDGQWSIEGQGADIKALCHDTGGNLMGYALTGTAVMEKLALNKVLPALLA

SEQ ID NO: 7638 - protein, 267 aa, Unknown
  Thermotoga sp. RQ7
MRVAAVQMLPAIGGFEENLSRIEHFVEEAISSGVDVIVFPELTISGYTWDEKTLERGARFFEEVVRKKLLRLSREGQIVIVTGTPRIVLGKLRNSLVIFKKKRELLFYDKTHLFRGEKDVFEPGEYFLVFSHRGVIFGTLICYEIGFPEISRILTLKGSKVILSSFAFGKERGHTYDIATRARAVENGVFLVASSMCGKGFVEFVGRTRIVAPNGKVLRELETSEGVIFEDIDPDIVYHYRYDEEGDSHAYLKNYRAHMYSLQKGRL

SEQ ID NO: 7639 - protein, 675 aa, Ostreococcus tauri
MTSLSPHDVAAAHVDGDVATRCIEAPFGASYLFQPKNRRRGIDRKARKQRLCAKMATRPGVWYDFPWANVGALKYAVFAPFVLAVALGKDDADSFCWHLLAIAAARYVNAQLWISLSRVHAWTRNTRIQAKGIDFKQVDREDHWDDYILLQTLVIAAVHWMPGLGFKDFPLYSGKSFAQLALLHAGPTEFIYYWLHRALHHHKLYSAYHSHHHASFVTEPITGSVHPFMEHLMYTANFAIPLLGTWALGGGDIAMFYTYLIGFDILNAIGHCNFEFVPRWFMRLPGMKYLIYTPSYHSLHHSRVHTNFCLFMPLYDYVYGTADVTSDELYEKAITGNAVPVKAPEVVFMAHGTELLSVFHLPFVLRSFSSRPFVSEWWLKPFWPLCVPFVLLLRVFGKSFVADRHRLKTLNCETWVTPAWGFQFFMKSEFNHINKKIEEAILDADKSGVQVVGLGALNKNEALNGGGALFVNKHGKSLKTRVVHGNTLTAAAILQKIPNDCKEIFLTGATSKLGRAIALYCAERGVRVVMYTTSEERFEMIRAEAPKKDQHLFVQSTSLTDGANIKDWVIGKHCSMKDQKSAPRGATFHQFVVPPIPESRKDCVYTDLPAFKLPRESKDFRSCEMTMPRGHVHACHAGALVHALEGWDHHEVGAIDHTRIDLTWEAALKHGFSLA

SEQ ID NO: 7640 - protein, 426 aa, Oryza sativa
MVATRSTTSRRCLTWWWLACCCFVSWVASSSWTAAACVAVSSLPGFDGPLPFSLETGYVEVNESTGVQLFYYFVRSEKNPDLDPLLLWLTGGPGCSSISGLAHEIGPFQFAAKRYYSGGLPIIIYRPETWTKVSNIIFVDSPVGAGFSYAATEEGSKSSDTNAVKQLLIFLRKWLHDHPRFSLNPLYIGGDSYSGMIVPTLTLAIDESNGSEEKPFFNLKGYIAGNPVTDYKIDEDGRIPFLHGMGLISDELYEHAKETCGEKYSAPSNAQCAHSVQAINDKASHVLLKIWANDETVRESLGVQKGTVGEWKRCNRDIDYNSDVRSTVEYHLTLMRKGYRAIIYSGDHDSRVPSISTQAWIRLLNLSIADDWRPWYVDGQVAGFTRSFASNNLTYATVKGAGHTAAEYKPKECQEMFARWISGTPL

SEQ ID NO: 7641 - protein, 584 aa, Arabidopsis thaliana
MMMFNEMGMYGNMDFFSSSTSLDVCPLPQAEQEPVVEDVDYTDDEMDVDELEKRMWRDKMRLKRLKEQQSKCKGGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 7642 - protein, 417 aa, Borrelia burgdorferi
MRDDQIFNLIEKEKLREREHIELIASENFTSLEIRQAVGSILTNKYAEGYPLNRYYGGCSFIDEIETLAISRAKELFGAKYANVQPHSGSQANMAAIMALISPGDRILGMQLSHGGHLTHGSRVNFSGIFFNTYFYGVSRDSELIDYDEVLKIAKDCRPNLIIAGASSYSREIDFKKFREIADDVSAYLLCDIAHIAGLIVAGFHNSSIDVAHLTTSTTHKTLRGPRGGIILSGKDFDKLVNFNGKEKPLFNAVNSTVFPGTQGGPLVHVIAGKAIAFKEALQESFKEYIANVIKNTKVMAEYFKSEGFRIVSGGTDNHLFLVDLSSSDLTGADAEKLLESVNITLNKNAIPFDKKSPSLASGIRIGGAAITSRGLNESDSLNVAKFIVRALKAKSDIELKQIKKEVVRFIRDFDMP

SEQ ID NO: 7643 - protein, 89 aa, Angiopteris evecta
MKKQDLIDMEGIVTESLPNAMFRVCLDNGCQVLTHISGKIRRNYIRILPGDRVRVELSPYDLTKGRIIYRLRNKYPNGISQEVFRSMRD

SEQ ID NO: 7644 - protein, 656 aa, Coccidioides immitis
MRCSFVLANYNWLSSRVVGIQPATVLSVSAIHSKLVLSLVACEPCLGAIFGNEGFKLAGSKRLSFSGQGGLLNRMFGGSSSPNKDKNTSIASPSTITSTTRARVTESPPAREGKGSSSDILKRSNDKRDQNGDKKRRGSSVSRAAAFFANAKNSLHISGLREPHKSPQVAQTPLQILGKMDPALVVPQGSLNNSAGESLPTPRSSFRVGVTEDKNKKCRRTMEDTHAYLYNFLGTPLSINQGESSPQSSQPKEPGGPESGDSTPIIETDNGYFAIFDGHAGTFAAEWCGKKLHLILEETIRRNPTIPVPILLDQTFTLVDQQLEQLPLKNSGCTAVIAVLRWEDRAPNSTISTPDAVNNKIQNPEPKGDRGETLQIPGNSTTETPSARDSRTMSASKPENPTVRQRVLYTANVGDARIILCRNGKALRLSYDHKGSDENEGMRITNAGGLILNNRVNGVLAVTRALGDSYMKDLVTGHPFTTETVIQPEADEFLILACDGLWDVCTDQEAVDLIRNAHDPQEASKILVDHALSQFSTDNLSCMVVRFDSKAHADGVNIKSAGESEVLNKTSVSETDKIVAQAKRESHRNSASNLDPAITEADSSREVEVAAAKLDEEPGPELSLPEKPKNDVDAMSSTAPSELTSAPNKGSPPKVK

SEQ ID NO: 7645 - protein, 458 aa, Bacillus thuringiensis
MSTKMTPPVEKNEFIDVVFEDLTHDGAGVAKVKGYPIFVKNGLPGEEAQIKIVKVKKNFAFGRLMKLHTESPYRKEAECPVYNQCGGCQLQHLTYEGQLQAKEKQVRDVMQRIGGLGDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 7646 - protein, 574 aa, Unknown
  Acinetobacter sp. ADP1
MELLSGGEMLVRALADEGVEHVFGYPGGAVLHIYDALFQQDKINHYLVRHEQAAGHMADAYSRVTGKTGVVLVTSGPGATNTVTPIATAYMDSIPMVILSGQVASHLIGEDAFQETDMVGISRPIVKHSFQVRHASEIPAIIKKAFYIASSGRPGPVVIDIPKDATNPAEKFAYEYPEKVKLRSYQPPSRGHSGQIRKAVDELLTAKRPMIYTGGGVVQGNASELLTELAHLLGFPVTNTLMGLGGFPGDDPQFVGMLGMHGTYEANMAMHNADVILAIGARFDDRVTNNPAKFCQNAKVIHVDIDPAAISKTIMAHIPIVGAVQPVLQEMLTQLKQLNVSKPNPEAISAWWDQINEWRKVHGLQYQAGQDGIMKPQQVVEALYKATDGNAIITSDVGQHQMFGALYYKYKRPRQWINSGGLGTMGVGLPYAMAAKLACPDQQVVCITGEASIQMCIQELSTCKQYGLNVKILCLNNRALGMVKQWQDMNYEGRHSSSYVESLPDFAKLMEAYGHVGIQIDHTDELESKLAEAMAINDKCVFINVMVDRTEHVYPMLIAGQSMKDMWLGKGERT

SEQ ID NO: 7647 - protein, 430 aa, Listeria monocytogenes
MKITINQASEFVGKEVTIGAWLANKRSSGKIAFLQLRDGTGFMQGVVVKAEVGDDIFATAKALTQETSLYVTGTINEDTRSPFGYEMAVSSVEVISESHDYPITPKEHGTEFLMDHRHLWLRSNRQHAIMKIRNEIIRASYEFFNKEGFLKIDPPILTGSAPEGTTELFHTKYFEEDAFLSQSGQLYMEAAAMAFGKVFSFGPTFRAEKSKTRRHLIEFWMIEPEMAFYKLEDSLQVQENYVAFLVKAVLDNCRLELDRLGRDVSHLEKMVAPFPRITYTEAIERLHELGFDDIVWGDDFGAPHETAIADSFEKPVFITHYPKAIKPFYMPEDPENDQVVLCADMIAPEGYGEIIGGSERIHDLETLQARMEDFDLDQEAYSWYLDLARYGSVPHSGFGLGLERTVAWISGTEHVRETIPFPRLLNRLYP

SEQ ID NO: 7648 - protein, 502 aa, Actinobacillus pleuropneumoniae
MKRLTKNLAMATIAMLGCLSSAAWAEEKPAQTPSLTDKALKHEKLGVVVESANHKFAEKYPLQYNSWKATSESTDRGSALAADPRYVVLWAGYAFAKDYNKPRGHYYAITDVREILRTGAPKDENDGPQPMACWTCKGPDVARLIEEKGERGYFDPKWAKYGAEIVNSIGCADCHDTTSKEFEEGKPALRVARPHVLRALETVGWKFEDLDKHGKRTAVCANCHVEYYFKGKTDVTFPWDKGVDVDSIEKYYDEIQFADWTHALSKAPMLKTQHPDFEIWSQGVHGKNGVTCIDCHMPKVKDKDGKVYTDHKIGNPFDQFDATCKTCHEQSKETLEKRVKEHKHQVKEAMIRLEDQLVKAHFEAKAAWEAGATQEEMKDILTAIRHAQWRWDYSAAGHGSHMHAPDVMLHVIASGIDRAADARAQLGVVLAKHGVTTPVAIPDISTKEKAQKAIGLDIPKDQAAKDEFLRTVVPQWDAEARKKGLLPAEEPKAVVAPKAEAK

SEQ ID NO: 7649 - protein, 216 aa, Triticum aestivum
  misc_feature (198)..(198): Xaa can be any naturally occurring amino acid
MGGRVDHEYSYLFKMVLIGDSGVGKSNILSRFTRNHFSLDSKSTIGVEFATKSLQMDGKTIKAQIWDTAGQERYRAITSAYYRGAVGALLVYDITKRQSFDNVHRWLRELRDHADSSIVIMMVGNKSDLIHLRAISEDEGKALAEKEGLFFLETSAMEAINVEQAFQTIITEVYGIVNRKALAAKEAAAATASFPPRXNISIDSTAGNTKRACCST

SEQ ID NO: 7650 - protein, 72 aa, Dechloromonas aromatica
MAKEDYIEMLGEVVENLPNATFKVRLENGHIVHGFISGKMRMHYIRILPGDKVTVQLTPYDLTKARIVFRTK

SEQ ID NO: 7651 - protein, 306 aa, Listeria monocytogenes
MQKKAMIIYNPAAGKNKFRKLLPDAEKILTEANFEVTLVPSTPAPKSTTFIAKQAAEAGFEVVIAAGGDGTVNEVVNGLMQVDTPPKLGVLPVGTTNDYARALNFAKDPLEALRIIAKQETIRVDIGKANETEFFINNAAGGKITEITYAVKESMKSKWGRLAYLFSGLTVLPKLSPVYVEIAYNDEIFKGKILLFFVNKSNSVGGMETLCPPAELNSGMFELLILKKVSPKKLFQLFASIKKGTHLSSPHVIHARTNKVTINSDADLNVSYDGVYGGKAPYTLEVIPEALEVFADKNRISSRLRG

SEQ ID NO: 7652 - protein, 260 aa, Aspergillus fumigatus
MATITQVQTQETHTVLPKSLTVVPGQITVKEISNLDLPDIPLPPPSTNPTEILAQDKGTPDNHVPRDPRLIRLTGVHPFNVEPPLTALFNEGFLTSPELFYVRNHGPVPLVRDEDIPNWEISIEGLVERPVVLNFRQILQKFNQITAPITLVCAGNRRKEQNTVRKSKGFSWGPAGLSTALFTGPLMADVLRYAKPLRQAKYVCMEGADKLPNGYYGTSVKLNWAMDPNKLIMLAHKMNGEPLRPDHGRPLRAVVPGQIG

SEQ ID NO: 7653 - protein, 415 aa, Bacillus subtilis
MKHLPAQDEQVFNAIKNERERQQTKIELIASENFVSEAVMEAQGSVLTNKYAEGYPGKRYYGGCEHVDVVEDIARDRAKEIFGAEHVNVQPHSGAQANMAVYFTILEQGDTVLGMNLSHGGHLTHGSPVNFSGVQYNFVEYGVDKETQYIDYDDVREKALAHKPKLIVAGASAYPRTIDFKKFREIADEVGAYFMVDMAHIAGLVAAGLHPNPVPYADFVTTTTHKTLRGPRGGMILCREEFGKKIDKSIFPGIQGGPLMHVIAAKAVSFGEVLQDDFKTYAQNVISNAKRLAEALTKEGIQLVSGGTDNHLILVDLRSLGLTGKVAEHVLDEIGITSNKNAIPYDPEKPFVTSGIRLGTAAVTSRGFDGDALEEVGAIIALALKNHEDEGKLEEARQRVAALTDKFPLYKELDY

SEQ ID NO: 7654 - protein, 453 aa, Thermosynechococcus elongatus
MTPPRIENVVIIGSGPAGYTAAIYAARANLKPLMFEGYQIGGLPGGQLMTTTEVENFPGFPEGIQGPQLMARMKAQAERWGTEMVTEDVIQVDFSQRPFLISSAERQVYAHSVIICTGATAKRLHLPGEEQYWTKGVSACAICDGATPIFKDVELAVIGGGDSAAEEAVYLTKYGSHVHLLVRSDKMRASKAMQDRVFANPKITVHWQTEAREILGDGNLMTGLRIINKATGEESLLPVRGLFYAIGHTPNTQLFKDFLELDSVGYIVTRHGTQTNVEGVFAAGDVQDHEYRQAVTAAGSGCMAALDAERWLSARGLIQEFHQRATETQPAATAKPTASPQQEFDPNAIKHRGSYALRKLFHESDRLLLVKYVSPTCGPCHTLKPILDRLVEEFDGKVQLIEIDITEDSAIAEQAGVTSTPTIQLFKNKELLEVIVGMKPKSQYRETLQRYLS

SEQ ID NO: 7655 - protein, 507 aa, Aspergillus fumigatus
MNSLKLLVVSPEINPSNRKARSIPVLNPFDRYGRVFFFSWLGFMVAFLSWYAFPPLLTVTIRKDLHMTQQQVANSNIVALLATFLVRFIAGPLCDRFGPRLVFIGLLLCGSIPTAMAGLVTTPNGLIALRFFVGILGGTFVPCQVWCTGFFDKNIVGTANSLAAGWGNAGGGITYFVMPAIYDSLVHSQGLAPHKAWRVAYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIADMLYKYTGAVWSKKVLLSFLGVVMGAFQLAIGLADPRSEATMFGLTAGLAFFLEACNGTNFAVVPHVHPFANGVVSGAVGGMGNLGGIIFAIIFRYNETHYSRSLWIIGVISIAANLAVSWIRPVPKSQMMRQ

SEQ ID NO: 7656 - protein, 555 aa, Atriplex dimorphostegia
MWSQLSSLLSEKMDALATSDHASVVSMNLFVALLCGCIVIGHLLEENRWMNESITALLIGLSTGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVANDATSVVLFNAIQSFDLTRIDHRIALQFMGNFSYLFIASTILGAFTGLLSAYVIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNLAKKSHGEKVTFNQQIVIWWAGLMRGAVSMALAYNQFTRSGHTQLRGNAIMITSTISVVLFSTMVFGLLTKPLIMFLLPHPKHFTSCSTVSDVGSPKSYSLPLLEGNQDYEVDVGNGNHEETTEQRTIVRPSSLRMLLNAPTHTVHHYWRKFDDSFMRPVFGGRGFVPFVPGSPTEQSTNNLVDGT

SEQ ID NO: 7657 - protein, 864 aa, Vibrio fischeri
MNNNMSLKKKSILALACYVCFLITVIGSITYCVVEPPIRENLENNLNLRTQLLAREIEDPLNHSLSILHALVGVAASGYSIDVLEDMTYSVFKESDDIIISGGIWPEPNTLEPSKQLASIFYSRDERGKITSVNDYNIPSNTPYQQESWYTSVSHENSSHNISWSEVYIDPFTKQKMITASQPYFENNQFVGVATIDISLKGLIGVIESQAEKHQLGISVYDGNTTIAEYKFAVDESMYVVELFMDDLRWELKVVNSVLTVADETFAQVVNIELGIVPILLACVILAYYFINRSLINPIVLISQQVNERESSEKIDINYGYKDEIADLIYSFNQETEYLEIEKSKAEALAKAKSSFLANMSHEIRTPLNGIIGMSDILTETDLTPVQSEYVETIDTSSQTLLLLINDILDLSKIESGNLVIVPQESNVEEVAYDTLTVILSKATEKGLALQVDIANDLPELVMLDEHRLRQVLMNLMSNAVKFTQDGAVILSINYQQKENGRGLLFFSVKDTGIGISKDKCEQIFEPFTQEDSSITRQFGGTGLGLAICRQLVEMLGGELKVDSEKGFGSKFHFILDVEVIEPTHKGLEEYAQSSCVIVSNHMLYATQLEMECKKLGINSRIVQKFVPQDDLISQSDVVIYCQKSSSEALNHVRLMNEYKHRPAIIICKKHQDEKVDFERTIEGVITYPLLGKRFYKVMKQAFIASQSHQGIVSEVKTSGDSEYGEMIDLPHKRKDNLDIIKTVLVVEDNAINQKVASLLLKKAGFCVEIANNGQEALDMVMSKTSPYSLVLMDCMMPIMDGFAATEAIRKWEENQEQKRLPIIALTASVFIEDIDKCYQSGMDDYVAKPFRKELILEKLEAYT

SEQ ID NO: 7658 - protein, 219 aa, Triticum aestivum
VTLQNKFVQKSRLVPVRNSRDIVDPRVRKEEEQITNISRNETLSRLPVRLSTNRITELVQLRDISRPVILAGSKASVTQAMQRAERYRTDLLKRGVLLIPVIFGASLKVQGKPKGFGTTRSAASAPSIGGDFEKRTESIAAKSRLRAEVRFKADIVSPEQWESLIRDQQESEGVTPGEDVYIILRLDGRVRRSGRGMPNWNDILKELPRLEDLLSKLER

SEQ ID NO: 7659 - protein, 347 aa, Musa acuminata
HVHELEPVEVVADQVAVALSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVQVKDTGCGISSQDLPHLFTKFAHGRNVASRGFSGSGLGLAICKRYVSLVQGHIWLESEGIGKGCMATFVVKLGICENPDGSQQKIVLLPWTKHGQEDTSSSRGMPKDPKAFIPLKPRYQRSV

SEQ ID NO: 7660 - protein, 222 aa, Fulvimarina pelagi
MYILDMFAKKTKMVDPAEALKGRSTAMPVPETHFVNGAPLKGPFPDGLKQAVFGMGCFWGIERKFWQLDGVYSTAVGYLGGYTPNPTYQEVCTGQTGHNEVVLVVYDPEKITYRELLKTFWEGHDPTQGMRQGNDMGTQYRSGIYTFDDEQRELAEETKAAYQGALKEAGHTGTISTEIKPAEEFYYAEDYHQQYLAKNPRGYCGVGGTGVSCPVGAGVAAE

SEQ ID NO: 7661 - protein, 477 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGIARPTFSEIIIRLDKIYAQCMKQGTWKDSLKIWK

SEQ ID NO: 7662 - protein, 349 aa, Nicotiana tabacum
MALVPTPAVNEGPLFAEVDMGDNSSTPTVRATVVQASTIFYDTPATLVKAERLLAEAASYGAQLVVFPEAFIGGYPRGSTFGVSIGNRTAKGKEEFRKYHASAIDVPGPEVDRLAAMAGKYKVYLVMGVIERDGYTLYCTVLFFDSQGHFLGKHRKIMPTALERIIWGFGDGSTIPVYDTPLGKIGAAICWENRMPLLRTAMYAKGIEIYCAPTADSRDVWQASMTHIALEGGCFVLSANQFCRRKDYPPPPEYVFSGTEEDLTPDSIVCAGGSVIISPSGAVLAGPNYVGEALISADLDLGEIARAKFDFDVVGHYARPEVLSLIVRDHAVSPVSFTSTSSKAESSPK

SEQ ID NO: 7663 - protein, 408 aa, Zea mays
  misc_feature (125)..(125): Xaa can be any naturally occurring amino acid
  misc_feature (179)..(179): Xaa can be any naturally occurring amino acid
  misc_feature (202)..(202): Xaa can be any naturally occurring amino acid
  misc_feature (272)..(272): Xaa can be any naturally occurring amino acid
MAAAAAVFFPSTPNPRHRLAAAARRPPPSFTGATDAVPLPEDEDSSDDDADDDGAPRRSGRRDRRRAVRVAWEKLVRWSRSWRRRNRSDVLETTRKVVVLGGGSFGTAMAAHVAAKKADLEVAMXLRDDHICRSINNAHVNCKYLSEHRLPENIVATTSAADALAGADFCFHAVPVQFXSFLESISTHVDPKLPFISLSKGXELNTLRTMSTIIPRALGNRRQPFVVLSGPSFAVELMNKLPTAMVVASKDNKLASSVQQLLASPNLRISTXAAGIVEGMSLGNNCMAALVAQGCSEIRWLATKMGAKPTTLSGLSGSGDIMLTCFVNLSRNRTVGLRLGSGEKLDRIMGSMNQVAEGVSTAGAVIALAQKYKVKMPVLTAVARIIDNELTPTKAVLELMNLPQVEEV

SEQ ID NO: 7664 - protein, 554 aa, Yersinia pestis
MCSIFGVLELKTDPIELRKKALEMSRLMRHRGPDWSGVWANDKAILAHERLSIVDVNTGAQPLYNAAHTHILAVNGEIYNHQALRQQYSDRYAFQTGSDCEVILALYQEKGPAFLDDLQGMFAFVLYDTEKDAYLIGRDHLGIIPLYMGHDEHGNMFVASEMKALVPVCRTIKEFPAGSYLWSQDGEIREYYHRDWFDYDHVKDNVTDKIQLANALEDAVKSHLMSDVPYGVLLSGGLDSSVISAITKKFAARRVEDNERSEAWWPQLHSFAVGLIGSPDLRAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKNFLDVAMRINPQDKMCGNGKMEKHILRECFESYLPHSVAWRQKEQFSDGVGYSWIDTLKEKAAEQVTDQQMETAHFRFPYNTPGSKEGYLYREIFEELFPLPSAAECVPGGPSVACSSAKAIEWDESFKNMDDPSGRAVGVHQDAYK

SEQ ID NO: 7665 - protein, 699 aa, Ostreococcus tauri
MALNARRPSRDHERTPNKFLPWLSNTPTLDGTLEKRQETEGWWASLFGGGTEQWGLRYFLLYDTHLFWGKGFSTMHGYGTVLSVREVPELGPTSFAVEMMAVPKRNLRRSFNDNVNFLDLISGLCCKPAGFRVMYLRATSPKEMQRWMEGFCRGTSDTPVSTRMPLDFSEEIPPSPRISTDSELSIDTFSGTGTRTRYEEPPPPLSPGGASREFLNTSPETEDVPLFRLDANGESGEFNHSTQQKSPVRTRSVLKSNSMLRNHEQRQSVDGNCSKSVTFDDHVESVVIARSPVKQQGIVPAQETDREFRTRTRLLKAAGSFKISESELQIGAKLGIGSFGVVYRAKWNDTDVAYKVMLQDKMNYETVNAFAEEIRMMRGLRHPNIVLFIGAVIQPNRLGIVSELMKRGNLEFLLHGNSTMGRQLRENGMLRRQMAADCARGMLYLHSLSRPVVHHDLKPANLVVDSNWTLKVSDFGMAQLKSYTYDSVSGAPGGTPEWMSPEALRGDKANERSDVYSFGVILWELMTVSFPWAELSSPVQIVAQVAFLHRRLKVPEWIEKPMADLLHSCWAREPEERPTFEKIVEQLAGEYPQAWSLGQVDKSADEQAANILAMMSTGKGAKNSAFAPRGLKPIRTPTPVTDVPKQTDTLDTEEDSSEDLSKRHGHDYRQRVPPETSPLKTPRAELPSALPTLSNGARD

SEQ ID NO: 7666 - protein, 435 aa, Chlamydomonas reinhardtii
MPCAAGSPGSHTGGCRYDSSLGMLTKKFLNLINTARDGILDLNQAAETLKVQKRRIYDITNVLEGVGLIEKKSKNNIRWKGAGDGGRGGDADPDLDRLRSDMSKLDERELDDNIRFMTSAIQALSENPLNKPRLYVTDEDVMGLPCFANDTIFAVKAPPGTTLEVPDPREAADPRDGQMRYRIVLRSTKGPIDVYLVQHTNNVGTTSQQGQQGGAGGGQQPSASAEPAGSTVGPAGAAGGAMSGGAMGAPAVAPAASGAAAAAAVGGAPAAAGPAGVAPAAAAAAAAPAAAAAAEPVPSAVKQEQQPPAVRAPVPGLAGQGVISPAAFHFMPQSGTPLSAMAGGASGHNFFAPMSPNAVDLAALAASFGGAGPGGALGRVSGLIPGGGPAGHGGLGGHGGVELDPGQWFDAPGDGAGGGAAAYFGADGDNFFAEL

SEQ ID NO: 7667 - protein, 516 aa, Unknown
  Magnetococcus sp. MC-1
MSHVKRVMITMPNTSWFGKRLWVVPPYTLGILAAVVDQQRFEVEALDPHLGNLSLEQSLQKILDFAPDVVALTCMSLEYAQSFHALARAIKERAPGITLLLGGVYVTTSVDLAMRDRVADYGVMGEGEHRFPLILDMLDRGETDFSQFDGIAYWEQERLQVNAPVAYVKPLDAVPFPDYEKMRLKEYFNVNNSFGNVMNARYEPYVLTSTSRGCPYDCIYCSTHSIDGSKVRLRSAENVLQEIDILYNDYGVKEILFLDDNLIINRKRFKQILQGLIDRDYDLWWKSLNLATFLLTEDMLEMMKAAKTYQLILPIESGNQYVLDHVLKKPLDLKKVPPLVKKGKELGFEISADFIIGSPGETWDQIRDTCTFADEMDVDMVSFHIATPLPKTEMYTRAMEMGALPDNFDFGDTNFFGFGRGAIATDEFQPQDLHMLRALEWDRINFKTPERRARFAKMSGISLEELAKWRKNTIRNLGLYFPNAEGKDYTDGAKKPAIPKNGLLDKNGRFMQVVNA

SEQ ID NO: 7668 - protein, 235 aa, Euglena longa
MFNDKIIKEMFFARLHLGHFSTKWNPKMKKYVFCKQNGKYIIDLIQTVYYLKKVCNFIKKLSIEGKKILFVSARMLIVDKLKHFANVTKSFYITEDWLGGTFTNWITTKGCIDKLNYYSVDGLKLYDSLTKRERLISRKQQSKLAKYYFGIKQMKKIPDVVFLIGQSDLKKAIGECLKLNVPTISILDTDCDPTMTNFFIPANDDSISSIFFILDFVKYYMLKGGKKISKRLVFN

SEQ ID NO: 7669 - protein, 429 aa, Prochlorococcus marinus
MTDRFLASINAALTDSDPAIAGLIDQERQRQETHLELIASENFTSQAVMQAQGSVLTNKYAEGLPHKRYYGGCEHVDAIEELAIERAQRLFGAAWANVQPHSGAQANFAVFLALLQPGDTIMGMDLSHGGHLTHGSPVNVSGKWFKVVHYGVERDSQQLDMEAVRQLALKERPQLIICGYSAYPRTIDFAAFRSIADEVGAYLLADMAHIAGLVAAGVHPSPIAHCDVVTTTTHKTLRGPRGGLILCRDADFGRKFDKAVFPGSQGGPLEHVIAAKAVALGEALQPEFQVYSCQVVANAQVLAGRIQERGIAVVSGGTDNHLVLLDLRSIGMTGKVADLLVSEVNITANKNTVPFDPESPFVTSGLRLGTAALTTRGFDDEAFREVADVIADRLLKPQDESIKAQCLERVRQLCGRFPLYRDVLQPALA

SEQ ID NO: 7670 - protein, 365 aa, Mannheimia succiniciproducens
MTQQPTLFIDRDGTLIDEPKTDFQIDSLEKLKFERNVIPALLKLKNRYRFVMVSNQDGLGTDSFPQEDFDKPHNAMLAVFRSQGIEFDDILICPHKPEDNCDCRKPKIKLLKKYIDKKLFDPADSFVIGDRPTDVQLAENLGIRALQYHPENLDWDMIAEKLLREPVADPKGLGQPRHAVVARKTKETDIKVEVWLDEAGVNQINTGIGFFDHMLDQIATHGGFRMNVSCKGDLHIDDHHTIEDVALALGAALKEAIGNKRGIQRFGFVLPMDECKAECALDLSGRPYFKFKAKFNRDKVGDFSTEMTEHFFQSIAYTLLATLHLSVKGDNAHHQIEALFKAFGRTLRQAIKIEGNEMPSSKGVL

SEQ ID NO: 7671 - protein, 624 aa, Thermosynechococcus elongatus
MGIFGWRTASLLKKAWQLYQQQHWSKAQQCARQVIEQTPQPEAYYLLGLIAEQLARPLEARTAYEQAIALDPWHAPSHYRLAVVLHALLQQPAAAVPHYQRALEVKPDWVEAHSNLGNAYLDLGDTEGAIACYQKALSLNPDLPTTLYNLGLCLHAQGKLTEATACYEQSLYLEPGQADVHNNLGSAYLELKNYTAATVHFQAALGANPELLVAHYNLGYALHLQGNLAAARDRYQEVLLRDNKHLRTLLQLGQICLAEEDLTGAIGYYQRCLSLDPLNSAAQAGLATALLESGDPQAALPYLRQAVALNPEAEDVRLKFALVLLMLEQFREGWQEYEWRWQQPTGGLRNYPQPRWQGQSLKGKTLFVYSEQGFRDCIQFVRLLPLMAKHAQRIIFEAYPPLVRLCQTLPGIEVMSTEETPPPFDYHTPLLSLPRYLGIDQDHFPKFKPYFPLPTRPPHPLFKVSKPRVGLVWASHSQTRTTVQRSCPLEYFLPLLQEFDVQWYSLQKERSPTEAEQLRQVGVIDCQPYMGDFLDTALLIQQLDAVVTIDTAVAHLAGALGKPLWILLPFVADWRWFWRRSRSPWYPSAELIRQPQRGDWPGAIAQLRSALQAHYRTRCNGIPN

SEQ ID NO: 7672 - protein, 134 aa, Listeria monocytogenes
MHIALIAHDEKKDLMVGFATAYKHLLEPHQLYATGTTGLRIIEATGLTVHRFKSGPLGGDQQIGARISENKMDLVIFLRDPLTAQPHEPDVTALIRLCDVYEIPLATNIGTAEILIRGLGAGFLDWRDLRRNDE

SEQ ID NO: 7673 - protein, 480 aa, Musa acuminata
RSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEKRLMIETVLKSSNLLAALINDVLDLSKLEDGSFELEIANFNLHAVFREVINLIKPIAAIKKLSVSVTLAPDLPLCAIGDEKRLMQTILNVAGNAVKFTKEGHISITASVARSDSSRDPRAPEFSPVTSDRHFDLRVQIKDTGCGISPQDLPHIFTKFAHSRNSANKASNGSGLGLAICRRFVSLMEGQIWLESEGIGKGCTATFIVKLGICDPSGNLQQILQTTPSHGDANLPGPRAKFDDENGKFTPMMRYQRSV

SEQ ID NO: 7674 - protein, 1065 aa, Bacillus thuringiensis
MDKKVSAIPQPKTYGPLGNLPLIDKDKPTLSFIKLAEEYGPIFQIQTLSDTIIVVSGHELVAEVCDETRFDKSIEGALAKVRAFAGDGLFTSETDEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDDVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKKHEIKKQVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKQSMWSDAMKAFGLELNKNMEKERSTLSLQFVSRLGGSPLARTYEAVYASILENRELQSSSSERSTRHIEISLPEGATYKEGDHLGVLPINNEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMKVGEAHLYFGCRHPEKDYLYRTELENDERDGLISLHTAFSRLEGHPKTYVQHVIKEDRIHLISLLDNGAHLYICGDGSKMAPDVEDTLCQAYQEIHEVSEQEARNWLDRLQEEGRYGKDVWAGI

SEQ ID NO: 7675 - protein, 72 aa, Carboxydothermus hydrogenoformans
MSKDDVIEVEGTVVEPLPNAMFRVELDNGHKVLAHVSGKIRMNFIRILPGDRVTVELSPYDLTRGRIIYRHK

SEQ ID NO: 7676 - protein, 143 aa, Oryza sativa
MLSTSTVFLFGPKQITLAETTGGTFREYIDTFDGYSFLYPKSWIQVRGAGADIFFRDPFFLDENMSVEISSPSSSKYMTVEDLGPPEKAAERVLQQYLTEFMSTRLGVRRTSNILSASSKVADDGKLYYEVEVNQTDYTNSHS

SEQ ID NO: 7677 - protein, 87 aa, Unknown
  Magnetococcus sp. MC-1
MCQNGAQGSFRGAPPLSKEDVIEMEGTVLENLPNAMFKVELENKHSLLCHISGRMRKNYIRILPGDKVTVQLTPYDLTKGRISYRHK

SEQ ID NO: 7678 - protein, 219 aa, Clostridium perfringens
MVSGTHYGNLQKVRGGKRTFGITPHIPGGFINPEQLEKIAKVTKKYNGVIKITSGQRLLITNLKGEDLPKIWDELGMEPAVKKQNSVKNVEMCPAGFCKRSKFNTIGTGMKLLNKYKHMDMPCRTKIGVAGCRNACGSVYSKDVGVIADKTGFLVTAGGSAGHNPRMADILIKDVDEKEALRIVDKIFEVYKGEAEAGEKLGDFIDRIGIEVFKEKTLV

SEQ ID NO: 7679 - protein, 220 aa, Capsicum annuum
MESEHEKSETPNFKRPLKKKCENAKRFTDEQVKLLESMFKLGTKIEPREKLQLARDLGLQPRQVAIWFQNKRARWKSKQLEHEYRILQSKFDHLNTQFESLKIEKERLLIELETLNDQLGNKLARGSKSQDSRDSELHTSPENGFTDLLELKHCAGCSNSRFGHKSVNEEDDETTEETDKYFTPKEEAEFWNLDELGDNNSLEHWCVGLGSISNSKLWDF

SEQ ID NO: 7680 - protein, 237 aa, Prochlorococcus marinus
MFLNWLNPKKVEAQGKTTSKHFVLNSLINKPANKDEEEIFFGCGCFWGAEKGFWKLPGVITTAVGYAGGAKKNPTYREVCSGRTNHAEVVRVIWNKLEIDLSDLLKMFWECHDPTQGNRQGNDSGSQYRSAIYLTKQDHKTLAINSLEKYQVLLQEKGFGSITTQIETNIDFYYAEDYHQQYLAKPGSRPYCSAMPTNVSLKDFKGSNYKLNSRVWDNFNWEQNHCVLRSSNSPIIN

SEQ ID NO: 7681 - protein, 99 aa, Porphyra purpurea
MADYKIHLLSEDEGIDVTFDCSEDTYILDAAEEAGIELPYSCRAGACSTCAGKVTEGSVDQSDQSFLDDEQLLKGYVLTCIAYPESDCTILTHVEQELY

SEQ ID NO: 7682 - protein, 218 aa, Rhodopseudomonas palustris
MFFMRKSTAMPSAAEALPGRPTPIPTARTHFVSGNRLQPPFPEGLQQAVFGLGCFWGAERKFWQLGDGVYSTAVGYAGGFTPNPTYEEVCSGRTGHTEVVLVVFDPARISYEALLKTFWESHDPTQGMRQGNDVGSQYRSAIYTFGDDQKRAAEASRVTYGDALKAKGYGPITTEIAASGPFYYAEDYHQQYLAKNPGGYCGLGGTGVSCPVGVRVTA

SEQ ID NO: 7683 - protein, 408 aa, Bifidobacterium longum
MVNMKNRFTFRIHRTVSGNTRFSNQSHSPFVWERRFTNATQQNPHNPSNEGLHMTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 7684 - protein, 135 aa, Janthinobacterium lividum
MRILHTMLRVGDLQRSIDFYTKVLGMKLLRTSDNPEYQYTLAFVGYGSNPDHAELELTYNYGTTSYDLGTAYGHIAISADDIVAACDAARANGGNVTREPGPVKGGNTVIAFITDPDGYKIELIERKFDGQGGGL

SEQ ID NO: 7685 - protein, 338 aa, Burkholderia thailandensis
MNLQKFPRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFKFDYVVVCSVTGSTQAGMVVGFAADGRADRVIGIDASAKPAQTREQILRIARNTADRVELGRDIASGDVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 7686 - protein, 470 aa, Magnetospirillum magnetotacticum
MTYPVVLVNVSRNTNAISFPMGLSVVANALLHHDITPQIIDLIPVMPDQRIDYFLRTMPKEPAIYGFSMMIGNFHLDHAEHYARLIKEHSPDSIVVYGGSLPSSVPELLVENCECDFVIHGEGEVVFPAFVKALREGESFPEGPGIFYKGADGQVVGTKAKRMRRLDHLSRQNYSLFDMDFYSGYFKEVGLSWEIMASRGCKAHCSFCYKFMGDGIGLREVGEVLDEIQYIMENYGITKFYFVDENFMQIKKYFYSFLEEKKNRGLNFTFIASSRIDEIDEERISIAKEHGLTALTTGVESVNQATLNAIDKRIDIEDAERAVKLLRQYGIRPHVNLIIGFEWESEDDYKAMLEFIERNDLRGTVKLSYLTPLPATRLYEDAKSRNKLGKPEFEYVRTLGNLYWELMVNMTNMPDELLKHYYALISDVGKETRALPVTPAYRQNLNDDLVMYKTVAAPSPPPAHAAWSLP

SEQ ID NO: 7687 - protein, 497 aa, Taxus wallichiana
MDSFIFLRSIGTKFGQLESSPAIISLTLAPILAIILLLLFRYNHRSSVKLPPGKLGFPLIGETIQLLRTLRSETPQKFFDDRLKKFGPVYMTSLIGHSTVVLCGPAGNKLALSNEDKLVEMEGPKSFMKLIGEDSIVAKRGEDHRILRTALARFLGAQALQNYLGRMSSEIGHHFNKKWKGKDEVKVLPLVRGLIFSIASTLFFDANDGHQQKQLHHLLETILVGSLSVPLDFPGTRYRKGLQARLKLDEILSSLIKRRRSDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEKFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 7688 - protein, 534 aa, Triticum aestivum
  misc_feature (318)..(318): Xaa can be any naturally occurring amino acid
GGGRSRTSGSPGLQEFGTRSTYPILHGSALFSRGDTQVLCTVTLGAPGDAQRLDSIVGPPTKRFMLHYSFPPFSINEVAKRGGLNRREVGHGTLAEKALLAVLPPEGDFPYTVRVNSEVMASDGSTSMASVCGGSMALMDAGIPVREHVAGVSVGLVSETDPTTGDISSYRILTDILGLEDHLGDMDFKIAGTRRGITAIQLDIKPAGIPLDIVCESLEPARKARNQILDRMDQEISSARAINDGSSPRLATLSFSSDSLRKLLFHRKKIEQDTGARVSVSDGTVTIVAKTQPIMDKAIEKVEFLVGREIEVGKTYKXGIVSSIKEYGAFVDFNGGQQGLLHISELSHEPVSKVTDIISVGQALSLTCIGQDVRGNIKLSLKANLPHSHQPEKELASEDATLLPNQDLVGWAAVENMPSKDADVNSSNSKDEDDTTEETPAFSTPTVIIRSAADCDAQDVANGPTKKRSKAASSKVAKPSPRASKPTKEQQEARKATPKKASTTSTAKKSKKEKADDSASNGLDKGKADDSASN

SEQ ID NO: 7689 - protein, 432 aa, Bradyrhizobium japonicum
MTSAKTASAPDSFFTASLDQADPEIAAAIKGELGRQRHEVELIASENIVSRAVLEAQGSVMTNKYAEGYPGALYYGGCEWVDVAENLAIDRAKKLFGAGFANVQPNSGSQMNQAVFLALLQPGDTFMGLDLAAGGHLTHGSPVNMSGKWFKAAHYTVRREDQIIDMDAVQKQAEEIKPKLIVAGGSAYSRAWDFKRFREIADSVGAYLLVDMAHFAGLVAGGVHASPVPYAHVTTTTTHKSLRGPRGGLILSNDETLAKKLNSAIFPGLQGGPLMHVIAAKAVAFGEALRPDFKVYAKNVVENAKALAEAMKSHGFDIVSGGTDNHLMLVDLRPKGLKGNVSEKALVRAAITCNKNGIPFDPEKPFVTSGLRLGTPAATTRGFGVAEFQQVGGMIAEVLNAIAQSDDGKAPLVEAAIKERVKALTDRFPIYQ

SEQ ID NO: 7690 - protein, 453 aa, Alkaliphilus metalliredigenes
MKVLLVRPARIKQAVTLGEFMYSEPIGLEMVYAMLENQHHVEIVDMMSEKITLEDKLKAFQPEVVGITSLCIDVFAVRALAEAVKKYDPSIITMVGGTQSFLNPEAFFTETIDHVMKYTNTENMTTLFGYLQRGEQPPIIHGICSGVNDFKTTDKCGMNQYVHPNRKATAKYRRQYSYFGYRPCAIMGTSQGCSKTCSFCLRWRIEGATERYLPMDFVKEEIRSIEEDNIMVFDNDFLHNGDRIEELCNFLQEEGIHKNFICYASVNSILSNKEVIKRFTKLGLSTVLVGYETFKEEELKKYQKKSSTDDNLNASQFLKEIGLDVWASFMIHPDWSVADFKEFRRYLKKLNPEISTFSPLTPFPNLPLYNEYKDRLLIQKEEYEKWSFGQVTINPSKMSLRKYYYEILKTILYVNLVRNNILYMISRFGITSILRLFKGSIKAFIKYIQLMMQ

SEQ ID NO: 7691 - protein, 329 aa, Bradyrhizobium japonicum
MTKYKLEYIWLDGYTPTPNLRGKTQIKEFASFPTLEHVPLWGFDGSSTQQAEGHSSDCVLKPVAVFPDAARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRPNSQGDPYQIVRRS

SEQ ID NO: 7692 - protein, 77 aa, Brassica napus
  misc_feature (7)..(7): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(61): Xaa can be any naturally occurring amino acid
EKEEVVXAYSMLSSAAVVTSPAQATMGAPFTGLKSSSAFPVTRKXNNDITSIXSNGGRXXXVPSIFASINLPSLPLP

SEQ ID NO: 7693 - protein, 1353 aa, Thermosynechococcus elongatus
MPAAPLPANEPERQRALEQYQVLDTPPEPIFDEITNLAAAICETPIALISLVDRQRQWFKSKVGIDACETPRNVAFCAHVILQDQLVIVPDARLDPRFADNPFVTGPPYIRFYAGMPLVTPQGYGIGTLCVVDYQPRQLNPVQQQTLRTLARQVINELEIRHHLEVTQQQLAYIQQMSSLQEAVFNSSNHAIIATRTDGIITLMNRAAQQWLGYPASELVGKATPERFHDPQEMERYAQILSAQLGEPIPAGFETLVARARRGLADEQEWTFVRRDGSCFPVSLSVTPMHDRQGQLIGFLESAVDITDKKQIEAALRLRERAIIASTNGIVITDYRQPDNPVIYVNPAFERMTGYRATEVIGKNCRFLQGSDRHQPGATAIRNAIKKGQSCRVVLRNYRKNGQLFWNELAISPIYNEFGEITHYIGIQSDVTERQRAQLFLQQQVKRTLLLNRITEEIRQQIEREHICRTAVQQVGVTLNVSRCLLFVYQENAPTPMELVAEYCGPGVPSVNECDLDLTQMRAPFLASVFASDEVFSCDDVQNDDRLAPLHAYCEALRVKSALIVRTAYRNQANGLLILHQCDRQRRWTDAIQSLLKSVAAQVGIGLAQVQLLEQETRQRQQLQQQMQRALLLNQITEQIRQSLDTETVFATTVTQIGQAFGVNRCLIHRYDPGPPPHIPDVAEYLQPGYASMRGISIPVENNPHALAVLSGDTAVVSNDVTQDPLLANAMHLCHQFQIQSMLAIRTSYKGVPNGIIGLHQCDRQRQWTPEEIELLEAVAAQVGIAIAQAELLRHEQQQRQLLAQQNQELEQARLQAELANRAKSEFLATMSHEIRTPMNAVLGFTNLLLDTPLNEQQRDFLQTLHQAGEALLTIINDILDFSKIESGKLVLEQQPFDVRECVEDVLSLLASKAQEKELELLYTCTPETPAQIKGDVTRLRQILVNLVGNGIKFTHEGQVAVHVGVLKREGKDFLQFQVQDTGIGIPRDRLDRLFKPFSQVDASTTREYGGTGLGLVISKRLCELMGGDMSVESTEGQGTTFTFTILAEGQKPYVPPKVHPALEGKRVLVIDDNAASRENLCTLLHNWGMVPIGYSDPRLVLEAAPPWDLAVIDLNMPQMTGLQLAERLQSEPNFNQQPMILLTPLSWLETASRKELITAHVPKPIRPLTLRQTLIRTLSSESATQPALTKTGIDLNLGNRFPLRILLAEDNAVNQKVALHILKRMGYRADVAANGLEVLEALQQRPYDVILMDVQMPKMDGLETTERICAQWPPSQRPWIIAMTANALAGDRERCFAAGMDDYISKPIKIEALAAALNRCRCLNPKSTYPQLCDQINIDSDQGHQSATESMT

SEQ ID NO: 7694 - protein, 315 aa, Oceanobacillus iheyensis
MSEEKMYDVIIAGAGPAGMTAAVYASRANLDTLMLERGIPGGQMANTEDVENYPGFDNILGPDLSNKMFEHAKKFGAAYAYGDIKEVEDHGEYKLIKAGSKEYYTRSLIIATGAQYKKLGIEGEEALSGRGVSYCAVCDGAFFKNRNLVVIGGGDSAVEEGIYLTRFANKVTIVHRRDNLRAQKIIQDRAFDNEKIDFIWDTVAETINGTDGKVSSVTLKNTKTNEVNNFDAEGVFIYIGMVPLNQAFLSLGITNDEGYIATNENMETSIPGIFAAGDIRDKELRQIVTATGDGSIAAEAAIKYVEDLEEKIKSK

SEQ ID NO: 7695 - protein, 194 aa, Glycine max
  misc_feature (27)..(27): Xaa can be any naturally occurring amino acid
  misc_feature (55)..(55): Xaa can be any naturally occurring amino acid
  misc_feature (117)..(117): Xaa can be any naturally occurring amino acid
  misc_feature (129)..(129): Xaa can be any naturally occurring amino acid
  misc_feature (166)..(166): Xaa can be any naturally occurring amino acid
DTSFILARDAIGDTYLFIAWRLNGSHXTPSYLNGDYDDCEHYESFPPGHLYSIKXRALLTIAQSLHGFCDAILLSHLMITLALRHAFEMAVVKRMMTDVPSAGSLSQGSYSTLSAVXLYLYLSGSRCSXQRASKLHSLCVCLEGAPDLMASLEVTYYIGTVHHEYXYSVQEGIYTIDDEIYHIYSSWVDTIRAS

SEQ ID NO: 7696 - protein, 417 aa, Gibberella zeae
MASLGAPSKKHKVTIVGSGNWGSTIAKIVAENTRAHKELFEEDVQMWVYEENVTIPKESKLYDEANGDAPQKLTEVINKHHENVKYLPGIPLPTNLIANPDIRDAVKDSSILVFNLPHQFIANVCKQINGHILPFARGISCIKGVNVTDTDISLFSEWIGDGLGIYCGALSGANLAREIAEEKWSETTIAYDPPALDNSRAPTPRSGSPNPTMGELPEAHHKDVRGRTSKTKLTAMPAEYPPLDQHCFRTLFHRPYFHVQMVSDVAGVSLSGALKNVVALAAGFVDGRGWGDNAKAAIMRVGLMEMVKFGKEFFGETVHTATFTESSAGVADLITSCSGGRNFRCAKMAVQKGISVQEVEKQELNGQKIQGTTTAEEVNSFLKARGLESEYPLFTAVNAILNGEAQVDDIPTLIQDS

SEQ ID NO: 7697 - protein, 261 aa, Spinacia oleracea
MAAATSATAIVNGFTSPFLSGGKKSSQSLLFVNSKVGAGVSTTSRKLVVVAAAAAPKKSWIPAVKGGGNFLDPEWLDGSLPGDFGFDPLGLGKDPAFLKWYREAELIHGRWAMLAVLGIFVGQAWTGIPWFEAGADPGAVAPFSFGTLLGTQLLLMGWVESKRWVDFFDPDSQSVEWATPWSRTAENFSNSTGEQGYPGGKFFDPLSLAGTISNGVYNPDTDKLERLKLAEIKHARLAMLAMLIFYFEAGQGKTPLGALGL

SEQ ID NO: 7698 - protein, 80 aa, Deinococcus radiodurans
MPEQREKKKKDESDSVRAEGVVEEALPNTTFRVKLDTGHDILAYISGKMRIHYIRILPGDRVVLEISPYDTSRGRIVYRR

SEQ ID NO: 7699 - protein, 517 aa, Unknown
  Saccharum hybrid cultivar
MARGDGELELSVGVRGAGAAAADHVAPISLGRLILAGMVAGGVQYGWALQLSLLTPYVQTLGLSHALTSFMWLCGPIAGLVVQPLVGLYSDRCTARWGRRRPFILTGCILISLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLKTNACCEACANLKGAFLVAVVFLVICLAVTLIFAKEVPYRGNENLPTKANGEVEAEPTGPLAVLKGFKNLPPGMPSVLLVTGLTWLSWFPFILYDTDWMGREIYHGDPKGSNAQISAFNEGVRVGAFGLLLNSIILGFSSFLIEPMCRKLGPRVVWVTSNFMVCVAMAATALISYWSLKDYHGYVQDAITASTNIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 7700 - protein, 258 aa, Prochlorococcus marinus
MLIQNTIFYKKEWRWSNFIKLLISQLAKYHCLEHEIPSAFSYKESTYGSSKSQNNVSLFTWGATHRERINFARAVCINSPSYSVLNFLIIPSTRFNIPFLGVDFVSLPKNHLLVLDFQPSLKVENQFNSELLDQLVKLKKSCHKSLPIAEKMSEEVSRFFSPGLIWSRLPKHKNSDYLIENQLYHSFKEYLVLYLNTLFTSEEVDQGLQQEIINGQNNYLNYRRNKDPARPMLSSLFGKDFTESLINKVLFSTNKVYN

SEQ ID NO: 7701 - protein, 1028 aa, Unknown
  Pseudoalteromonas sp. 22b
MTSLQHIINRRDWENPISVQVNQVKAHSPLNGFKSVDHARTNTQSQKQSLNGQWDFKLFDKPEAVDESLLSETLNSNWQSITVPSNWQLHGFDKPIYCNVKYPFAVNPPFVPSDNPTGCYRTEFNISESQLTQRNHIIFEGVNSAFHLWCNGQWVGYSQDSRLPSEFDLSELLVAGTNRIAVMVIRWSDGSYLEDQDMWWLSGIFRDVNLLTKPQNQIRDVFITPDLDACYRDATLHIKTAINAPNNYQIAVQVFDGEQALCEPQIQSTNNKRVDEKGGWSDVVFQAIDIQSPKKWTAETPYLYRCVVSLLDEQGNTIDVEAYNIGFRKVEMLNGQLCLNGRPLLIRGVNRHEHHPENGHTVTTADMIEDIKLMKQNNFNAVRTAHYPNHPRFYELCDQLGLYVVDEANIETHGMFPMGRLASDPQWAGAFMSRYTQMVERDKNHASIIIWSLGNECGHGANHDAMYGWSKSFDPSRPVQYEGGGANTTATDIICPMYARVDTDIKDDAVPKYSIKKWLSLPGETRPLILCEYAHAMGNSLGSFDDYWQAFREYPRLQGGFIWDWVDQGLSKTDENGKHYWAYGGDFGDELNDRQFCINGLLFPDRTPHPSLFEAKYSQQHLQFTLREQNQNQYTIDVFSDYVFRHTDNEKLIWQLMQNGICVEQGEHVLNIAPQSTHTLTIKTKTAFEQGAQYYLNLDVALVNDSHFANANHVMDSEQFKLINSSNLSSKLFVSSSEQNAISVSETDSQLSIENDKFKLVFSKQSGLIEQWLQNDTQVINSPLVDNFYRAPLDNDIGVSEVDNLDPNAWEARWLRAGIGQWQRTCSSIHAVQSSVDIRITCVFNYEFNGVLQAQTQWLYTLNNTGNISLNVEVHLNDTLPPMPRIGLSTTLNKQSDTKINWLGLGPFENYPDRKAAARLGYYSLSLNELHTPYIFPTDNGLRSDCQLLSINNLTVTGAFLFAASEYSQSTLTQAKHTNELIADDCVHVHIDHQHMGVGGDDSWSPSTHKEYLLEQKQYSYSLTFSAK

SEQ ID NO: 7702 - protein, 754 aa, Symbiobacterium thermophilum
MKFTRRSFVKASALATAMVAAGCSPQPVAPKQNPETEGATWYKTVCRYCGVGCGVMVAAKDNRVVAVKGDTENPVNKGLLCVKGYYLDRIMNTEEGRILKPLIRKNGQLTEASWDEALDLVAARFREAIDQHGPDSVGFYGSGQNLAEETYIANKLFKGCIGTNNVEGNPRTCMASAVAGFLSTFGKDEPMGNLDDIEHADTFFIIGSNTAEAHPIIYSRITTRKQTGKDVKVILADPRRHRVADIADIFLPFRPGTDLALLNAFAQVIIEEGLHDPDFIERHTTFQDGNGAITFEQYVAFLQDYTPEKVAPITGLSPDDIRAAAREIGARGRKTMTLWCMGINQRTVGTWLNNAIYNLHLLTGKICQPGNSPFSLTGQPSACGSVREGGGLSHLLPCGRQVTNEQHRKEVAAVWGVDYTRMSDKVGYHTMEMFRAAGDGRIKALLISCTNPGHSLPNLNSVRASLEKTFLVVMDAFHNRTTELADVVLPSALWCEKEGIYGNTERRTQHLAKAVEPKGEARPDVWILLEIAKRLGYGEYFSHYTSNEVIWEEFRKMGGGGTGYDYAPYERYKQERGLRWPVNDKQPAGTTLRYVEGDDPFVPEGAGIYFYGKPDGKAVIYARPHRDPAEVPDAEYPFYLSTGRILEHWHTITMTKRVPEIMKGAGEFYCEIHEEDAARLGIQNGDLVKLTSRRGQVVATARVGGRAVPQKGLVFLLMHDDRTERLANFLTNDAVDETSKQMEYKVCAVRVEKA

SEQ ID NO: 7703 - protein, 891 aa, Physcomitrella patens
MGVSVASPVLSNEVLGHHDADLLKTKLVSNGGFQPPKLLQEEMAPSSIIKSLTVVDTDEFDDDSTSEDEKVMEYVKEIPITDVDERDKGTSDDWIPRHPELVRLTGRHPFNCEPPLSTLMEAGFLTPTSLHYVRNHGAVPRASWDDWKVDVSGLVKRPMSLTMNDILRFRARELPVTLVCAGNRRKEENMVKQSIGFNWGAAAVSTSIWRGVLLCDVLRHCGVVSRKKGALYVCFEGAEILPGGGGSTYGTSITIETAMDEAQDVMLAYQQNGQYLEPDHGFPIRLIIPGYIGGRMVKWLNKIEVTSRESGNYYHFHDNRVLPSHVDAETAKAEGWWYRPDYIINQLNINSAISSPAHGETLPVNFSSLQEPYIVKGYAYSGGGRKVTRVEVSLDDGKSWTLCDVKHPEEPTRYGKYWCWCFWQIGVDVMDLLKCKEIVVRAWDAGMNTQPQHLIWNVMGMMNNCWFRVKVGISKFEDSGIHLAFEHPTRPGNQVGGWMTKSEVPQAAAPVLSKVVETKVTQLPVAVRQIPVSEVRKHQTEESCWIIVRNKVYDCTPFLNDHPGGADSILINGGMDSTEEFDAIHSAKAQTMLEEYYIGDLSASTAEVVDVAPKTEAEAIPTALSASGRPVALSLKERIAFRLIEREVLSHDVRRLRFALQSENHVLGLPVGKHVLLSASINGKLCMRAYTPTSNDDDVGYLELVIKVYFKDVHPKFPMGGMFSQHLDTLRVGDTIEAKGPVGHIVYEGKGQFLINGKPKFVRRVAMLAGGTGITPMYQVIRAIVSDPEDKTQVWLLYSNRTEEDIMLRKELDAWQEKHNNLVVRYTLTGTASEGWRFSKGRISEAMVKEHIPEGGEESLALLCGPQELIQEACIPCLLKHKYEKSACLEF

SEQ ID NO: 7704 - protein, 892 aa, Physcomitrella patens
MGISLDSPILSNSAVGKLDTDLQSKKMLPNGDVHSCKVLHEEVSSAFRGSPVKKILSISETEEFDDEESASEDEKVMGYAAEIPITKVDERDKGTSDDWIPRHPELVRLTGRHPFNCEPPLATLMEAGFLTPTSLHYVRNHGAVPRASWDDWKIEISGLVKRPTTFTMNDILRFPARELPVTLVCAGNRRKEENIVKQSIGFNWGAAAVSTSIWRGVRLCDILRHCGVVSRKKGALYVCFEGAEILPGGGGSTYGTSITIDTAMDKAQDVLLAYQQNGQCLEPDHGFPIRLIIPGYIGGRMVKWLNKIEVTTQESGNYYHFHDNRVLPSHVDAETAKAEGWWYRPDYIINQLNINSAITSPAHGEALPVNFSTLQESYIVKGYAYSGGGRKVTRVEVSLNDGKSWILCDLKHPEEPTRYGKYWCWCFWQINVDVLDLLKCKEIVVRAWDAAMNTQPQHLIWNVMGMMNNCWFRVKIGITKSEDNGIHLTFDHPTQPGNQTGGWMVKSEAQKPAEPLIKIIETKVAAPARQIKLSEVRKHQKADSCWIIVRNKVYDCTPFLDDHPGGADSILINGGTDSTEEFDAIHSAKAQAMLEEYYIGDLVASKDDLEVELVKDEKEDIAKLVSSSGRPVALNPRERLPFRLIEKETLSHDVRRLRFALQSENHVLGLPVGKHILLSATINGKFCMRAYTPISNDDDVGYFELVIKVYYKNAHSKFPMGGLFSQYLDSLRIGDTIDVKGPVGHIVYEGKGHFLINGKSKFVKKVSMLAGGTGITPMYQVIRAIVSDPEDQTQICLLYSNRNEGDIMLRKELDTWQQQHENLKVHFTLTGAAPEDWAFSKGRICEAMIKEHIPEGCEASLALLSGPQELIQSACLPSLLNHKFDKSICLEF

SEQ ID NO: 7705 - protein, 421 aa, Pseudomonas syringae
MTESVLDYMTRLGRAAREASRVIGRASTAQKNRALQATAAALDEARDELSAANALDLAYGQANGLEPAMLERLALTPARIDSMIVGLRQVASLADPVGAIRDMSYRPSGIQVGKMRVPLGVVGIIYESRPNVTIDAASLCLKSGNATILRGGSEAIHSNRAIAACIARGLAEAGLPAAVVQVVETTDRAAVGALITMPEYVDVIVPRGGKGLIERVSRDARVPVIKHLDGICHVYVSAHADLPKAQKIAFNAKTYRYGICGAMETLLVDQTIAADFLPAMAAQFREKGVELRGCERTRELIDVMPATEDDWHTEYLAAILSIRVVSGLDEAIEHINHYGSHHSDAIVSDHQSQIRRFMAEVDSSSVMVNAPTSFADGFEYGLGAEIGISTDKLHARGPVGLEGLTCEKYIVIGDGQLRGHA

SEQ ID NO: 7706 - protein, 112 aa, Brassica napus
  misc_feature (102)..(102): Xaa can be any naturally occurring amino acid
MPNLECRMYEQRFPEVDAAVMIQVKHIADMGAYVSLLEYNNIEGMILFSELSRRRIRSISSLIKVGRQEPAIVLRVDRDKGYIDLSKRRVSEEEAHACEDRXNKSKLVHSIM

SEQ ID NO: 7707 - protein, 267 aa, Unknown
  Thermotoga sp. SG1
MRVASVQMLPTIGGFEENLNKVERFVEEAVSNGVDVIVFPELTISGYTWDEKTLAKGVRFFEEVARKKLLKLSREGQIAIAVGTPRLVLGKLRNSLVIFKKKREILFYDKTHLFRGEKDVFEPGEYFLVFSYGGVVFGTLICYEIGFPEIARVLTLRGSKVILSSFAFGKERGHTYDIATRARAVENGVFIVASSMCGKGFVEFVGRTRIVAPSGKVLRELETDEGMIVEDIDPDIVYHYRYNEEGDSHAYLKNYRVNMYSLQKGRL

SEQ ID NO: 7708 - protein, 740 aa, Coffea canephora
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPVGFTVPIQLPVINQVFSTNRAVKISPNSPVAKLRPSGKYMQGEVVAVRVPLLHLSNFQINDWPELSTKRYALMVLMLPSDSARQWHVHELELVEVVADQVAVALSHAAILEESMRARDLLMDQNVALDLARREAETAVRARNDFLAVMNHEMRTPMHAIVALSSLLQETELTPEQRLMVETILKSSNLLATLINDVLDLSRLEDGSLQLDIEPFDLHGLFKEVINLIKPIASVKKLFVTLSMSSDLPEYAIGGEKRLMQIMLNVVGNAVKFSREGGISISASVAKSDSLRDPRAPDFFPGLSDNHFYLRVQVKDTGSGISPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 7709 - protein, 740 aa, Coffea liberica
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLALEECALWMPTRSGVELQLSYTLRHQNPVGFTVPIQLPVINQVFSTNRAVKISPNSPVAKLRPSGKYMQGEVVAVRVPLLHLSNFQINDWPELSTKRYALMVLMLPSDSARQWRVHELELVEVVADQVAVALSHAAILEESMRARDLLMEQNVALDRARREAETAVRARNDFLAVMNHEMRTPMHAIIALSSLLQETELTPEQRLMVETILKSSNLLATLINDVLDLSRLEDGSLQLDIEPFDLHGLFKEVLNLIKPIASVKKLFVTLSMSSDLPEYAIGDEKRLMQIMLNVVGNAVKFSREGGISISASVAKSDSLRDPRAPDFFPVLSDNHFYLRVQVKDTGSGISPQDIPKLFTKFAQSQSLAAKNSGGSGLGLAICKRFVNRMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 7710 - protein, 740 aa, Coffea pseudozanguebariae
MESCNCIEPQWPADELLMRYQYISDFFIALAYFSIPLELIYFVKKSAVFPYRWVLVQFGAFIVLCGATHLINLWTFTMHSRTVAIVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPFGFTVPIQLPVINQVFSTNCAVKISPNSPVAKLRPSGKYMQGEVVAVRVPLLHLSNFQINDWPELSTKRYALMVLMLPSDSARQWHVHELELVEVVADQVAVALSHAAILEESTRAGDLLMEQNVALDLARREAETAVRARNDFLAVMNHEMRTPMHAIIALSSLLQETELTPEQRLMVETILKSSNLLATLINDVLDLSRLEDGSLQLDIEPFDLHGLFKEVLNLIKPIASVKKLFVTLSMSSDLPEYAIGDEKRLMQIMLNVVGNAVKFSREGGISISASVAKSDSLRDPRAPDFSPMHSDNHFYLRVQVKDTGSGIMPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTRGLLVHLGCDVATVSSGDECLKVVNNEHKVVFMDVSIPGIDIYAVAVRIHEKFAKRRDRPLIVALTGNTDRVTKESCMRVGMDGVILKPVSVDKMRSVLTELLDHGVLLEAQ

SEQ ID NO: 7711 - protein, 99 aa, Prochlorococcus marinus
MASYKVTLVNANEGLNSTIEVPDDQYILDAAEEQGIDLPYSCRAGACSTCAGKITAGSVDQSDQSFLDDDQLEAGFVLTCVAYPTSDVTITTHAEEELY

SEQ ID NO: 7712 - protein, 391 aa, Triticum aestivum
MAAPTSAIGFEGYEKRLDITFSEASIFADPHGRGLRALSRAQIDSVLDLARCTIVSELSNKDFDSYVLSESSLFIYSQKIVIKTCGTTMLLLTIPRILELAEELCMSLAAVKYSRGMFIFPGAQPAPHRSFSEEVDVLNRYFGHLKSGGNAYVIGDPAKPGQKWHIYYATEQPEQPMVTLEMCMTGLDKKKASVFFKTSADGHVSCAKEMTKLSGISDIIPEMEVCDFDFEPCGYSMNAINGSAFSTIHVTPEDGFSYASYEVMGMDASALAYGDIVKRVLRCFGPSEFSVAVTIFGGRGHAATWGKKLDAEAYDCNNVVEQELPCGGVLIYQSFAANEEVAVSAGSPRSVFHCFEAETVESHPLVKEGKLANLLAWRAEDSLEEGVVLCE

SEQ ID NO: 7713 - protein, 946 aa, Candida albicans
MISIVNGTSTLSLVAGSVETLNQAINFYTNILGLSVHSEQNDWTYLSNDDNKMIVKIQLDTKSGLSLDQVNDRRTEIIAKLNVTDWRSLDTTSVLKVQNLVALIETLTTFNYTLQITPNELYPNEVYCVGPIGYIIGFTACDEPLTLVPPLQKSHPKPGLVSNLMSKSGSQSRNIEETKAVRRNIAVMTSGGDSQGMNAAVRAVVRATIFHGSKAFAVQEGYAGLVKGGPEYIKEMKWQDVRGFLSEGGTNIGTARCMEFKERWGRLKGCKNLIDAGIDGLIVCGGDGSLTGADLFRHEWPSLIQELKDKGEITNEQFERHKHLYICGMVGSIDNDMAMTDATIGGYSALERICRAIDYIDATANSHSRAFVVEVMGRHCGWLALMAGIATSADYIFIPEKPASSKDWQDQMCDIVGKHRAQGKRKTIVIVAEGAITSDLKPITSDEVKDVLVDRLGLDTRITVLGHVQRGGTAVAFDRTLATLQGVEAVKAILELTPDVPSPLIAIDENKICRRPLVEAVRITKSVASAIEAKDFEKAMSLRDHEFKEHLANFMAMNTANHEKPTLPREKRKKIAIINIGAPAGGMNSAVYAMATYCMSRGHTPYAIHNGFAGLSRHESVKSIEWIDIEGWNSIGGSEIGTNRQTPEETDIGMIAHYFEKYQFDGLIIVGGFEAFVSLEQLERSRAMYPSFRIPMVLIPATISNNVPGTEYSLGADTCLNSLMEYCDIVKQSASATRGTAFIIDVQGGNSGYIATFASLISGAQASYVPEEGISLQQLEMDINSLREAFAVEQGMTKSGKLIIKSSNASKVLTPHTLADIFNDECHGDFDTKTAIPGHVQQGGLPSPIDRSRGDRFAIRAVQFIEDHCDVLAPYRYELDFPIDDKKILNTAAVLGIKSSRLRFTSIRHLFDFETELGRRMPKTIYWNTIRDISDQLVGRTRLDKP

SEQ ID NO: 7714 - protein, 327 aa, Alkaliphilus metalliredigenes
MTIPKSLKLANLPTKIEKLERLSKSLGDINIYIKRDDQTGTEVSGNKVRKLEFAVQEALDQGCDYLITCGGIQSNHARATAAVAAKLDINSYLVLRSNGDDPVEGNYFLNKILGAEICLITPEEYRDNRMKVMEEIQRELAGQGHKAYILPEGASNGIGTFGYYQAMEEILEQEAELDVKFDAIVTAVGSGGTYAGLFYANKLRKNEAKIYGINVCDDADHFKNRVQELVHESIQYTKRPIHFKKEDIHMIDGYVGEGYAQSRQEELTFILDFAKLEGIILDPVYTGKAMYGLVEEIKKGSFNGFKNILFIHTGGLYGLFPKGNQLF

SEQ ID NO: 7715 - protein, 740 aa, Coffea canephora
MESCNCIEPQWPADELLMRYQYISDFFIALAYFSIPLELIYFVKKSAVFPYRWVLVQFGAFIVLCGATHLINLWTFTMHSRTVAVVMTAAKVLTAAVSCATALMLVHIIPDLLSVKTRELFLKNKAAELDREMGLIRTQEETGRHVRMLTHEIRSTLDRHTILKTTLVELGRTLGLEECALWMPTRSGVELQLSYTLHHQNPVGFTVPIQLPVINQVFSTNRAVKISPNSPVAKLRPSGKYMQGEVVAVRVPLLHLSNFQINDWPELSTKRYALMVLMLPSDSARQWHVHELELVEVVADQVAVALSHAAILEESMRARDLLMDQNVALDLARREAETAVRARNDFLAVMNHEMRTPMHAIIALSSLLQETELTPEQRLMVETILKSSNLLATLINDVLDLSRLEDGSLQLDIEPFDLHGLFKEVINLIKPIASVKKLFVTLSMSSDLPEYAIGDEKRLMQIMLNVVGNAVKFSREGGISISASVAKSDSLRDPRAPDFFPVLSDNHFYLRVQVKDTGSGISPQDIPKLFTKFAQSQSLAAKNSGGSGLGLAICKRFVNLMDGHIWLESEGLGKGCTAIFMVKLGLRGRSNEAKLQYVSRAPVNHVRTNFTGLKVIVMDDNGVSRMVTKGLLVHLGCDVATVSSGDECLKVVNNEHKVVFMDVSIPGIDIYAVAVRIHEKFARRRDRPLIVALTGNTDRVTKESCMRVGMDGVILKPVSVDKMRSVLSELLDHGVLLEAQ

SEQ ID NO: 7716 - protein, 300 aa, Herminiimonas arsenicoxydans
MQYLTIEDTIGNTPLVQLKRMDGEESARRNNVILGKLEGNNPAGSVKDRPALSMIKHAEERGTIKPGDTLIEATSGNTGIALAMVAAMRGYKMILLMPENLSEERRQAMAAYGAKIVLTPKAGGMEYARDLAEQMQKNGEGLILDQFANPDNPRSHYETTGPEIWRDTGGKITHFISAMGTTGTIIGVSEYLKEKNPDIRIIGVQPEEGSQIPGIRKWPEAYLPKIYDASKVDQLEYVSQGVAERMARRLAMEEGIFCGISAAGACEVALRISQTTENATIVFVVCDRGDRYLSTGVFPA

SEQ ID NO: 7717 - protein, 215 aa, Pseudomonas aeruginosa
MVLRSEILTKKSELPTPDQALPGRESAMPVPEAHFVNGRPLTAPFPAGLQQVLFGMGCFWGAERRLWQQPGVWVTAVGYAGGYTPNPTYDEVCSGLTGHSEVVLVVYNPQETSFEQLLKVFWEAHDPTQGMRQGGDIGTQYRSVIYTFDAAQKAAAMASRENFQAELAKAGYDRITTEIADVPPFYYAEAYHQQYLAKNPNGYCGLGGTGVCLPA

SEQ ID NO: 7718 - protein, 987 aa, Candida albicans
MPSSSDAINRISYISLVTSDNDKFNQTFQFYSQLGFRLTKSFSKVSSYGSGLGANHPEFQLGVSHDSLKEVWLESYPLQNVDSNGNLRPWQEMEVYDGDNCERLNESTVIKVRLLGETPLKSISQKQFVFFTTQLNKIEKILTDANVKYGKVVDNVILAEDPLNNIISFSNTQNELCKTRFQSPEEYVEKTTAEILAKRKKSQLGSKFGSFEEISPSEVGGGNGLRKKKIGVMTSGGDAPGMNPAVRAVVRAGIYYGCDVYAVYEGYEGLVKGGDLLKKMEWSDVRSYMSLGGTSIGTARCKEFRERAGRLQGAYNMIKNGIDALVVCGGDGSLTGADLFRSEWPSLVKELVDTGKLTKEEVSPYEHLTIVGLVGSIDNDMSGTDVTIGAFSALERITEMVDYIGATAASHSRAFVVEVMGRHCGWLALLSGLATGADFVFIPERPPKAGLWKEQLKEVCLRHREYGRRKTTVIVAEGAIDDELNPITSEEVKQVLADLGLDTRNTILGHVQRGGTAVAFDRRLATLQGVEAVKAVLEMTPDTPSPMIGILKHKIVRIPLVDAVKQTKAVAEAISNKDFDKAMSLRDNSFYDDYRYFRDISIYDDGSKQLSEDKRLNIAIVHVGAASAGLNAATRAVALYSLSRGHKLYAVQDGFAGLVKGDLKNLTWMDVEGWHSLGGSEIGTNRSLPSQNIGKVAYNLQKFNIQGLLIVGGFEAFTSLHELSEQKANYPIFEIPMVVVPATVSNNVPGTEYSLGADTCLNQLVSYCDAVQQSASSTRRRVFVVEVQGGHSGYVASYCGLITGALATYTPESNINLRELQGDIDLLQKVFATDRGEDHNGTLIVRNEQASAVYSTQLIADILKENANKRFETRTAIPGHVQQGFTPSANDRVMAVKFSLKAMEFIETRNGCYGKHDRKFSDEEISEHSQVVIGIHGDVVKFTCIKHLYDNEANVALRKGKTVHWTDMIDVANILNGKSLLKKQERY

SEQ ID NO: 7719 - protein, 413 aa, Burkholderia thailandensis
MSTTDPYLIAGGGHAARRAAETLRERDPAARIVMIGEEPELPYDRPALSKEALVGGDEGERRAFVRDAAWYRERGVELRLGVRVEAIERGTQRVRLSDGASLGYARLLIATGSRVRRFRGPVDAGVPIHYVRTVADARALRAALAPGRRVAVLGGGFIGLEVAASAVRLGCRATIVDPAPRLLQRGMPEVVGAFALALHARHGVDVRLGALPERIRRGANGAAVVETSAGDIAADVVVAGIGVVPNVELAQAAGLHVDDGISVDERCRTADAAIFAAGEVTRHFNPLVGRRLRIESWQVAEHQPAVAAANILGGHDTYEEWPWLWSDQHDCNLQTLGVFDGEQTLVLRGSPELDRAFCVFALNARRELRAVAAVNAGREIAACRRLMTANVALDPARLADPTVALRSMLRDGA

SEQ ID NO: 7720 - protein, 530 aa, Leptospira interrogans
MILVNFENEKEISLSKPQNLLEISLNNGIPHTHACGGNARCSTCRVLVLENPSHLSPPEQKEKELSQKKGFPKSVRLACQTTVLGDVRVRRIVLDEEDYNLTIPGSATISGEEKEIAILFSDIRDFTLFSESHLPYDVIHILNRYFYKMGDVILKHGGKIDKYIGDGLMALFGVNGGSPQEICISALRAAKEMELELYSLNEYLKSHLHTSFRIGVGVHYGNCILGQLGHPANMSYTAIGDSVNIASRIESKTKKSGASVLISESLYKQVKEKVVKGRVFSAQLKGKTGNYKLYEIQEILEKVDANLWEEAKNSLRRIILVREVGSWLKLVYHLSCLFDENQNWIGLSAANSFQKFSKLPENGDLVQNFYQIKDTFNEQFQNSFSFADLLALAGAVAIEKSGGPKIPIQPGRKDRLLSEVFQILPLSMQTQKDQLPYLQKMKLGIRDIVLISGARTIGWLGGESFTSNPYNFDNSYFHVLLKAGLEGPLLIPNDRELLKNDESRAFVLDYALDPSKFFEDFTSTYLKLTS

SEQ ID NO: 7721 - protein, 833 aa, Physcomitrella patens
MDSSGKYVRYTNEQVEALERVYHECPKPSSIRRHQLIKECPILANIEPKQIKVWFQNRRCREKQRKEATRLVSVNAKLTALNKLLMEENERLAKHASQLTLDNHALRQQLPNLPVPDGKCRLSGQAGVASTDTSCDSAVTGGLPQHLTSQHSSPDASPAGLLSMAEETLTDFLAKATGTAVDWIQLPGMKPGPDAIGIIAISHGCVGIAARACGLAALDFSKVAEILKDRPGWSQDCRRMEVLGTLPTGNGGTIELLYTQMYAPTTLAPARDFCTLRYTTLLEDGNLVICERSLTGKHNGPTMPPVQSFIRAEMFPSGYLIRPCEGGGCIIHIVDHVEYEPWSVPEVLRPLYESPAVLAHKSTIAALRYLRRIAAEESGEIIIRNGQHPAVIRTLSQRLTKGFNDAVNGFGDDGWVPMESDGMDDVSVMLNATPKSMEGQIATDKLLFSLGGGILCAKASMLLQNVPPALLIRFLREHRSEWADHEIDANAATAFRGASNGHVSRGRMSHVQLPLPLAQFGEQGEFLEVVKLEGHSAVQHSVLSRDSFLLQLCSGIEEGAVGAGAQLVFAPIDAAVSEDIPLLPSGFRVIPVDSSVVDGIGLNRTLDLASTLEDHEAGLNGESKSNGSSSQVRSVLTIAFQFAYEVHTRETCAVMARQYVRTVVASVQRVAMALAPSRGQPRPALGNSDAISLARHILSSYRVQLGMDLVRPEVGGTEALFKVFWHHSDAIVCCAWKGTPEFVFANRAGLEMFETTSSSLQDLAWDKTLDEDSLKLSYATFTQVLQQGYCCLPSGVRISSTGRTVTYERALAWKVLDDDETTQCIAFLFMNWS

SEQ ID NO: 7722 - protein, 446 aa, Brassica napus
  misc_feature (216)..(216): Xaa can be any naturally occurring amino acid
MMFNEMCMCGNMDFFGELDFCPPPPQPEPVTEEDYTDEEIDVDELERRMWRDKMRLKRLKEQKDKSREGAVDAAKQRQSSQEQARRKKMSRAQDGILKYMLKMMEVCKAQGFVYGIIPENGKPVTGASDNLREWWKDNVRFDRNGPAAISKYQAENNIPGVRERSNHIGPTPYTWHELQDTTLRSLLSALMQHCDPPQRRFPLEKGVPPPWWPNGXEDWWPQLGLPKDQGPAPYKKPHDLKKAWKVGVLTAVIKHMFPDIAKIRKLVRQSKCLQDKMTAKESATWLAIINQEESLARELYPESCPPVSLSGGGSCSLLMNDCSQYDVDGLEKETRYEVEELKPEKVNFGMAANFPVKEEVPSEFMRKRKPNRDLNAMMDRTIFTCENTGCAHGDVSRGFLDRNSKDNHQFVCPHRDSGLPYGAPSRFHVSEVKAGWVGFSQPRPVK

SEQ ID NO: 7723 - protein, 161 aa, Ostreococcus tauri
MGSITSPKPRADSYDAIIVDSSDPIGPASVLFEEKFFRQIYRVLKPGGVLCSQAECAWLHLDLIVDLAKMCKEIFVNGSVQYGYTSIPTYPSGQIGFMLCCKPDEDGSTVDFTKPKRYPTPVEGSDLKPMRYYNAQVHAAAFVLPEFAREALEPHLVRGKE

SEQ ID NO: 7724 - protein, 393 aa, Magnetospirillum magnetotacticum
MELKRQHLIDPVVCIRCNTCEEACPVDAITHDGTNYVVSFDKCTGCRTCVSPCPTGAIDNWLLVDQPWSIDDQFGWDELPLGQTGPGPAEPAPLPPGEVSDLLAAATSTTGPSVPPPASASKPYFNLYSRDKPVTARVAGNMRITGEGAESDIHHVVLDFSHNAFPFLEGQSIGIVPPGVDAKGRAHNIRLYSIASPREGERSGCNNLALTVKRVAGGVGSNYVCDLKKGDEVSVAGPFGQAFLMPDDPHANIIMICTGTGSAPFRAFTERRRRNAADAPGKLMLFFGARTPEELPYFGPLMKLPKSLIDVNLAFSRVADQPKQYVQDKLRERADDLAALLASPQTHIFICGLKGMEQGSDEAFADICRLHGLDWAGLRPKMREEGRYHVETY

SEQ ID NO: 7725 - protein, 98 aa, Zea mays
  misc_feature (76)..(76): Xaa can be any naturally occurring amino acid
  misc_feature (78)..(78): Xaa can be any naturally occurring amino acid
  misc_feature (85)..(85): Xaa can be any naturally occurring amino acid
PTCSPLLLPVIPILLVRQGPLPHDGEARVPDAANRIKGWFMTYIDRDSEQAVKERLKRKRIKSDMADDERQERMIXRXIERAHKXLAKPNGGGAAEGE

SEQ ID NO: 7726 - protein, 253 aa, Gloeobacter violaceus
MTTLHPVQIIGAGPGDPDLITVRGQRLLALADTVFYAGSLVPEGLLDWCRPEAERIDTRSLTLEAILPDLLARVQTGRRVVRLHSGDPCLYGAVHEQMVALVEAEIEFEIVPGISAFQAAAATLKVELTVPGLVQTIILTRASGRTGIPAAEELAGLAAHRASLCLYLSAHHATECEERLLAHYPPETPVAVCYRLGWPDERIVRTRLGELARTTREEKLTRTTLYVISPALEAAPSRSRLYHPEHNHLFRAK

SEQ ID NO: 7727 - protein, 181 aa, Triticum aestivum
  misc_feature (139)..(139): Xaa can be any naturally occurring amino acid
  misc_feature (166)..(166): Xaa can be any naturally occurring amino acid
AVLAETGDSWFNCQKLKLPEGCGYEFQMQYGSIGWSVGALLGYAQGASEKRVIACIGDGSFQVTAQDVSTMLRCEQNSIIFLINNGGYTIEVEIHDGPYNVIKNWNYTALVEAIHNGEGKCWTAKVKCEEELTAAIEGXWGRKKDSLCFIEVIAHKDDTSKEFSSXGSRVSAANSRPPNPK

SEQ ID NO: 7728 - protein, 236 aa, Panax ginseng
MTKRYWNINLEEMMKAGVHFGHGTKKWNPKMAPYISAKRKGIHITNLTRTARFLLEACDLVFDAASRGKQFLIVGTKNKAANLVAWAAIKARCHYVNKKWLGGMLTNWSTTETRLHKFRDLRTEQKTGRLNRLPKRDAAMLKRQLSHLQTYLGGIKYMTGLPDIVIIVDQHEEYTALRECITLGIPTICLIDTNCDPDLADISIPANDDAISSIRLILNKLVFAICEGRSSYIRNP

SEQ ID NO: 7729 - protein, 106 aa, Carboxydothermus hydrogenoformans
MGIITLTDENFETEALKREGLIIVDFWAEWCGPCRMIAPILEEIAQEYEGKLTVGKLDVDSNPETPRRYGIMSIPTLLFIKNGEEVGRTVGFKHKNELMKIIIKNL

SEQ ID NO: 7730 - protein, 445 aa, Unknown
  Frankia sp. EAN1pec
MDEPLTVDGAELDVRKLGPCRIDSPLLPLLGARPTTQHYIDEGDKVLFDDTVSMISARKVPLDELPGFEPAGPRRKIYFDPSKTRVGIVTCGGLCPGLNNVIRGLVLELTNHYGVNRIFGFRHGYQGFIAKYGHSVVDLTPERVANIDEDGGTILGTSRGQQDPAEIVDCLSRMNINILFVIGGDGTLRGARAIAGIVAERGEKIAVVGIPKTIDNDIPYIDQSFGFQTAFAKAAESIRAAYAEATSAPGGVGIVRLMGRHSGFIACYAVLAKSDADVVLIPELPFTLEGERGLLAYIRQRVEKRGHAVVVVAEGAGQDLVAGLPESSDASGNRKLYDIGPELSRRITEDFAARGAELNLKYIDPSYHIRSVAANPYDNVYTIRLAHAAVHAAMSGRTEMVVGRWRRRFIHIPIALAVSQRNQVDPAGDLWMSVLEATGQPYRFG

SEQ ID NO: 7731 - protein, 320 aa, Cucumis melo
MEMDFPVINMNNLNGESRVSVLNQINDACENWGFFELVNHGISHELMDKVEKLTKEHYRKCMEQRFKEMVASKGLDSVETEINDTDWESTFFLRHLPVSNMSEIGDLDEEYKKVMKEFADELEKLAEEVLDLLCENLGLEKGYLKKVFYGSKGPNFGTKVSNYPPCPKPELIKGLRAHTDAGGLILLFQDDKVSGLHVLKDGKWVDVPPMHHSIVINLGDQLEVITNGKYKSVMHRVIAQEDGNRMSIASFYNPGNDAVIYPAPALVEGEQEKTKLYPKFVFDDYMKLYVGLKFQAKEPRFEAMKAMESTNLNMGPIATV

SEQ ID NO: 7732 - protein, 303 aa, Brassica napus
PRVRGRVGSEILAILLQNSTANQKRLGQMNGVDAVLEGVAMYKSRDPKTPDEEEMLENLFDVLCCLLMPLENKERFVNAEGVELMIIIMKQKKYAYGSAIRALDFAMTNYPPACERFVDVMGLKTAFAAFMGKIPLNKRIKRERYKEELEERVISLVASLFAGILRGSRRDRLLSKFVENEYEKIDRLMELYIRYSDRVRSEAERLDQLELDDLELDEDEKYNRKLESGLYSLQLVAVILGHIWCSEHSGMRARIELLLKQQKLSKDDVKEILQEYHDNLGDVEGAEEKERGQARIQLFISAM

SEQ ID NO: 7733 - protein, 120 aa, Cathaya argyrophylla
DSESSTEKTPLHLFGVYDGHGGSQVADFCKERLHGALIEELEAEMREGDRGEGECSWQRQWERAFVACFNKVDAEIGGVKPRNSRCGSGEEVGGSGNDESARADPAPAPAPADAVGSTAV

SEQ ID NO: 7734 - protein, 124 aa, Cathaya argyrophylla
GSESSTEKTPLHLFGVYDGHGGSQVADFCKERLHGALIEELEAEMREGDRGEGECSWQRQWERAFVACFNKVDAEIGGVKPRNSRCGSGEEVGGSGNDESARADPAPAPAPAPAPADAVGSTAV

SEQ ID NO: 7735 - protein, 408 aa, Arabidopsis thaliana
MGSLRRSTSNRSRKKGTAVKMNRMPSSLLPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 7736 - protein, 367 aa, Arabidopsis thaliana
MKGKKPSIEIATSNPSLPEDLVVSCLARVSRLYYPTLSLVSKSFRSLIASPDLYKTRSLLGRTESCLYLCLRYSPEDNPRWFTLCRKPNRRTLSKEKNESSGNLLVPIPIINSPPLEWSSIVAVGSHLYAINGPIEDAPCSNVSFLDCRSHTWLEAPSMRVAHTNSQLDGKMYLAGSSENVDSLNCIQVFSTKTQTWKPVPFQKRIFGVGDLEGKIYTICRTECGQGVTIKPKDLTCDVVGFCGEKDWSSVCMIGNIVYFYRPNGEFLWIYSGKGESARRNLKGLEGLPKFDDYASVKLVDYGGKLMVLWDTYVPESESKEKMIWCAEISLQKKCNNEEIWGTVEWFDAVLTVPEDCKFVRAIAATV

SEQ ID NO: 7737 - protein, 73 aa, Borrelia garinii
MNIKEEAIETEGIVKESLPNTMFRVELKNKHIVLAHLSGKMRKHFIKIVPGDKVKVELSPYDLTKGRIVYREK

SEQ ID NO: 7738 - protein, 859 aa, Aspergillus parasiticus
MATITEVRTDALVPTDLVLKTGQIKIQSEEISTKDLSDIPLPPPSKRPTEVLSVDKGTPDSHVPRDPRLIRLTGVHPFNVEPPLTDLYKEGFLTSPELFYVRNHGPVPHVKDEDIPHWEITIEGLVEKPLVLNFRQVLQQYDQITAPITLVCAGNRRKEQNIVRKTKGFSWGSAGLSTALFTGPLLADILRSGKPLRQAKYVCMEGADKLPNGHYGTLIKLNWALDPNRGIMLAHKMNGESLRPDHGRPLRAVVPGQIGGRSVKWLKRLILTDAPSDNWYHINDNRVLPTMVSPDMASNNRNWWHDERDAIYDLNTNSAVGYPQNNEVLNILEARAVIYCQRIAYAGGGRRVTRVEISLDKGKSWRLADIEYAEDKYRDFEGELFGGKVDMYWRETCFCWCFWSLSIAIPELENSDAILVRAMDEALGVQPRDMYWSVLGMMNNPWFRVTITKENGNLRFEHPTHPSMPTGWMERVKKAGGDPTNGNWGERHEGEEPTEPEPVQDINMKKDGPSRTISFEEFKENSCDEKPWFIVNGEVYDGQAFLEGHPGGRQSIISSAGQDVSEEFLAIHSETAKAMMPEYHIGTTDPEGLIALKDDASSSTDEIRPVFLQSRSWTKATLKERKDISWDTRIFSFKLEHEDQTLGLPVGQHLMIKVLDRSSNNEAIIRSYTPISETSQKGTVDLLVKVYFATATSAGGKMTMALDRLPLGSVVEYLGNGRVLISGKERHVRSFKMICGGTGITPILQVLRAVVQDHQDPTSCVVLNGNRQEEDILRRAELDGFMASDSRRCNIIHTLSKAPDSWTGRRGRISEELLKEYAAPEDESMVLICGPPAMEESARRILLAEGWKESDLHFF

SEQ ID NO: 7739 - protein, 145 aa, Camellia sinensis
LIVSVTQTPATFQGLRPTTKSPLSLTKSISTVKFTPKKRCNDAIKAELNTSLVISLSTGLSLFLGRFVFFNFQRENVAKQVPEQNGMTHFEAGDSRAKEYVSLLKSNDPVGFNIVDVLAWGSIGHIVAYYILATSSNGYDPKFFG

SEQ ID NO: 7740 - protein, 559 aa, Herminiimonas arsenicoxydans
MESFAALFEESLTRQDMRSGEVISAEVVRLDHNFVIVNAGLKSEAFIPIEEFKNDNGELEVNVGDFISVAIESLENGFGDTILSRDKAKRLASWLSLEKAMESGEIVIGTVNGKVKGGLTVLTNGIRAFLPGSLVDTRPVKDTTPFEGKTLEFKVIKLDRKRNNVVLSRRAVIEASMGEERQKLMETLKEGTVVTGIVKNITDYGAFVDLGGIDGLLHITDLAWRRVRHPSEVLTVGQEITAKVLKYDQEKNRVSLGVKQLGDDPWTGLSRRYPQGTRLFGKVTNLTDYGSFVEVEQGIEGLVHVSEMDWTNKNVAPNKVVQLGDEVEVMVLEIDEERRRISLGMKQCKANPWDDFAVTHKKGDKVRGAIKSITDFGVFIGLAGNIDGLVHLSDLSWTETGEEAVRRFKKGDELEAIVLAIDVERERVSLGVKQLEGDPFNNFAAMNDKGALVTGTVKSVEPKGAVIQLSEEVEGYLRASEISRDRVEDAGTHLKVGDTVEAMVINVDRKARGIQLSIKAKDNVETQEAMQKMSSDSNAASGTTSLGALLKAKLDNSKN

SEQ ID NO: 7741 - protein, 400 aa, Aspergillus parasiticus
MPLLEAPRNGPKVSNGVLSGVSHSQSFGIDTESHSDDPNRRQRIVVVGLGMVAISFLEKLVKQDSERRKYDIVVIGEEPHVAYNRVGLSSFFEHRNIEDLYLNPKEWYGSFKDRSFDYHLNTRVTDIFPDRKTVKTSTGDTIAYVLLVLATGSDAVLPTHTPGYDANGVFVYRTISDLERLIEFASKHQGETATTVGGGLLGLEAAKAMTDLEDFGKVKLIDRNKWVLARQLEADAGTLVTRKIRELGLDVLHQKRVAKIKTDDNNNVTGIVFEDGEEIDCCCVCFRIGVRPRDELGTTAGIQCASRGGFVINESLQTSIPEIYAIGECASCANQTFGIIAPGIEMADVLAFNLTNPDKEPKSFRRPHLSTKLKLLGVDVASFGDFFADRDGPKFLPGRR

SEQ ID NO: 7742 - protein, 481 aa, Unknown
  marine gamma proteobacterium HTCC2080
MANASLYWFRHDLRLADLPGLIAAAKAGTVIPVFVWDEALGGDWSLGGASQWWLHHSLQSLAADLNGLGSRLILRRGETSKVIAKLLEETGAQNVFASRQYQPWAADTENAVKAVTESAGGDFKRYPGTLLFEPENIRTGGGTPFKVFTPFWRAALKQPAPPQPQPVPLLTSPDEWPQSDALNTWQLCPKTPNWATGWEELWSPGEAGASGALRTFLDSHVDSYGNGRDFPAQPNTSRLSPYLKFGEISPRQIWWTAQNTKQSNPDEGSSIDKFLSEIGWREFCNHLVAQFPAMPDKAWNPKFEYFPWQSHQRNLSAWQQGNTGYPIIDAGMRELWQTGFMHNRVRMVVASFLTKHLLMHWRVGEQWFWDCLLDADLASNACSWQWVGGSGADASPYFRIFNPIAQGEKFDKAGMYTRRWVPELAELPDKYLYKPWEAPELTLKAAGVELGTTYPNPIVDHRTARESALEAYATLKNIDAA

SEQ ID NO: 7743 - protein, 470 aa, Mannheimia succiniciproducens
MRVNFMNTQTSVSPPSIFSRNSLIFMADVIIFALLLAFLPFEQNVNKGLALLVFVGVLWLTEALNVTVTAVLVPLLAIGLGLVTTKNALVAFADPTIFLFFGGFALATALHIQKLDRLIANRIMALAKGNLFIAVLYLFSVTAFLSMWISNTATAAMMLPLAMGILSQLDREREHNTYTFVLLGIAYSASIGGMGTLVGSPPNAIVASQLHLTFSDWLWYGMPVMIILMPLMIGCMYVIFKPRLNIRFTQDFEKIEMTTPRIITLLIFILTAVLWVFSSSVNPMLSGLLGLPKDIASFDSVVALLAAALICISGVASWKQIQDNTEWGVLLLFGGGLTLSAVLKDSGASKVMADGIVFLIQGGHFYVIGLIVTAFIVFLTEFTSNTASAALLVPIFISIAQALGMPEMGLALLIGLGASCAFMLPVATPPNAIVFGTGEVKQSDMIRAGVVLNILCIFVIGTIGYLFWFG

SEQ ID NO: 7744 - protein, 233 aa, Oryza sativa
MAAEGELKLLGTWASPYVSRVKLALHLKGLSYEYVVEEDHFNNKSELLLSSNPVHKKVPVMIHNGKPICESLIIMEYLDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAVY

SEQ ID NO: 7745 - protein, 388 aa, Zea mays
  misc_feature (15)..(15): Xaa can be any naturally occurring amino acid
PCPTPARCPPPLTTXHEHTPLCRSCGAPTTSPTPAPWSGTTDSPPPAYRPIRLPAINAPTNTAAIVLSPVPQPLPVPPAAPPHAFLVPAKRITSPDDIARFHASVHGLHFLGFVAALSASVHGRKLSDPLPSPPSPAIAALLDLVSALAALVASTPPLPHSSRYGNPAFRLWHEKLTDSASELISRITATASSPADLAGADVELAPYLLDSFGNATRIDYGTGHETNFAAFLYCLARLGLITEPDYPAVVLRVFTAYLDLMRTLQDTYQLEPAGSHGVWGLDDYHFLPFVFGSAQLIDHKYMKPKSIHNPDILENFSKEYMYLACVAYVKKVKKGPFMEHSPMLDDISGVANWKKVNSGLLKMYKAEVLEKVPIMQHFLFGSLIKWED

SEQ ID NO: 7746 - protein, 352 aa, Chlamydomonas reinhardtii
MLCGCGGAKQVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPPFGERYLSSVLFQQLRDEASKMTFEPSA

SEQ ID NO: 7747 - protein, 341 aa, Unknown
  Magnetococcus sp. MC-1
MAVEYADNPSVAVIGAGSWGTALAALLAGKLPQVTLWAREPEVVEGINQGHHNPVYLADLDLPPNLVAHQDLAWVAANHDVLVMVVPTQFCRQVLAQLKPHVRPHVTFVSATKGVETANLALISEIFTQTFAAPIAQRTCYLSGPSFAREVIAGQPVAVAMAGADEAALAAMQALFFFPHFRTYSTSDVVGVELGGALKNIIAIAAGISDGLGYGAGARAALITRGLAEIARLGHIYGANPQTFAGLSGMGDLLMTASSTLSRNYTTGFRLGQGESLSHISGSSREVAEGVQTAASTWLLAQRHGVEMPITQAVHAILFEQVPPQQAVTQLLNRDMKREAV

SEQ ID NO: 7748 - protein, 195 aa, Alkaliphilus metalliredigenes
MTRSYRGDRRTKETDIELILNLDGKGQGKIATGIGFFDHMLEQIMKHGQLDLELKAVGDIEVDFHHTVEDVGILMGKAIAEALGDKKGIVRYATAFIPMDEALSMVSMDISGRPFLQYGVNYSGEFVGQFEVQLVEEFFRALAFNSGITLHIQTQYGRNNHHIVESIFKAFAKALREAITIDPRIEGVLSTKGSL

SEQ ID NO: 7749 - protein, 176 aa, Pseudomonas aeruginosa
MSFNTEVQPGICMEPDAITQEYVFNHTMLRVKDPKRSLDFYSRVLGMRLLRRLDFEEGRFSLYFLAMTRGEEVPDAVDERQRYTFGRQSVLELTHNWGSESDDSQYHNGNQDPRGFGHICFSVPDLVAACERFETLGVNFVKPLDRGMKNVAFISDPDGYWVEIVQASLNGEMGRG

SEQ ID NO: 7750 - protein, 507 aa, Prochlorococcus marinus
MISLAVSTVSDSPSTVSATSIDVPGGFDRDDWASGYCNVEQELNAVSLRPLRGQIPAELQGSHYRNGPGRFERDGQWVHHPFDGDGMITAVRFSDSKATLSNRFVRTKYWQEEEKAGRFLYRGVFGTQKRGGVKANAFDVRFKNIANTQVVQLGDQLLALWEAAGPHALDPVSLETHGLSSLNGVLKPGEAFSAHPRFDPGHHGDPRMVTFGVNTGPTSKIRLMEFATQGPDAGRLISDRTDSFKGFAFLHDFAITPNWTLFLQNAINFNPLPFVLGQKGAAQCLTSKPGGQAKFWLIPRDCGTFAGQPPRIFDAPDGFVFHHLNAWEEGDELVLESIYYSDYPSIDPGEDFLSMDFDFFPEGRLEQCRINLLGKGIETKRFSERCCEFAMVNPRREGLSARYAWMAVAERETGYAPLQAIKKLDLSNGDQCLWSAAPRGFVSEPLMVPRPGSEAEDDGWLLVFVWNGERRASQLLILNANDLSEQAVLEMPITIPYGLHGSWVAAD

SEQ ID NO: 7751 - protein, 209 aa, Prochlorococcus marinus
MGIMTSLRQGDVHRVTAETDVLVRVGLDGCGQCNVSTGVAFLDHMLHQLSSHGLLDLEITATGDTHIDDHHTNEDVGIAVGQALSQALGDRRGIHRFGHFVAPLDEALVQVVLDCSGRPHLSYGLQIPAERIGSYDSELVKEFFVAVVNNSGLTLHIRQLAGTNSHHIVEACFKAFARALRMAIEIDPRRAGAVPSSKGVLEQAGGQKS

SEQ ID NO: 7752 - protein, 338 aa, Listeria monocytogenes
MTQKKVAILGAGSWGTGLALVLADNNHKPVIWGNLDKIVNEINESHTNSHYLPDIILPTEVKATLSLDEAIDGAEIVVIAIPTNAMRIVCKQLNEALKEPTILVHVSKGIEPETNLRMSEVIEEEIDAAKRKALVVLSGPSHAEEVALRHPTTLCASCKDLSAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGREKKIEKESF

SEQ ID NO: 7753 - protein, 84 aa, Spirogyra maxima
MKKQNLVEMEGTITESLPNAMFRVCLDNGCYVLAHISGKIRRNYIRILIGDRVKVELSPYDLSKGRITYRLRIKSINDSNDLIK

SEQ ID NO: 7754 - protein, 381 aa, Listeria monocytogenes
MSEDLFDVEVRNFEEGDKVTGTVTSVEDKQVYVGIPGSKLDGVVPISELSNIHVETASDVVSVGDTLDLIVTKVEDDILVLSKRKVDAEKASDDIKAKFESGEVFEAVVSDVVKGGLVVDLGVRAFVPASLVEDHFVEDFADYKGTTLTFKVVEFEPENNRVILSHRAVVETEKASQKQALLSEIKEGDVIEGTVQRLANFGAFVDIGGVDGLVHISQISYKHIATPQEVLEEGQKVTVKVIGIDPENERISLSIKATLPGPWDGITEKAQVGSVLEGKVVRLVTFGAFVEIFPGVEGLVHISQISHEHIGTPQEVLSEGQTVEVKVLEVNEADKRLSLSIKELQDAPVEEADYELPEENTGFQMSDLIGDKLKGLQNDDK

SEQ ID NO: 7755 - protein, 122 aa, Cathaya argyrophylla
GSESSTEKTPLHLFGVYDGHGGSQVADFCKERLHGALIEELEAEMREGDRGEGECSWQRQWERAFVACFNKVDAEIGGVKPRNSRCGSGEEVGGSGNDESARADPAPAPAPAPADAVGSTAV

SEQ ID NO: 7756 - protein, 968 aa, Tropheryma whipplei
MHERHIGPSQEEIDHMLGFLGYKSLDDLMHAALPNGVQSPPDIKIPSHDELTCLTQLAAFAKMNRIKTSMLGQGFYNCITPAVIRRNILENPSWYTSYTPYQPEISQGRLEMLINFQTMICDLTGLEIANASMLDEASCAAEAMLLAKRVSRSSSNKYLVHNGVFPHIRRVLETRADAVGVEIVDLPEGQSIDFDHFGVYAQYQSASGKLLDLRPLFSRSKRAGAICVIGCDLLMLTLFTSPGELGADIAFGSAQRFGIPMNFGGPLASFLAARKAMERSLPGRLVGVSVDADSNHAYRLTLQTREQHIRREKATSNICTATVLMAIAAVAFAQHHGPKGLRAIAHRINTVAVGFARLLKQTAFRVSSLDIFDTIEINNPTQVCVEAESKYDLLFWKVDDNKLRITFDEVTARLDGDLPERLSKVFGISPDKIRDLGCNYDSCDCSFYGDLQQAREGLSSVASRNISVHSDLARHPLRRFSGYLKHPVFNNYTGEVALMRYLKALSDKDFALDRGMIPLGSCTMKLNAAFQLEPVLWPEFANLHPFAPLGDADGTLQIIDQIETWLANLSGYDAVSLQPTAGSQGELAGLLAIRGYYKSLNLDRDVCLIPASAHGTNAASAVLAGMRVVVVACDQQGNIDLDDLRLKASKNAHALAALMVTYPSTHGVYEDNISEVCSVVHKYGGQVYVDGANSNALIGYLRTGDFGGDVSHLNLHKTFGIPHGGGGPGIGPVVAKAHLAPFLPFRNRVHKPSTDLPAVKHMGGPIASSDYGFAGALYISWAYIFCLGSQGMKRCTAVAVLVANYIAKQLSDTFPVLYTGKNNLVAHEFIMDFREVTRVSGITVDDVCKRLIDYGFHAPTMSFPVPGTLMVEPTESEPFSEIQRFIKTIRSIRAEIDRVIDKTYDPDNNPLKRAPHTLEQIASDKWDRPYSRRTGIVYTSGKYWPASARIDNAYGDRNIFCTCPDLPD

SEQ ID NO: 7757 - protein, 449 aa, Haemophilus influenzae
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 7758 - protein, 122 aa, Cathaya argyrophylla
DSESSTEKTPLHLFGVYDGHGGSQVADFCKERLHGALIEELEAEMREGDRGEGECSWQRQWERAFVACFNKVDAEIGGVKPRNSRCGSGEEVGGSGNDESARADPAPAPAPAPADAVGSTAV

SEQ ID NO: 7759 - protein, 170 aa, Glycine max
MGLGTLPLTPSYSGFSSNSGLIHDTTNHRRVNRSMKFRVSAKQEKQEEKKKQSLFSSVTEALDFSQVRSAEDAQLIEEAREATKSGERMSREQYGALRRKIGGTYKDFFKSYVEVDGAYVEEGWVDKTCKVCKKDTKGEARQVDKFGRYVHVACLEKANTGNFFTRLFSR

SEQ ID NO: 7760 - protein, 169 aa, Capsicum chinense
MASQSNRPQSVYDFTVKDAKGKDVDLSIYKGKVLIIVNVASQCGLTNSNYTDMTELYRKYKDKGLEILAFPCNQFGGQEPGSIEDIQQMVCTRFKAEYPVFDKVDVNGDNAAPLYKFLKSSKGGFFGDGIKWNFSKFLIDKEGNVVDRYSPTTSPASMEKDIKKLLGVA

SEQ ID NO: 7761 - protein, 124 aa, Legionella pneumophila
MTEALFERLGGQNAVNTAVDIFYRKMLMDDRVNYFFDDVDMEQQILKQKGFLTMVFGGPNQYTGKSMREGHQHLLARGLNDSHVDIVIEHLGETLKELGANEEDIQKVAAIANSVRGDVLGRSS

SEQ ID NO: 7762 - protein, 331 aa, Mycobacterium smegmatis
MEAAVMGCGAWGTALAKVLADAGNPVTMWARRPEVADEINSEHRNSEYLGDVVLPASIRATSDPEEALRGACTVMLAVPSQKLRANLDNWKHLIEDDVTLVSLAKGIELGTLMRMSQVIVQVTGADPSRVGVVSGPNLASEIADEQPAATVIACSDSGRAVTLQRAMATGYFRPYTNPDVIGAEVGGACKNVIALACGMAVGVGLGENTVAALITRGLAEIMRLGIALGATPATLAGLAGVGDLVATCTSPHSRNRTFGERLGKGGTMESALAAAGGHVAEGVASCESVLALASSYGVEMPLTDAVHRVCHKGLSVHEAVALLLGRSTKPE

SEQ ID NO: 7763 - protein, 330 aa, Mycoplasma pulmonis
MAEKTLRKSNEDKQVKTENIYKIIPNSKFLEAGVYFGHRTQQWNPKMKKFIHSKRRGIHILDVSKTSKALEWAYKIINAAAAKGATFIFVGTKKHAKEIVKEQAQRTNSYYVTERWLGGTLTNSKTIFSRVRRLFDLEKMAENNFEGYTKKEGIEFKKELSKLQKNFEGIREMKTQPNFMIVVDPNVDRIAVKEARDKGVKIIGILDSDANPDFVDLGIPANDDSIKSISLILTVLADAIVNAKGGKDLFAYQDEANIILPEDKKIDSPQRSHFNNTRFDQSSSREHRDSWRRNSQNTSQNQEQSQRPYKRTYNKDSRETLDKKTKEEVK

SEQ ID NO: 7764 - protein, 206 aa, Prunus persica
HGTEVAVKILMEQDFHAERFKEFLREVTIMKRLRHPNIVLFMGAVTKPPNLSIVTEYLSRGSLYRLLHKPGATEALDEKRRLNMAYDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDL

SEQ ID NO: 7765 - protein, 322 aa, Paenibacillus macquariensis
MTIKKIAVLTSGGDSQGMNAAVRAVVRSGLFYGLEVYGIQRGYQGLLNDDIFSMDLRSVGDIIQRGGTVLQSARCKEFMTPEGQQKGADILRKRGIDGLVVIGGDGSYHGANKLSKLGINTMALPGTIDNDISYTDFTIGFDTSVSIVVDAINKLRDTMSSHERSSIVEVMGRHCGDIALYAGLASGAETIIVPEVPFDMDEIAERMKQNFAHGKRHSIVVVAEGAGNGENVAKQLVERCETLEPRVTVLGHIQRGGTPTPADRNLASRLGDFAVRMLIAGESAKACGIISNELVLTDIDKVVNSKKEFNMELYELAARLSQ

SEQ ID NO: 7766 - protein, 468 aa, Zea mays
TPSSRVGCCSANATYGRIRYTPPPPSRPSPSGQRSSIHPHPIIKPPNAPRVPRPPRRRRSRLLSPGEGAPRGAFPTADCRLTLRDRKRRRRRPAMAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 7767 - protein, 105 aa, Brassica napus
MEETTTFQGLRHLFMTVFLHGFSAFIVVPVITDVSMAALCPGKDECSLAIYLSGFQQAITGVGSLMMMPLVGSLSDKHGRKSLLTLPMALNILPLVFDVDVECSL

SEQ ID NO: 7768 - protein, 112 aa, Burkholderia pseudomallei
MKRITAIIKPFKLDEVREALAEVGLTGLTVTEVKGFGRQKGHTELYRGAEYVVDFLPKMKIEVVVANNLVDQVIDAVIGAARTGKIGDGKIFVSDVERVIRIRTGEENEAAV

SEQ ID NO: 7769 - protein, 644 aa, Unknown
  Streptomyces sp. 139
MCGIAGTYRWPDGKAVTDRLTETLAHRGPDGSGGYSHALGDGEVHLGHRRLAILDLSENGAQPMVSGGLALTYNGELYNAPELRAELEGAGVRFRGTSDTEVLLEAWRRWGTDCLPRLRGMFAFAVFDERTGDLVLVRDQLGIKPLFLLRRGKGLVFASELKALAAVTGGSLEVDPAALVASLLYYWVPDSRCAFRGAEKLPPGTWLRCRADGSVSAAGSGTCARSPPRAGAGTVRYLPDLAAVVEESTRRHLLSDVPVATFLSGGLDSSYLTALAARDRPGIPAYTIGFRAEDARFEAMPDDLRYARRVAERFGVDLREIEIAPDVLDLLPRMTYHLDEPVGDPAAINTFLICSAAREAGVKVMLSGMGADELFAGYRKHLANLIAVRYRHVPGPVRRGVASAVDRLPVATSRRGLRSVRFAKRFLSFAGLPEETAFRRSYTLYDRQELAGLLDPDLAPAVDDVLAEHADVYQDNELDDFVNRMCLADARMFLPGLNLAYTDRSSMAASTEVRVPYVDVEVVRAAFAVPGARKIAGRQGKAVLKEAATTVLPREIVYRPKGLFSAPLRAWMSRDLAPLVREVVNDGLLVRSGFLRREALARMVAEDAAGQRDFSKHLWHVLTLEYWYRDATSRAGRNSPTSTA

SEQ ID NO: 7770 - protein, 307 aa, Bacillus cereus
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSIERRNLLRAYGAELVLTPGPEGMGGAIRKATELAKENGYFIPQQFKNQSNPEIHRLTTGPEIVEQMGDQLDAFIAGIGTGGTITGAGEVLKEAYKDIKIYAVEPADSPVLSGGKPGPHKIQGIGAGFIPETLDVEVYDEIVQVKTEQAFEYARRVAKEEGILVGISSGAVIYAATEIAKKLGKGKKVLVIIPSNGERYLSTPLYQFES

SEQ ID NO: 7771 - protein, 1165 aa, Streptococcus pyogenes
MKKKVNQGSKRYQYLLKKWGIGFVIAATGTVMLGCIPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHIPLLTPKMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADSVKVVVYDKQDQTKVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKTRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQVGVTAIAKPKGVQFTKEGLTIDGLTALVLKVSSKTANPSQQKSQTDNHQTKTPDGSKDLDKSLMTRPKRAKTNQKLPKTGEAPSKGLLAAGVALLLLAISLLMKRQKD

SEQ ID NO: 7772 - protein, 461 aa, Burkholderia thailandensis
MVSDQDNDSLKRGLKNRHIQLIALGGAIGTGLFLGIAQTIQMAGPSVLLGYAIAGVVAFFIMRQLGEMVVDEPVAGSFSYFANKYCGHFTGFLSGWNYWVLYVLVSMAELSAVGIYVQYWWPGVPTWISALVFFVAINAVNLASVKSYGETEFWFSIIKVAAIVGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDVAANVLNVVVLTAALSVYNSCVYCNSRMLYGLAQQGNAPRALARVSRRGIPIAALGVSAFATALCVVINYFMPGKAFELLMGLVVSAIIINWAMISVIHLRFRQAKRASGETTRFKSLGYPLTNYLCLVFMAAILVVMFRTPDLRLSVYLIPVWLVVLALGYRFRQRGAGYALGEGVSAR

SEQ ID NO: 7773 - protein, 963 aa, Pseudoalteromonas tunicata
MSHAKSLDQLEQKQDFIRRHIGPDAAQTAAMLAELNVSSVEELISQTVPADIRLKQGLTVGESRTEVEALSYLKSVVSKNKLYKSYIGQGYHPTLVPNVILRNVLENPGWYTAYTPYQPEIAQGRLESLLNFQTLSIDLTGLDLASASLLDEATAAAEAMALAKRVAKAKKANAFFVADDVHTQTIDVIKTRAGQFGFDVVVAPAADVANHDIFGALFQYPSTTGEVVDIPALIATVQDKKAIACVAADIMSLILLKSPGSLGADVVLGSAQRFGVPMGYGGPHAAFFATRDEYKRSLPGRIIGISKDRLGNDALRMAMQTREQHIRREKANSNICTAQVLLANMAAFYAVYHGPQGLKVIAQRIHRFADILAAGLQAKGVSLKHSTWFDTLTVVAANKDEVVARALAAEINFATNHAGEYSISVNEETTRADIATLFDVILGAGHGLDVAALDAQITANGSDSIPAALVRDDAILTHPNFNSYHSETEMLRYIKRLENKDLSLNHSMISLGSCTMKLNATAEMIPVTWPEIANLHPFCPLDQAAGYQIMINELHDWLVNITGYDAVSMQPNSGAQGEYAGLIAIRKYHESRGDFHRNVCLIPSSAHGTNPATAQMASMKVVVVNCDKNGNVDMADLKAKAEEVSENLSCIMVTYPSTHGVYEATIRELCDVIHQHGGQVYMDGANMNAQVGVTSPGFIGSDVSHLNLHKTFCIPHGGGGPGVGPIGVKSHLAPFMPNHSVINVPGTTAGNGAVSAAPYGSAAILPISWAYITMMGSEGLKQATEMAIVNANYLTEKLSKHFPILYRGQNSRVAHECIVDLRPLKEATGITEMDVAKRLMDYGFHAPTMSFPVAGTLMIEPTESESKVEIDRFIEAMVSIKGEIDKVASGEWTVENNPLVFAPHTQADVLGNEWDRAYDRFYAAFPVPAVAKNKFWPTVTRIDDVYGDRNLVCACPPIDSYTE

SEQ ID NO: 7774 - protein, 274 aa, Aquifex aeolicus
MPVVSMKELLEAGVHFGHSKSRWNPKMAPYIYGVRHGIHIIDLNKTIVMLEDAYHFVSDVIAQGGEILFVGTKKQAKDIIKEEAERCGAFYVNERWVGGLLTNFQTVRKSIMKLQTLERMEEDGIFDVLPKKEVRNLRRKMEKLRKLYNGIRDMKKLPDVIWIVDTVREKIAVSEARKLGIPIVAIADSNCDPTVIDYTIPGNDDAIKSIKLLTSKIADAVLEGKQRRESAEEVVPTKERRPVEITERERQLFEQAVEMSEKYAELDKDSTEYE

SEQ ID NO: 7775 - protein, 1030 aa, Zea mays
  misc_feature (286)..(286): Xaa can be any naturally occurring amino acid
  misc_feature (579)..(579): Xaa can be any naturally occurring amino acid
  misc_feature (601)..(601): Xaa can be any naturally occurring amino acid
ARSSHCQGLPGPPGFAVAGKAVALGEAKASDGCGRFLRIRAREECAARSSAAPVAVLLLAAAGAAAAAGGAEGDGDGQALMAVKAGFRNAANALADWDGGRDHCAWRGVACDAASFAVVGLNLSNLNLGGEISPAIGQLKSLQFVDLKLNKLTGQIPDEIGDCVSLKYLDLSGNLLYGDIPFSISKLKQLEDLILKNNQLTGPIPSTLSQIPNLKTLDLAQNKLTGDIPRLIYWNEVLQYLGLRGNSLTGTLSPDMCQLTGLWYFDIGGNNLTGTIPEGIGNCTSXFEILDISYNQISGEIPYNIGYLQVPPLSLQGNRLIGKIPEVIGLMQALAVLDLSENELVGPIPPILGNLSYTGKLYLHGNKLTGHIPPELGNMSKLSYLQLNDNELVGTIPAELGKLTELFELNLANNNLEGHIPANISSCSALNKFNVYGNRLNGSIPAGFQKLESLTYLNLSSNSFKGQIPSELGHIVNLDTLDLSYNEFSGPVPPTIGDLEHLLELNLSKNHLTGSVPAEFGNLRSVQVIDMSSNNLSGYLPEELGQLQNLDSLILNNNSLAGEIPAQLANCFSLVSLNXVIQQLLWARPVIEKLLKVPNGXFMGNLMLHVYCQDSSCGHSHGTKVSISRTAVACMILGFVILLCIVLLAIYKTNQPQLPEKASDKPVQGPPKLVVLQMDMAVHTYEDIMRLTENLSEKYIIGYGASSTVYRCDLKSGKAIAVKRLYSQYNHSLREFETELETIGSIRHRNLVSLHGFSLSPHGNLLFYDYMENGSLWDLLHGPSKKVKLDWDTRLRIAVGAAQGLAYLHHDCNPRIVHRDVKSSNILLDGSFEAHLSDFGIAKCVPAAKSHASTYVLGTIGYIDPEYARTSRLNEKSDVYSFGVVLLELLTGRKAVDNESNLHQLILSKADDDTVMEAVDPEVSVTCTDMNLVRKAFQLALLCTKRHPADRPTMHEVARVLLSLLPPAAKPPASKAAAASAAAGDYTRFLATAADLRRGGVADDDTGDNSSSDEQWFVRFGEVISKHTLS

SEQ ID NO: 7776 - protein, 2154 aa, Oryza sativa
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMGTPVNIIVGSHVWAEDPDDAWIDGEVVEIRAGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDCFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTISTLKVLQNWLIGCRLHQLFSTYYKILLSLAVQQNARSSSLGSGISSGYSGMVGRPDTASKVEAKYSALRFKQQLTAYVEKIYGMIRDNLKKEINPFLIMCIQVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTSQNKELEDELVTFRTKAEDLEKRLLEVQKESDELSREILEKDSKLNQLQEMIERY

SEQ ID NO: 7777 - protein, 445 aa, Nitrosomonas europaea
MKIIIAALTGLIMVVTVFAMEKTVTPNSVNVKQTIDSKTDYIVLGMGCFWGAEKRMGELSGVIDVESGYAGGDHADAGYQDILNFEHALRAGKTAGRNHAEVVKVTFDPAQVALEHVLARFWESHNPTQGDRQGNDIGSNYRSAVYYHDENQKTLALTTRKIYQQALATAGYGQITTEILPLKNYITAEEYHQNYLQKNPDGYCGLGGTGVKYPAPDQHIIRGDTSSVPASPSPQSLDGKNLNFDQQLVIFESENCEFCAQFDRDILAHWQADIPMVATKNTNPPADWTLDKPLFAAPTIVLFREGKEVVRYTGYTGEKENFWQWLGFQMLTPEQQKIAFQQGTERPFTASNLDEKRPGRFVDPITGATLFFSKTKFNSGTGWPSFFEPVEGSVTYHEDHSGYMQRIEVRSASSGIHLGHVFDDGPPPSYKRYCINGNVLKFIPD

SEQ ID NO: 7778 - protein, 133 aa, Staphylococcus aureus
MSIEVGNKLKGKVTGIKKFGAFVELPEGKSGLVHISEVADNYVENVEEHLSVGDEVDVKVLSIADDGKISLSIKKAKDRPRRQHTSKPSHQKPVQKAEDFEKKLSNFLKDSEDKLTSIKRQTESRRGGKGSRR

SEQ ID NO: 7779 - protein, 256 aa, Mannheimia succiniciproducens
MICGGKTPIKKENIMAQVSMRDMLQAGVHFGHQTRYWNPKMKPFIYGPRNGVHIINLEKTVPMFNGALAELTRIASNNGKILFVGTKRAATEAVQAAALDCQQYYVNHRWLGGMLTNWKTVRQSIKRLKDLETQSQDGTFDKLTKKEALVRTREMEKLELSLGGIKDMAGLPDAIFVIGADYEHIAIKEANNLGIPVFAVVDTNSNPDGIDFVIPGNDDATRAIQLYVTAAAAAVKEGRSQQTATEEKFAEEVAAE

SEQ ID NO: 7780 - protein, 929 aa, Pseudomonas syringae
YRRTDTCCRRKSVLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 7781 - protein, 369 aa, Thermosynechococcus elongatus
MSSSRKRLGVFTSGGDCPGLNTAIRAIVAHATLSYGWEVLGILHATQGLIERKAIPLNAEGLGGMDVLLNMGGTILGAINKGDTLGHADEVIAGYYELGLDALIAICGDGSLRILHQLAQKGNWNFLAIPKTIDNDVALTDRAIGFDTAVNTVVEALNRITSTAASHDRVFVVEVMGRTAGHLALYSGIAGGADIILIPEIPYSIEGICQHLQKLRDRWGRQFALIVVAEGSKQLEEDANHPRHCSIGQYIADKIAQHSPIPIELRVSVLGHIQRGGAPMAMDRLLAAGMGNTAVDLAAQGTFGRMVAWQAGQVVTVPIADVVAKCPRHVDPNSFLIRTAQGLGIYVGDKPMLPYVDPTLCRDQVICAI

SEQ ID NO: 7782 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDCEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEDYNWDLNYGEIAKIFRAGCIIRAQFLQKITDAYAENPKIANLLLAPYFKQIADDYQQALRDVVAYAVQNGIPVPTFSTAVAYYDSYRAAVLPANLIQAQRDYFGAHTYKRIDKEGVFHTEWLD

SEQ ID NO: 7783 - protein, 455 aa, Ruminococcus flavefaciens
MALKNQYLKELLERVEKRNPGEPEFIQAVTEVLETLQPVAEKRQDLIDAGVFERIVEPERQIIFRVPWVDDNGKVQVNRGFRVQFNSAIGPYKGGIRLHPSVYLGIIKFLGFEQVFKNSLTTLPMGGGKGGSDFDPKGKSDGEIMRFCQSFMTELSKHIGADCDVPAGDIGTGAREIGFMFGQYKRLRNEFVGVLTGKGLTYGGSLARTEATGYGLCYFTNEMLQANGKSFEGKTVVISGSGNVAIYATEKATQYGAKVVTVSGSNGYIYDPDGIELDLVKQIKEVERGRIKEYASRTSHKNAEYHEGSVWTLKCNAGGIKLDIALPCATQNEINGDGAKAIVANGGFAIAEGANMPSTPEAIETYLSNGLLYGPAKAANAGGVATSGLEMSQNSERLSWTFEEVDEKLHGIMKSIFKACDDAAKEYGMAGNYMAGANIAGFLKVAEAMKAQGCV

SEQ ID NO: 7784 - protein, 424 aa, Comamonas testosteroni
MNKEMSETLTRVGPNTRMGNLLRRYWVPALMSSEIAEADGPQVRVQLLGEKLLAFRNTDGKACLISEFCSHRGVSLYFGRNEENGIRCAYHGVKFDGDGQCVDVPSSPQSCARMHIKGYPCVERGGIVWTYMGPEEHKPSPPELEWCTLPPEHVFVSKRLQYSNWLQAMEGGIDTAHVSYVHRFEVDTDPMHQGVKALDYIKADGNVKFEIEQTPFGLSLFGRRNGEPDSYYWRITQWLFPWFTLIAPFGNHALGGHVWVPIDDHNCWAWSINWQPDQPLTEEERTSMEEGKGIHVEYEAPGSFIPKANRNNDYGMDRVAQREERSYSGIFGFSAQDYSLQESMGSIQDHAAERLLPTDKAIVMARRMLNEAALGLEQGETPPALDASEQHVRPAGVLLPREQDPVAWAREELADATKKPVFSL

SEQ ID NO: 7785 - protein, 1405 aa, Psychrobacter arcticus
MKRILINATQNEEIRVALCNGNHLYDFDLENRTREQKKSNIYKGHVTRVEPSLEAVFVEYGSQRQGFLPIREISAEYLSGNPRDENIKKLIKEGDELIVQVEKEERGNKGAALSTYVSLAGRYLVLMPNNPRGGGISRQISGKLREDMKRMLGSLDLPKGMSVIIRTAGIGKTQEDLQHDLNHLLNIWQAIQEQNQKYPSPRLVHQEAGVVTRAVRDYLRDDIAEIWIDNENAYIEAAGFIDAVMPKQAEKLRKYTDYEPMFSRFNIEKQIETAYQREVRLPSGGSIVIDQTEALVSIDINSAKSTKGSDVAETAYHTNLEAADEIARQLRLRDMGGLIVIDFIDMNDNKHQKEVEKRLIDATKYDRARVQFGDISKFGLMEMSRQRLRPSLEESTGYICPRCHGNGMIRDLRSLSLSIMRQIEQIALKERQGEVQAEVPTDIAAFLLNEKRDSLVYLEQDSGTRITILPHAHLESPNFKLHFNRDGFAPSSYERITDTQLQEHSELGYNVDWQTAEKERPEQQPTRQPRQGSDNNNGSQAQVRTNTQQSAPTQQQQSTSHSNEHRSNNNSNVTSARAPQTKETPSVPNPQSSQNIVTSSAPVAPQPTAIVAAQPQAVAWLSNLFAQAPQAQTTSSVSSRDAAEAIEALVNTGAQSLGSFGQVDNTALVNTDNSQNASAPPQSTNQQSGNEQNRQQTRSAENSTDDNSDAEERRRRKPRKSRPSKPRQRKEQADETENSTVSNTTNSSATGTDDKADNQDKRQQDNRRHSDRNRNNRQDSNRNTNENNANITTANATSASDSNRSDSSDNVAEEQTRTKRKSNSQRGSRGKLERGETLTAADSKQNSQQASKDANGSKNQSNARRNQDPNEVVLQVNEAASKLKSPEVVHLSLDDSKSAARQATHKQAAIESHAAAEKERPENNTQQHADKQKSGDNKPAQQTAQTAQTAQTAQTVDTSSDASDKTQQSSVQADTAEKISAQVNTTQVDQVEKSTNHDKADQPTTSKDNDKGSSHKPAVDKQATTKSSTGNEAESTAPIQEVIAVQVEKVAPTETTQEASVAASTAEENVVVDSNEVAAENSSSQAGLELTHDALFAKRYITANKFGQASNDPRLVRRQQAQSSVAEASHANEQDVQVTVSAPTIRGTVGEFIRATLAEAENRLATDGVISCFNAAIAMHQEQAKVKDTADKQVATKPVAHSGFEFSNYGYQPLAADYLARFESMTQAVSQFAAAQGKTSVEPRAISKRASNDPRGQHPDYKESAVLTVVDPANNEPVQTGIDIDANKVEADALANQAQTDAVSDQSKQLLDAEQTPAEVDTVQADESIVAPFSKEDSQAAKSKTTIASYKNMIENVAEQLLPQKSMFNLTTPKVPKARARKPKADHKKPTQAEKVESDNSDNES

SEQ ID NO: 7786 - protein, 320 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATSDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 7787 - protein, 460 aa, Cryptococcus neoformans
MADSIASASNSGAESIAIAARRAFEASQLVNPSERDVALKAIRETLQASKDEIIAANKKDMEAAEALAATGKLSSSLVSRLDLGRPGKFEAMLQGITDVAALPAPTGIVTFAKEIGPELELHRVTCPVGVLLVIFEARPEVVVNIAALAIKSGNAAILKGGKESINTATLLSSLISQALAKTSIPPAFVQSVSTRSEISSLLAQDKYIDLVMPRGGNELVRSIQNNTRIPVMGHADGICAVYLDESAVQEKAVRIAVESKIDYMAACNAAETLLIHSSLLTTVWPAVASALMSNSVCLRCDAATLSALRDANIPKTSEFVTASSPADYSTEFLGPTIAVKAVESVQEAIQHINSHSSHHTDSIVTEDEASMSAWCRGLDSANCFVNASTRFADGTRYGLGTEVGISTGKTHARGPVGLDGLIIYKYMMRSRKQDGSVIADHEKGGKGYTHKDLVKGEPPF

SEQ ID NO: 7788 - protein, 959 aa, Saccharomyces cerevisiae
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNGVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIEDNQAAIAEARAAEENFNADDKTISDTAAVVGVKGSHVVYNSIRQLYDYETEVSMRMPKVIHWQATRLIADHLVGRKRVD

SEQ ID NO: 7789 - protein, 572 aa, Mycoplasma capricolum
MKKLLTLLGSIGMVASTAAVAVACTDRGTNTSSNKDNNGGEKPGNQPTNENSDKNEEIQGDDSGTGKSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKDQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTRLLTVSDSLDLNIDTESYNVLGF

SEQ ID NO: 7790 - protein, 263 aa, Colwellia psychrerythraea
MENINTTKQAFIAGEVALVGAGPGDPDLLTLQAYRFIKQAEVVIYDRLVSAAIMALLPSDCQQIYVGKKQADHRVPQEGINQLLVDYALLGKKVVRLKGGDPFVFGRGSEEAQFLLSHGVACHIVPGMTAASACTSYAGIPLTHRKVARSCTFITGNVQDNGALDLPWQALNDKEQTIVFYMGIKSLPIITAQLTGAGRDINTPAALIRKGTHQDQQVIKGTLANLTDLVALHRITPPSLIVIGDVVGLFPSEQLTNLGYLTP

SEQ ID NO: 7791 - protein, 185 aa, Pseudomonas fluorescens
MSADLEHIRQIMREADCLYTEAEVEAAIARVGAQITEELAERNPVVFCVMNGGLIFAGKLLTHLRFPLEASYLHATRYRNETSGGELFWKSKPEVSFIDRDVLIIDDILDEGHTLGAIIDFCKHAGARAVHTAVLIDKDHDRKARPDLKADYMGLPCVDRYVFGYGMDYKGYWRNAAGIYAVKGM

SEQ ID NO: 7792 - protein, 225 aa, Zea mays
MVQCLDGVRQLLAVLLNCCDVELKQPRGLQDPQVLARETVFSVSEVEALYELFKRISSAVIDDGLINKEEFQLALFKTNKKESLFADRVFDLFDTKHSGILGFEEFARALSVFHPNAPLDEKIDFSFRLYDLKQQGYIERQEVKQMVVATLAESGMNLSDEIVESIIDKTFEEADTKHDGRIDKEEWRNLVIRHPSLLKNMTLQYLKDITTTFPSFVFHSQVDDN

SEQ ID NO: 7793 - protein, 377 aa, Streptococcus thermophilus
MNNTEYYDRLGLSKDASQDEIKRAYRKLSKKYHPDINKEPGAEEKYKEILEAYETLSDAQKRAAYDQYGPDGANGFGGQGSFGGFDGGAGFGGFEDIFSSFFGGGATRNPNAPRQGDDLQYRVNLSFEEAVFGAEKEIHYNREVTCKTCSGSGAKPGTSPVTCGRCHGHGVINVDTQTPLGMMRRQVTCDVCHGTGQEIKDPCQTCHGTGREKQSHTVSVKIPAGVETGQQIRLAGQGEAGFNGGPYGDLFVVINVNPSDKFTRDGSTIYYTLNISFVQAALGDTVEVPTVHGNVEMVIPAGTQTGKTFRLKGKGAPRLRGGSQGDQLVTVKIVTPTKLNDAQKEALLAFAKASGDEKVAPQKKGFFNKVKDVLEDL

SEQ ID NO: 7794 - protein, 301 aa, Oryza sativa
MASVTYIDDSGSEVIDPPKTEVLDVTELAGDPVPHSPKPNVVVSSSVRELLECPVCLSAMYPPIHQCSNGHTLCSGCKPRVHNRCPTCRHELGNIRCLALEKVAASLELPCKYQNFGCVGIYPYYCKLKHESQCQYRPYSCPYAGSECTVAGDIPYLVNHLKDDHKVDMHNGCTFNHRYVKSNPHEVENATWMLTVFSCFGQYFCLHFEAFQLGMAPVYIAFLRFMGDDLEAKNYSYSLEVGGTGRKMIWQGVPRSIRDSHRKVRDSYDGLIIQRNMALFFSGGERKELKLRVTGRIWKEQ

SEQ ID NO: 7795 - protein, 268 aa, Chlorobium tepidum
MQSRIPFDFQNDVIERSKTVPVLVDFWAQWCGPCRILAPVLEKLAERHAGKWVLVKVNTEEFPEISAQYGIRSIPNVKLFSNGVVIDEFTGALPEYQIEQWLAKALPSPWAEEVARAAAEMAAGNDAVAITLLEGVLAKEPENRDAAAMLARLILFSRPEEALRLAETLEAEPDYADLSESVRTLGALLVRPASAFPDGEGREAYGEAVESLRKGDMDSALEHFISVLRTNRYYDDDGSRKACIAIFRFLGEEHEITMKYRRAFDRAF

SEQ ID NO: 7796 - protein, 689 aa, Prochlorococcus marinus
MGKIHKGSPWPLGSSITSRGVNFSVASPEASYIELLIFKNEDDLQPKKILTLDKNHRSGDYWHIEVEGINTGCFYCYRVIGNRSTCKQDIFSRKILLDPCSRGIAGWNIFQRESATGLSTNIDKCLKSIVTERDQFDFQSYPRPKHSWDKTIIYELHVGGFTKSSESDVKDKIKGTFLGLIEKIPYLKQLGVTTLELLPVFAFDTTDSPYGLNNYWGYSPINWFTPHHSFIASNNPINARDQFRNFIKVCHKNDLEVILDVVYNHTTEGNEKGPIISWKGFAESTYYHQNKEGKYLDVTGCGNTIAANNPLVRQLILESMRCWANELGVDGFRFDLGISLSRGKDLKPLDSPPLFEEIESDPALSDLKLISEPWDCGGLYRLSDFPAKRCCTWNGHFRDDIRRFWNGDKNSTWPLKDRLTGSPELYKDNFKSAQKSINFITSHDGFTLKDLVSFNLKHNLSNGESNRDGENHNNSCNNGIEGPTTNKKVNLIRSKNQRNLIATLLLSPGIPMILMGDEVGRSQGGNNNAWCQDNPLGWMIWRTDNCDNELRSFVSMCIYIRKELSDFFAPLININSDSPSLQSQEKLWVQWHGVKINAPDWGSWSNTIGFSINKAKEGAIIWMGFNAFNQSMKFELPKPLSPWVKILDTTLLTQKEYGLFRLSNQLEIEIESKSLVVLVAKEYTKKLRI

SEQ ID NO: 7797 - protein, 72 aa, Herminiimonas arsenicoxydans
MAKDDVIQMQGEILENLPNATFRVKLENGHVVLGHISGKMRMNYIRILPGDKVTVELTPYDLSRARIVFRTK

SEQ ID NO: 7798 - protein, 387 aa, Prochlorococcus marinus
MAYSETKVVLGGLAHIPIIIGFFYLIRRQYSFGAMLRNGKNALSEKVTKANPAKAATPAKAATPAKAATPAKAATPAKAATPAKAAAVKKPHADVPVNTYKPKAPFTGTVTENYSALKEGAIGKVQHITFDLSGGDPDFKYVEGQSCGILAAGEDAKGKPHRPRLYSIASTRYGDNFAGNTLSLCVRQLQYEKDGETINGVCSTYLCNLSPGDKVKISGPVGKEMLLPEEEDSNIIMLATGTGIAPMRAYLRRMFEPTEIEKHQWNFKGKAWLFMGAPKTANLLYDADFEHYKSKFPENLRYTKAISREQNNTKGGRMYIQDRVLEHAEEIFDMIENPKTHIYLCGLKGMEPGIDEAMTTAASAKGLDWSELRPKLRKAGRWHAETY

SEQ ID NO: 7799 - protein, 281 aa, Mycobacterium smegmatis
MNRKLRVSAVTPDIVIGDLDGNLARLHNALRAIEWTGPYLAVLPELATSGYVFTDIDEARALSLRADDARLTALADDVPADCVAVVGFAEVDGDTLYNSAIVIGDGKVVGTYRKAHLWAAEPEIFATGVEAGTVIDTAICRLGVAICYDNEFPELPRRLALRGAEVLALPVNWPLVDRPEGEHAPETIQAMAAARSSQLATVIADRRGTERGVRWTGGTAVIGPDGWIKATPQGDETIATAVLDLTDSKAIGDRNDALADRRPDLYRDLVESGEAATDIPD

SEQ ID NO: 7800 - protein, 636 aa, Unknown
  Bacillus sp. KSM-522
MTRRWSFLVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFLSQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGPLVGGPNRQDQYTDDISDYVSNEVATDYNAAFTGNGAAVWSGQSKLPNFPPKEKVEDEFFVEAAVMSNDTTSTQIKAILYNRSGWPARSSQSLSFRYYVNLSEIFAKGFTDKDIQVTAVYNEGASLSPLTVYDASSHIYFTEIDFTGVAIFPGGESLHKKEIQFRLSAPNGANIWDASNDYSFQGLTSNMQKTARIPVFDQGDLVFGTLPNK

SEQ ID NO: 7801 - protein, 181 aa, Fulvimarina pelagi
MRRHGRTVLELFAEKQIETEVDRIATEIATHCSGDPSNLMLVAVLKGAFVFTADLMRALSRKGVAPEVEFISLSSYGAGTVGGEVRLFRDIERPVDGRDVVLVEDILESGRTVALARKLMWERGAKSVRLAVLLDKPGHRKVEIEAEHVGFTCPDKFVVGYGLDAGYRFRELPFIGYLVEE

SEQ ID NO: 7802 - protein, 320 aa, Vibrio fischeri
MVKKIGVLTSGGDAPGMNAAVRGVVRTALTEGLEVFGIHDGYLGLVEDRIEKLERHSVSDMINRGGTFLGSARFPEFKEVAVREKAIENLKKHDIDALIVIGGDGSYMGAKKLTEMGYPCIGLPGTIDNDIAGTDYTIGYLTALNTVIDAIDRLRDTSSSHQRISIVEVMGRHCGDLTLMSAIAGGCEYVITPETGLNKEALIQNIQDGIAKGKKHAIIAITELMTDVNQLAKEIEAETGRETRATVLGHIQRGGQPGAFDRILASRMGNYGVKLLIDGHGGRCVGIQNEQLVHHDIIDAIENMRRPEKLELYKVAEELF

SEQ ID NO: 7803 - protein, 179 aa, Brassica napus
SVKKLSTNLILSADLPAYAIGDEKRLMQTMLNIMGNAVKFTKEGHVSIIASIMKPESLRELPSPDFYPVPSDNHFYLCVQVKDTGCGIHTQDIPFLFTKFVQPRTGAQRNHAGAGLGLALCKRFVGLMGGCIWIESEGIEKGCTASFIIRLGICNGPGSSSGSMALRLAAKSQTRPWNW

SEQ ID NO: 7804 - protein, 193 aa, Mycoplasma pulmonis
MSQKTKTDKPKISKYIDKIIYNEEQINEAIKKIALWIDQTYKDSNDLVIVGLLKGCVPFLAQLIKYINVDCQIDFMIASSYHGKSFSSGNVKIVMDLSLDIAGKDILVVEDVIESGITIQKTLDILGARNPKSLRVVSLLDKTAVANANIKIDQVGFKVKENLFLIGFGLDYQEKLRNLPYIGTMNKKYINDK

SEQ ID NO: 7805 - protein, 489 aa, Clostridium acetobutylicum
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 7806 - protein, 591 aa, Aspergillus oryzae
MAISTEQLAANGHTNGHTNGTATPLDSSSTSEKPVHPRSVPLNREYGYTPRKLRIITIGAGFSGLLMAHKIQHRFKELEEYVTHTIFEMRKDIGGTWLVNDYPGVQCDVPAHIYAFPFDPNPNWTKFYASGPEIQAYIKNTVAKWNLDRDVQLNTRVVGARWNENDGVWKVTVERDGVQRDEFAEILISGQGVLCHPSWPTIPGLRQFKGKVVHSAEWDHGFDYSHKRIAVIGNGSSGIQITPQMANLPGTEVVNFVRGGGWIYYRIPPSRHLGRTTDEVNPTYTEEEKTRFQDPEYHHQYRKGIIDRTNKAYKLFLKGKNNEEAVRFGTEQMAAKLNHDPELCRILIPKWEVGCRRVTPGPGYLEAFSKPNCNLTDSPITHISENAVHTTDGNVFECDVVICATGFDVSHRPRFPLIGQNGANLAEKWADEPESYLSVATAGFPNYFIFSGPNSLGGHGSLVEALNWTGDYFVKWIKKIATEDIKSVVPKKSAEEAFVRYGDEVHKTIVWTGSCKSWYKRNKANGRVTALFGGSALLFNRLISELRPEDFEIEYHSANNFRFLGNGFLEYEMDPEQDLSWYVELPEPLKQ

SEQ ID NO: 7807 - protein, 361 aa, Pyrococcus abyssi
MQAVLLAGGMGTRLLPLTIYRPKPMIPFFNKPLMEYMVNNLVEVGVDEIIVLVGYLKEKIIEHFGDGKEFGVEIKYSNGENVKFGTAGALKRAEKFIEGTFIVASSDVLTNLDFKSLLEFHAKKGGIATMALTKVEDPSPYGVAVLDDEGKILYFKEKPRREEAPSNLVNAGIYVFEPEILDLIPKGKPFDFSLNLFPKMLEEGIPIYGFPFDEYWNDVGRPSTYLQATEDVFLGKLKLPQISVGRLKGNVERGGSLFTGSRCILRNPKVSGFAVLGDNVEIGRDVKIERSVIFSNVTIEDGAEIREAIIGENVYIGKGVTIEPGSVIGDNSIIEEHSRIGANVKIWADSRVGRESIILPD

SEQ ID NO: 7808 - protein, 103 aa, Oryza sativa
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELF

SEQ ID NO: 7809 - protein, 850 aa, Pseudomonas aeruginosa
MKKVWFQLHWFFGISAGLVLALMGVTGATLSFQDELMRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPADSAIQWRAGDLLEIVPHQAPARIREWLQRHHLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 7810 - protein, 179 aa, Herminiimonas arsenicoxydans
MTTEIATLGGGCFWCTEAVFQQMKGITAIESGYTGGQVANPSYEQICEGTTGHAEVVRLTFDPAVVSFREILEVFFTIHDPTTLNRQGNDVGTQYRSVIYYHTPEQQDMARHVMAEMANVWDAPIVTELSPAETYYKAEDYHQNYFRQNPLQGYCAFIVAPKVAKFRQTFRDKIRADMS

SEQ ID NO: 7811 - protein, 446 aa, Burkholderia thailandensis
MPPLIAAVARQPQPRIERGTGRIGIILHSGFQKMSKVLSNVSLSRRREFLERTFGLGLAGLAGANAWGAVERTIALPFGNGRRPLADHFPQKGPLILQRTRPPLLETPFDVFDRHVFTPNDQFYVRWHLANIPSHVDPATFRLAVRGHVCRPVSLTLDDLVNDFAPVEIAAVNQCSGNSRGFYTPRVPGAQWGHGAMGNARWTGVRLKDVLERVGVRAGAVQVRMNGLETPAAPQTPDFKKSLEIDHALDGEVVIAYLMNGEPLPLLNGFPIRMIVPGWYATYWVKMLCDLEVLDRPDDNYWTKNAYLIPDTPGANVKPGQTGMKMVPINKMVPRSFITSVRDGGILKRNVQTEIRGFAFGGDCGLARVQLSGDSGRTWLDAQLDKDYGRYSFRRWALRFTPTNAGPLVLMVRAVNTSGLAQPMQSNWNGSGFMRNGVESVTLRVV

SEQ ID NO: 7812 - protein, 481 aa, Pseudomonas fluorescens
MQLIWLRSDLRLHDNTALSAAAQRGAAVAVYLLSPEQWLAHDDAPCKIDFWLRNLQSLSTALGRLNIPLLIRSAATWEQAPQVLLELCRQLQVQMLHFNQEYGIHESRRDAAVTRALQHAGISVQGHLDQLLFQPGSVLTKSGGYFQVFSQFRKVCYSRLHTALPALVKAPGAQLPLSINADPLPQRVEGFPSPTQALRELWPAGDDEAQRRLEKFSDEQIHYYQSERDFPAKPGTSQLSPYLAAGVISPRQCLHAALRGNQGEFESGSPGAVTWINELLWREFYKHILVGYPRVSRHRAFRPETEAVKWRHAPEELAAWQEARTGLPIIDAAMRQLLETGWMHNRLRMVVAMFLTKNLLIDWREGERFFMRHLIDGDLAANNGGWQWSSSTGTDSAPYFRIFNPISQSQKFDSEGRFIKHWLPQLAGLNKKDIHNPAAMGGLFGVPGYPAPIVDLSRSRERALAAFKALPARMDAGVSHE

SEQ ID NO: 7813 - protein, 221 aa, Triticum aestivum
MSRRGDWVYEKHGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 7814 - protein, 237 aa, Porphyra yezoensis
MPNQIRAQLLELNKNTKSNNVKQQLEIIENINSNDSIELKDLADLFFERITGPNYKSNCVDGLIYEKLLNSKNQEIVKFASNLCPDGIVPLRSAQQMNYKDLQMLLTHRDLLKADQLTQQKLIQLAGVNAQTRNWLYFTDIKKIPAQDLQTIDKLWHTHSKGKFGLFVQRQIWLSVGKDWGKFWQKIGWEVDRIPCRYPEEFQWNSHGPRGHLPLFNQLRGVQVLSALFTHKAWENY

SEQ ID NO: 7815 - protein, 349 aa, Arabidopsis thaliana
MSNAFLYMPTLYKKAGSFQLTTMGRQPCCDKVGLKKGPWTIEEDKKLINFILTNGHCCWRALPKLSGLLRCGKSCRLRWINYLRPDLKRGLLSEYEEQKVINLHAQLGNRWSKIASHLPGRTDNEIKNHWNTHIKKKLRKMGIDPLTHKPLSEQEASQQAQGRKKSLVPHDDKNPKQDQQTKDEQEQHQLEQALEKNNTSVSGDGFCIDEVPLLNPHEILIDISSSHHHHSNDDNVNINTSKFTSPSSSSSSTSSCISSVVPGDEFSKFFDEMEILDLKWLSSDDSLGDDISKDGKFNNSTVDTMNLWDINDLSSLDMFMNEHDDGFIGNGNGCSRMVLDQDSWTFDLL

SEQ ID NO: 7816 - protein, 243 aa, Bacillus megaterium
MTVGKVYLVGAGPGDPKLITVYGMECIQEADVILYDRLANEQLLNYAKKDAELIFCGKLPGKHGVIQDRIHELLVEKALQGKVVTRLKGGDPFVFGRGAEEAEVLANQGIPYEVVPGITSGIAAPAYAGIPVTHRDYATSFAIVTGHGREEKGKDYLNWSALAQGIDTIAFYMGVGNLPHICKQLMDHGRDKHTPVGLVQWGTTKYQRTVTGTLATIEEIAKKAEIAHPAIVLVGDVVTIREK

SEQ ID NO: 7817 - protein, 126 aa, Brassica napus
  misc_feature (46)..(46): Xaa can be any naturally occurring amino acid
QAEDRELKGQLLRKYSGYLGSLKQEFMKKRKKGKLPKEARQQLLDXWSRHYKWPYPSEQQKLALAESTGLDQKQINNWFINQRKRHWKPSEDMQFVVMDATHPHHYFMDNVMGNPFPIDHISSTML

SEQ ID NO: 7818 - protein, 251 aa, Nitrosomonas europaea
MSVTMRQMLEAGVHFGHQTRFWNPKMAPYIFGQRNKIHIVNLEHTLVMLREALDYARRLTANKGTILFVGTKRQARDIVMEEAIRCGAPYVNQRWLGGMLTNFKTIRQSIKRLQDMEKMVQDGTLNKLTKKEALDFQRELEKLNNSLGGIKEMKGLPDAMFVIDVGYQKGAIVEADKLGIPVVGVVDTNHSPAGVRYVVPGNDDSSQAIRLYARAMADAILEGRNQSVQEIIEMSKSDDEIMSGRDQSAGA

SEQ ID NO: 7819 - protein, 563 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASTNAKQ

SEQ ID NO: 7820 - protein, 433 aa, Mesembryanthemum crystallinum
MAQILAPSLQVKMSITKSSTPASSMLPNTWTSVVLKQSRKGSIKNSTKFKVCASIKPDVSVQNRVEQLLNLDVTPFTDKIIAEYIWIGGAGIDLRSKSRTLSKPVEHPSELPKWNYDGSSTGQAPGEDSEVILYPQAIFKDPFRGGNNILVICDAYTPAGEPIPTNKRHKAAEIFSNPKVVSEVPWYGIEQEYTLMQPNVKWPLGWPVGAYPGPQGPYYCGVGADKSFGRDISDAHYKACLYAGINISGTNGEVMPGQWEFQVGPSVGIEAGDHVWCARYILERITEQVGVVLTLDPKPIEGDWNGAGCHTNYSTKSMREEGGFEVIKKAILNLSLRHKDHISAYGEGNERRLTGKHETASIDSFSWGVANRGCSIRVGRDTEKAGKGYLEDRRPASNMDPYVVTGLLAETTLLWEPTLEAEALAAQKIAMKV

SEQ ID NO: 7821 - protein, 183 aa, Malus sp.
MASSMISSGTVATVSADRPAPAQARMVAPFTGLKSSSASPVTRKSNDITSIASNGGRVQCMQVWPPLGLKKFETLSYLPPLSTESLAKEVDYLLRKNWVPCLEFELEHGFVYRENHRSPGYYDGRYWTMWKLPMFGCTDSSQVLKELEEAKKAYPQSFIRIIGFDNVRQVQCISFIAYKPAGF

SEQ ID NO: 7822 - protein, 947 aa, Pneumocystis carinii
MILKILLTLTLYWIYLVRVRCETVPVDFENNDYYHFHFSEDVDIEEFSRAIGFKYHMKVEYLDNHHIFFIEKSVLEDEIKEKIENYFSLEKGRNAINGFNSDKLFYYEKQKLVKRENRALIRDDIYFDNQDLYNDEVVNNVVKDPMGDQAEKPTENQAENRAENLTQKLEEIKKQLNISDPCFDKQWYLFNTKDPGVDINVTGVWLQGITGKNVTVAIADDGLDYTNQDLAPNYNANASYDFDSKDFNPKPEKPDESHATKCAGEVAAARNTLCGLGVAYESNISGIRFLSSSHAFILEKDAVSYKPDVNHIYSCSWGPSDNGDVAMPMFPTTYSAIIKGIKEGRNGLGSIYVFGSGNGGHFDDCNYDGYANSPYTVTIASIDSEDKNLYFSESCPCILASTYSGGEKGYIYTTDVGTTNCTTEHSGTSASTAIAAGIIALISPNLTWRDVQALIVETAVPFNMKEYEWDKLHSGRYYNNFFGYGKLDAYRMVEKAKTFKTLNAQTMFSTQLIHVNMKFPEPSRRITSSFYIHRGYPKHYNFKSLEYVGVSFYYKHRIRGSLEFKITSPSGVTSKLTRVRFRDNKSGTFRWIFTTVKHWGEGIVGKWTIDVRDKNMWDEQGYIFNWQLHFFGESIDSNKVPVLSYPFTHKQPTTTPPPDPDATPPPDPDANLQPDSNADPQPQPDVKPLPSSDLEPQPSSDPGSPPSSDSESPPSSEPGYQPPSKPGPQPPSEPPPQPPLDPRPPSKPYPNPPSDPSSQQDPDTSLSSNLTSTSSSEPPPLPPPPPPAPTPPPPAPTPAPPPPPPPPPSRPEPQPQPRPEPQPQPPKPPQPEPPAPPPKPQPEPPAPPPKPQPEPPAPPPKPQPEQKPTSITSSTSTTSSSKTKISTIRKASSTKTSSTTKTSTRPSPTKGTSTGSGASHLSFFEKRHLLLQMILLLFFFLFLGYSF

SEQ ID NO: 7823 - protein, 72 aa, Thiomicrospira crunogena
MSKQDVIEFDGEVIETLPNTMFKVRLENGHEILAHISGRMRKNYIRILAGDKVKVELTPYDLTKGRITYRGK

SEQ ID NO: 7824 - protein, 426 aa, Brassica napus
MTRDIEDEIRDEKNPRPLDEDDIALLKTYGLGPYSAPIKKVEKEIKELAKKINDLCGIKESDTGLAPPSQWDLVSDKQMMQEEQPLQVARCTKIISPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 7825 - protein, 349 aa, Mesembryanthemum crystallinum
QNLNISEVSEKIIAEYIWIGGSGMDMRSKARTLNGPVDDPKKLPKWNYDGSSTGQAPGQDSEVILYPQAIFRDPFRRGNNILVMCDAYTPQGEPIPTNKRYHAEKIFSNPEVAAEEPWYGIEQEYTLLQKEVNWPLGWPIGGFPGPQGPYYCGVGADKAFGRDIVDAHYKACLYAGVTISGTNGEVMPGQWEFQVGPSVGISAGDEIWIARYILERITEIAGVVVSFDPKPIPGDWNGAGAHTNYSTKSMREDGGYEVIKKAIEKLGMRHKEHIAAYGEGNERRLTGKHETANIETFLWGVANRGASVRVGRDTEKEGKGYFEDRRPSSNMDPYVVTAMIADTTLLWKP

SEQ ID NO: 7826 - protein, 197 aa, Pseudomonas aeruginosa
MAERKASVARDTLETQIKVSIDLDGTGKARFDTGVPFLDHMMDQIARHGLIDLDIECKGDLHIDDHHTVEDIGITLGQAFAKAIGDKKGIRRYGHAYVPLDEALSRVVIDFSGRPGLQMHVPFTRASVGGFDVDLFMEFFQGFVNHAQVTLHIDNLRGHNTHHQIETVFKAFGRALRMAIELDERMAGQMPSTKGCL

SEQ ID NO: 7827 - protein, 167 aa, Tropheryma whipplei
MKPLLSEAVIHRRLAQLALQIDEDYRGTSIVLLGVLKGSIMLMADLSRLLSSDLRIEWVTLSSYGNDTVSSGSIRIVHDLDADIRDRHVLIIEDIVDSGLTLGWLLAKMRERRPASIEACVLLRKPHARGTDVRYLGFDIPDEFVIGYGMDYAEKYRNLKSVYVLEQ

SEQ ID NO: 7828 - protein, 77 aa, Borrelia burgdorferi
MEVVLNIKEEAIETEGIVKESLPNTMFRVELKNKHIVLAHLSGKMRKHFIKIVPGDKVKVELSPYDLTKGRIVYREK

SEQ ID NO: 7829 - protein, 75 aa, Unknown
  Synechocystis sp. PCC 6803
MSKQDLIEMEGTVMESLPNAMFRVDLDNGFNVLAHISGKIRRNYIKILPGDRVKVELTPYDLTKGRITYRLKNKK

SEQ ID NO: 7830 - protein, 343 aa, Vibrio fischeri
MVTMTTQTDYSDISMTVLGAGSYGTSLAISLARNGAKVILWGHEEAHMNRLEADRANEEFLPGVAFPPSLIMSTDLEKSVQASRDLLVVVPSHVFGLVLGNVKPFLRDDSRICWATKGLEPETGRLLKEVAVEALGESHSLAVLSGPTFAKELASGMPTAIAVASPDKEFVKDLQEKIHCSKTFRVYANNDFTGMQLGGAVKNVIAIGAGMSDGIGFGANARTALITRGLAEMTRLGVALGAEAETFMGMAGLGDLVLTCTDNQSRNRRFGLALGQGGDVDSAQEEIGQVVEGYRNTKEVWLLANRMGVEMPIVEQIYQVLYQGKDARVAAQDLLARDKKSES

SEQ ID NO: 7831 - protein, 390 aa, Crambe hispanica
MAMAAAVIVPLGILFFISGLVVNLLQAICYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPESDDAIAQWCRDQFVAKDALLDEHIAADTFPGQQEQNIGRPIKSLAVSLSWSCLLILGAMKFLHWSNLFSSWKGIAFSALGLGIITLCMQILIRSSQSERSTPAKVVPAKPKDNHNDSGSSSQTEAEKQK

SEQ ID NO: 7832 - protein, 486 aa, Triticum aestivum
  misc_feature (136)..(136): Xaa can be any naturally occurring amino acid
MARVGGGDVEIGGLPAPAGDPRRRVVAADDSLDDDGKPRRTGTVWTASAHVITAVIGSGVLSLPWSVAQLGWVAGPVTLLLFAIITYYTSVLLGDCYRSEDAVTGKRNYTYMEAVGSLLGKGQVWFCGLCQYVNLXGTAIGYTITASISAAALYKANCFHSKGHSADCGVYTTMYMVVFGISQIVFSQLPTLHEMAWLSILAAVMSFSYATIGVGLSLAQTITGPTGKTTIGGTQIGVDVTSAQKIWLTLQALGNIAFAYSYSMVLIEIQDTVKAPPAENKTMRKANLMGVSTTTAFYMLCGCLGYSAFGNDAPGNMLTGFGFYEPYWLIDFANVCIVVHLVGAYQVYCQPLFAFVEKWAQQRWPKSGFITGEIQVPLVSSGFKLNLFRLTWRSAFVVATTVVSMLLPFFNDVVGFLGAIGFWPLTVYFPVEMYIVQKKIPRWSSQWVCLQLLSLACLIITIAAAAGSIAGIMSDLKVYKPFSTTD

SEQ ID NO: 7833 - protein, 829 aa, Vibrio vulnificus
MKMTRRAFVKANAAASAAAVAGITLPASAANLIASSDQTKITWDKAPCRFCGTGCSVLVGTQNGKVVATQGDPEAPVNKGLNCIKGYFLSKIMYGQDRLTQPLLRMKDGKYDKEGDFTPVSWDVAFDTMAEKWKASLAKKGPTSIGMFGSGQWTVMEGYAAAKMMKAGFRSNNIDPNARHCMASAVVGFMRTFGIDEPMGCYDDFEHADSFVLWGSNMAEMHPVLWTRITDRRLSHPHVKVNVLSTYYHRSFELADSGYIFKPQSDLAIANFIANYIIQNDAVNWDFVNKHTNFKQATTDIGYGLRDDDPLQKQAKNPNSGNMTSISFEEYKKSVAPYTVEKASEMSGVAQDKLIELAKQYADPNTKVMSLWTMGMNQHTRGVWMNSLVYNIHLLTGKIATPGNSPFSLTGQPSACGTAREVGTFAHRLPADMVVANPKHRAIAEKIWKLPEGTIPPKPGFHAVLQDRMLHDGVLNCYWVQCNNNMQAGPNINGERLPGYRNPENFIVVSDPYPTATAQAADLILPTAMWIEKEGAYGNAERRTQAWYQQVGTVGEAKSDLWQVMEFSKRFKMEEVWPEELLAKAPQYRGKTMYDMLFANGQVDKFPLSEARQLNDDSHHFGFYVQKGLFEEYAEFGRGHGHDLAPYDVYHTVRGLRWPVVDGKETLWRYKEGSDPYAKKGSGWDFYGKPDGKALIISAPYEAPPESPDAEYDMWLCTGRVLEHWHTGTMTRRVPELYKAVPDAVCYIHPEDAKARGLRRGDEVLISNKRGEVRVRVETRGRNRPPQGLVFVPFFDARILINKLILDATDPLSKQTDFKKCPVKITKVA

SEQ ID NO: 7834 - protein, 488 aa, Bacillus anthracis
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 7835 - protein, 133 aa, Pseudoalteromonas tunicata
MRLLHTMLRVTDLEKSIAFYTQVLGMKEIRRAENPQYRYTLAFVGYADESEQAVIELTYNWDTDSYDLGNAYGHIALEFDDIYRACEQIKARGGIVTREPGPVLGGTTEIAFVKDPDGYAIELIQTKTKLDDF

SEQ ID NO: 7836 - protein, 243 aa, Glycine max
NPSRSSSVSSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 7837 - protein, 208 aa, Oryza sativa
  misc_feature (77)..(77): Xaa can be any naturally occurring amino acid
  misc_feature (152)..(152): Xaa can be any naturally occurring amino acid
TKGFSPLYNATHSRGEIGDPLEAGGLAAHTRSLPVRHAACARRRRLGVGDAASGLLARSRSSSYPWSRDCRAVPRPXKIGMFDVEMKKKSGREYSHCVHLVSWEMENVTSEALEAGRIACHKYMTIPAGKDAFHLKVRVHPIHVLPMNKMLXGAAADSLQTGMRGAFGKPHGTCPTVDIGQVLLSVPCMPSSAVHASVALRRANFKLP

SEQ ID NO: 7838 - protein, 202 aa, Unknown
  Mesorhizobium sp. BNC1
MAASNPRQAEISRKTNETDISVTVDLDGEGRSDISTGVGFFDHMLDQLSRHSLIDMKVSALGDLHIDDHHTVEDCGIAIGQAIAKALGDRRGITRYASLDLAMDEALTRAAVDVSGRPFLVWQVTFPSPKIGSFDTELVREFFQALAQNAGITLHVTNLYGANAHHIAETCFKAVARVLRAALSPDPRQLNAIPSTKGTLNG

SEQ ID NO: 7839 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTNEYENQQHRTTVSIGMDPELDQFMEAYCEMLTKYHEEL

SEQ ID NO: 7840 - protein, 200 aa, Corynebacterium glutamicum
MSNNVEMADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 7841 - protein, 72 aa, Mycoplasma pulmonis
MSDKSIKMQAKVLKMFSTDKYELELLENKVIIKGHISGKMRIHKIRILPGDIVDVEISPHDLSNGRITYRHK

SEQ ID NO: 7842 - protein, 282 aa, Wolbachia endosymbiont
MTNLPKVTVRDLAESGVHFGHKISRWNAKMAPYIYGVHQENRIHIIDLRKTLPLLQVAMKALYDVAFQGGRILFVGTKFQAFDIIASEAIRCGQYYVNHRWLGGMLTNWGTVSSSIKTLMQYEKILNDEDSILTKKELGNIEKKKQKLDKALGGIREMGAIPDILFIIDTNKEHIAVKEAKKLGIPIVAILDTNSDPDGITYLIPGNDDSRKSIELYCKLATDSILAGIESSLAKSGVKIDDIRGDEFIQEKEDGIVQTKRRRSKVYKEEEREVVTNEDESR

SEQ ID NO: 7843 - protein, 181 aa, Antirrhinum majus
MAAKVSSDPLVIGRVIGDVVDHFTSTVKMSVIYNSNNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 7844 - protein, 117 aa, Zea mays
  misc_feature (67)..(67): Xaa can be any naturally occurring amino acid
  misc_feature (84)..(84): Xaa can be any naturally occurring amino acid
  misc_feature (92)..(92): Xaa can be any naturally occurring amino acid
MVTSTTAGAVLTPPSVAGLRLAPSPRARVAFRAARARWSVAARAELSPSLVISLSTVVSIFLGRLVXVTSSKNVAKQVPDHNTXTHFYAGDXRAKDFSGLAKTHDPVRLKIQEVLDW

SEQ ID NO: 7845 - protein, 513 aa, Corynebacterium glutamicum
MSDLGPIWRWLLLVSVSICAASGLVYELALVSLSTSLNGGGIVETSLIVAGYVAALGLGALLVKPFLNWPAQTFLGVETLLGLIGGCSALVLYFTFATIGQSLWILVIATAAIGILVGAELPLLMTMIQQGRLADAKTTGSLVATLNAADYLGALLGGLAWPFVLLPWLGMMRGAAAAGMINLVAALFVGCVLLRHLLPRTHFFVSVVALLLAIAALATVLVKSDGIVATARAQLYRDPVIYSHQSDYQDIVVTERGKDRRLYLNGGLQYSTRDQHRYTESLVYPSLNPEAESVLIIGGGDGLAARELLRFPSMQITQVELDPEVIEVANTVLRSDNGGAMEDPRVSIIVDDAFTWLRSGGNNGETYDSIIIDLPDPNNDTMARLYSEEFYTLARARLNEQGRMVVQSSSAYTTPDVFWRVGATLKSAGCEQVIPYHVHVPTFGDWGFQLCGPADMELELREDTPPLTFLNDEVLVAAGVFGLDNQPRELEPSTLDHPRVVEDLRKGYRESGD

SEQ ID NO: 7846 - protein, 88 aa, Burkholderia pseudomallei
MAKEELIELDGIVDEVLPDSRYRVTLDNGVVVGAYASGQMRRHRIRILAGDRVTLELSVYDLTKGRINFRHKDERRSDAAPRASARRR

SEQ ID NO: 7847 - protein, 629 aa, Cytophaga hutchinsonii
MCGITGIFAFNQIGAFYMINLGKSIELLAHRGPDGRGTFVEELIALGHRRLSVIDTINGRQPMHDSTDRYVLTFNGEIFNYKILREQLIQEAGYTFTTDSDTEVLLNAYIHWGEACLLKLNGFFAFAIYDKQKHEIFVARDRMGVKPLLYYKDEDKFIFASEMKAVLAYNVPKEIDWVSVQQYFTLGYIPEPDSIFKDVKKLEAGSYLLINKAGVISKKYYEIPSSTQTKHQHSFEQAAAHVKELVDASVKDRLVADVPVGAFLSGGLDSSIVVASASKHVENLHTFSVGFKGADFYDETKSAELVAKTFNTSHTTFSLSQTELADNILPCLESMSEPFGDTSSLPLFVLSKKVAPSMKVILSGDGADELFGGYNKHRAEWLIKNPNWQIRFAQLIQPVVKILPGNRNTPMGDKIRQAQKLIEGLTLTDAERYYRWCSVFSEEAHKEMFQENIADNEEYKIRKGGILHAFKKNPYDLNRILYTDLNLVLGSDMLHKVDSMSMANGLEVREPMIDYRLVEYVSTLPSSYKINKNGGKQVLKHAYKDELPAEILSKAKHGFDVPLTKIFSKELKAWILDELLSQKFIEQQHVFKWSYIKNIRNAIDKNSNLDESKIWPLITFQFWWKKFMN

SEQ ID NO: 7848 - protein, 631 aa, Zea mays
MIHPPLPPHPHSAVSGSLNSHNTLQPAMQALTARSPASSSCPSSSTVHRRGGTRTRSTARFAPPRAAAAAANSVFSAPPAAVRYAAPPKPAAPIAPVPAPAPAAGGEKGLSFLQRAASAALDAFESGVIAGLLERPRALPRSADPAVQIAGNFAPVGEQPPVRSLPVSGRIPPFISGVYARNGANPCFDPAAGHHLFDGDGMVHAVRIRNGAAESYACRFTETARLRQERALGRAVFPKAIGELHGHSGIARLALFYARGLCGLVDASRGTGVANAGLVYFNGRLLAMSEDDLPYQVRVTADGDLRTVGRYDFEGQLGCASMIAHPKLDPASGDLFALSYDVIRRPYLRYFYFRPDGTKSDDVEIPLEQPTMIHDFAITERFVVVPDHQVVFKLGEMLRGGSPVVLDQGKTSRFGVLPKYARDASEMVWVDVPDCFCFHLWNAWEEPGTGEVVVVGSCMTPADSIFNDDGGEDGRLQSVLTEIRLDTRTGASTRRAVLPPSAQVNLEVGMVNRNMVGRRTRYAYLAVAEPWPKVSGFAKVDLDTGDLVRFDYGDGRFGGEPCFVPTEGAPARGEDDGYILSLVRDERAGTSELLVVNAADMRLEATVQLPSRVPYGFHGTFIGERELEAQA

SEQ ID NO: 7849 - protein, 263 aa, Oryza sativa
MEAEAAAKRARESGDAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGDLLIIGVIGFMLCSTEGPTVDFQHPIFNIEDNEFSTKSKGPLKFYNSEIHSASFCLPSFAKRVIGSKAN

SEQ ID NO: 7850 - protein, 276 aa, Arabidopsis thaliana
  misc_feature (95)..(96): Xaa can be any naturally occurring amino acid
MATTTAAAASGIFGIRIQDPRPGTGRVQARFGFSFGKKKPAPPPKKSRQVQDDGDRLVWFPGANPPEWLDGSMIGDRGFDPFGLGKPAEYLQYDXXGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 7851 - protein, 303 aa, Oryza sativa
  misc_feature (227)..(227): Xaa can be any naturally occurring amino acid
  misc_feature (246)..(246): Xaa can be any naturally occurring amino acid
MAGGGGAGSKVSVAAVQFACTDVESENVDTAERLIREAHKKGANIVLVQELFEGQYFCQAQRLDFFQRAKPYKGNPTIIRFQKLAKELEVVIPVSFFEEANNAHYNSVAIIDADGTDLGLYRKSHIPDGPGYQEKFYFNPGDTGFKAFKTKYATIGVGICWDQWFPECARAMVLQGAEILFYPTAIGSEPQDNNLDSREHWKRVMQGHAGANLVPLVASNRIGRETXVETEHGESTITFFGNSFIXAGPTGEIVKLANDKDEDVLVAEFDLDEIKSTRHGWGIFRDRRPDLYKVLLTLDGEKS

SEQ ID NO: 7852 - protein, 830 aa, Unknown
  Vibrio sp. Ex25
MPSRLLYPKLREKEVSWQSVTDLIAQEIHQAKAEFGPDSVAMYVSGQLLTEDYYVANKLMKGYVGSANIDTNSRLCMSSAVAAHVRAFGEDVVPVNYDDIDNTELLVICGANTAWTHPVLFRRIQQARENNPNLKLVVIDPRETVTAQQADLHLPIKNDGDVSLFNGLIKFLIEQQCIDSEYINSYTESFSALAEEVSDLRYDVTNLTSSIGISEEKLTTFFQWFAQSPTVITLFCQGVNQAENGVDKGNAIINAHLASGKIAKSGCGPFSITGQPNAMGGREVGGLANQLAVHRAFDSESIKQVQAFWDSPEIATKPGLKAVELFEAVERGEIKVLWIMATNPVVSLPDNQMVKRALEACPVVIVSDITAESDVAKYADVLLPAVGWGEKQGMVTNSERRMSRQRQFQVPPGEAKPDWWAISQVGQALCELEKAQNGFAFTSEHAVFREYAAMTGMNADSPLKLDLSQHANLTEQEYEEWVPTQWGGGRPFADGIYSHPDGKARFVVTSELPQRLERAKGWWLNTGRQRDQWHTMTRTGHIAHLAASELEPTVYMNTLSATQNRLKAGQLIKLFQPTSNTGIYAKVAIDEGLGFQELFMSMHWAGRYGGESSVNAIVNSVKDPISGQPAFKSSYVEVQDAAVKTYGMFIGTQFDSGKFLYSAFQAESNLGIWRFAHDKRPKKQSFCRTEKSRRITIDIALGWLAVDYDLVGDVRIIRSVLVVSSEPIQTDYTNFTGLIGKPMELSQLLTITQSQSSAKLVCSCFRVTDKQIHDAMEKQDCTSLTQLQNKLKCGTNCGSCVSQIKQMLDSHLHQKGKLQANQQSLAIQIK

SEQ ID NO: 7853 - protein, 615 aa, Phaseolus vulgaris
MATLTASSNLVSGSSHVHHGPTASYESKAVTMGLKSLKQTNTHNGLRILNPVDELRNRTPVKINSKATRKGLQGKNVKPKGEIICGMKLIFVGMEVGPWSKTGGLGDVLGGLPPALAAYGHRVMTIAPRYDQYKDAWDTSVVVELKVGDRTEKVRYFHCYKRGVDRVFVDHPLFLSKVWGKTGTKLYGLTTGDDYEDNQLRFSLFCQAALEAPRVLNLNSSKYFSGPYGEDVIFIANDWHTALLPCYLKTMYQSVGIFKNARVVLCIHNIAYQGRFAFTDYALLNLPDQFKSSFDFIDGHVKPVIGRKINWMKAGILESWFVITVSPNYAKELLSGPDKGVELDNILRKNEDRLIGIVNGMDVQEWNPSTDKYIAVKYDASTVLEAKALLKEALQAEVGLPVDRNIPLIGFIGRLEEQKGSDILAEAIPQFIEENVQLVALGTGKKQMEKQLQELEISYPDKARGVAKFNVPLAHMIIAGADFILVPSRFEPCGLIQLQAMRYGSVPIVSSTGGLVDTVEEGFTGFQMGSFNVECEAVDAADVDAIAKTIKRALALYGTPAFTEMIKNCMAQDLSWKGPAKKWEDVLLSLEVPGSEPGIDGEEIAPQAKENVATP

SEQ ID NO: 7854 - protein, 720 aa, Unknown
  Dehalococcoides sp. BAV1
MITANSFERTIGGRKLVIESGKLARLADAAITIRYADTELLVTLCSAKKPREGVDFLPLTIDYEERMYAAGKIPGGFIRREGRPSEQAILAGRLTDRPLRPLLPKEWRNDLQIIITVIASDKENDADIWGVVGASTVLAMSEIPYEGPVGASRIGYINGEFVLNPTFAQLESSQLDLVVVSTRKAVVMIEAGSKEIPEDIMINAIEFAHKANQELIDLQDEIRAKLGKEKLPVPVLEIPEEVKTAVAAFVKGRVNEALSHQDKTARENAVEGLQAELVAALSETFAEGDILAAYDKEIKKAIRSTILEKDIRVNGRGIKQLRQLDAETGLLPRVHGSALFTRGDTQVMAITTLGSLQESQQLDGLSAEDTKRFMLHYNFAPFSTGEVKRSGSPGRREIGHGALAERALVPILPTPEEFPYTIRLVADVVGSSGSTSMGSVCSSSLSLMDAGVPVKKAVAGISIGLITGENGTYCTITDIEGIEDNYGDMDFKVAGTRDGITAIQVDMKVKGISFDIIRDAIYQAKEARYNILDVMDKALAQPKTELSPYAPRMYKINIDPSKIGSVIGSGGKTIRSIIEQTNTTVDIENDGTVVIGAIDEASAKKAIKIIEDLTKDIEAGSIYTGKVTRIMTFGAFVEILPGKEGMVHISELADHRVEKVEDIVKVGDDITVKVIEIDNQGRVNLSHRVILNPNAVPISRNRDSQPRRPGPFRPSDRSNS

SEQ ID NO: 7855 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 7856 - protein, 818 aa, Thiobacillus denitrificans
MDMSTPMGQGPKMKLVMVGNGMAGVRTLEELLKLAPELYDITVFGAEPHPNYNRILLSPVLAGEQTVDDIILNGADWYSENGIRLHLGQKVVRIDRAAREVETADGTRARYDRLLLATGSTPFILPVAGADLPGVVSFRDIADVDAMVDAAGRYKHAVVIGGGLLGLEAANGLMKRGMDVTVVHIGPWLMERQLDEPAARLLQRSLEEKGMKFLLQKHTAELVAGASGRVTGVRFKDGDAIPADLVVMAVGIRPNTELAESAGLHCNRGIVVNDTMQTFDPRIYSIGECVAHRGVAYGLVAPLFEQAKVCANHLAHYGIGRYQGSATSTKLKVTGVDLFSAGDFMGGEGTETILYSDPIGGVYKKLVIRDDKLVGGVMVGDTVDGAWYFSLLRDGKDIGALRDHLMFGQDHCGNLGHQGINRAAAMTDDMEVCGCNGICKGDIVKAIREKGLFTLEDVRKHTKASSSCGSCTGLVEQILAVTAGGDYSAAPKTKSMCGCTDHTHEAVRAAIREHRLLTIPQAMAFLEWRTPNGCASCRPALNYYLISTWPGEAEDDPQSRFINERAHANIQKDGSYSVIPRMWGGQTTPAELRRIAEVAEKYAVPSVKVTGGQRIDLLGVKKEDLPKIWADLDMPSGHAYGKALRTVKTCVGSEWCRFGTQDSTQMGIDLEKVFYKMWAPHKVKLAVSGCPRNCAEVAIKDVGVIGVDSGWEIYVGGNGGIKTEVAQFLVKVKTPDEVLEYSGAFLQLYREEARYLDRTVHYLERVGLDYVKKKVVDDAASRCALYERLLFALSVERDPWLERAQEGKLKHEFETISA

SEQ ID NO: 7857 - protein, 337 aa, Bradyrhizobium japonicum
MLEKFARYPLTFGPTPIEKLERLSKHLGGNVEIYAKREDCNSGLAYGGNKLRKLEYIIPDAIASNADTLVSIGGVQSNHTRMIAAVAAKIGMKCRLVQEAWVPHEDAVYDRVGNIMLSRIMGADVRLVDDGFDIGIRKSWEQAIEEVKAAGGKPYAIPAGASVHKYGGLGYVGFAEEVRKQEAELGFKFDYIVVCTVTGSTHAGMLVGFAADGRARKVIGIDGSFTPAQTKAQVLSIAQNTAKLVELGKDIVADDVVLIEDYAYPAYGVPSEETKEAIRLTARLEAMITDPVYEGKSMQGLIDLTQKGYFEKGAKVLYAHLGGAPALNGYGYAFRNG

SEQ ID NO: 7858 - protein, 321 aa, Gloeobacter violaceus
MTQKYGPKTTTDEVLSGIELKGKRFLITGASSGIGLETARSLVSHGASVVGAVRNLAKAEPATASVRDAASQGGSLELINLDLASLQSVRACADKLLADGQPFDAIIANAGVMATPFGRTIDGFEVQFGTNHLGHFALINQIEPLLANDGRLVVLSSLAHRGADIDLDDPNFEQQAYDPWVAYSRSKTANSLFAVEFDRRYRDRGIRAASVMPGNSLTDLPRHLSPEDLQGLLQTVDAARTEAGLPPKELKEISQAAATSVWAAVVANKDEIGGHYLEDCAVVPIDDTPNPFADGVRSYALDANRAKQLWAKSEELISAAS

SEQ ID NO: 7859 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGIFHTEWLE

SEQ ID NO: 7860 - protein, 894 aa, Thiobacillus denitrificans
MSVVSSVCCYCGTGCGVLIEADAGVVTGVAGDPAHPANRGRLCTKGATLHLAAAAASGRARHPEFRRDRTSVRARAGWADALDHIAEKFRSVVAEHGPDAVAFYVSGQLTTEAYYVFNKLARGLVGTNNIDTNSRLCMSSAVAGYKATLGVDAPPGCYDDIEAAGTLFIAGSNTAYAHPILFRRIEAARRARPDLKLVVVDPRRTDTAAEADLHLAILPGTDVALFHAMLNVMLWEDRVDRAYIDAHTEGWTALRDLVRDYTPEKAAAICGVPAADIVTAARWFARGPTLSLYCQGLNQSTCGVDKNAALINLHLATAQIGKPGAAPLSLTGQPNAMGGREVGGMANLFSAHRELDNPEHRAEVARLWGVDALPGQPGKTAIEMFDAVRRGEIRALWIACTNPAQSLPDQARVREALAAAELVVLQDAYADTETAGFADVLLPAAAWGETDGTMTNSERRIARVRAAVPPPGEARADWEIVTDFARRLDPERGVRLFPYACAEDVFDEHRETTRGRDLDITGLSYARLDAGPQHWPFAEGAVEGRVRLYADGVYPTGSGRARFHAAPYRPVAEAIDARFPLHLNTGRLRDAWHGMSRTGRVARLFAHADAPRLAMHPRDLALRRLASGELVRVKSRRGEVVVEVEASEAVRPGQCFLPMHWGARFMSGLGANALTLPAFDAVSKQPELKHAAVQVARADLPWRMAAIAVGDGARLLDAVQPLLRACEYGAAGLAGRAHDVLTLRVGHAHPVPDELLAALDAALGLADPLTVMHYEDRPRGIAKRVRVEGGRVVAARLTGETAGFAWLRDLAVEGVDAQALRAWVLAPVAHPPAGGRVRGRVICNCFDVAEADIVAAADAGADLGALQAALKCGTECGSCVPELKRLLAASRAAA

SEQ ID NO: 7861 - protein, 363 aa, Anthurium andraeanum
MATEVMTAVPAGSRVESLASSGIQAIPLEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKADFSIWPKQPANYVEETREFGRQLRVVASKMLAMLSLGLGVEEGKLEAEVGGIEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGRPAQFPPRTFSQHIQHKLFRKTQGDFATPN

SEQ ID NO: 7862 - protein, 171 aa, Zea mays
  misc_feature (25)..(25): Xaa can be any naturally occurring amino acid
  misc_feature (164)..(164): Xaa can be any naturally occurring amino acid
MAPTVMMASSATAVAPFQGLKSTAXLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAXYKPPGSD

SEQ ID NO: 7863 - protein, 436 aa, Fulvimarina pelagi
MSQALQSQSNVHEAFFNTPLRERDSEVMDAINKELGRQSHEIELIASENITSRAVIDAQGSVLTNKYAEGYPGRRYYGGCQYVDIVEELAIERVTKLFGCNFANVQPNSGSQANQSVFLALIKPGDTILGMSLDAGGHLTHGAKPNMSGKWFNAVQYGLDLETGLIDYDALEKLADEHKPKLIIGGGSAYSRQVDFKRMREIADKVGAYFMVDMAHFAGLVAAGVHPSPFPHAHVATSTTHKTLRGPRGGIVLTNDEDIAKKINSAVFPGLQGGPLMHVIAGKAVAFGEALTDEFKSYQRSVCENAKVLAETLRAGGCDIVSGGTDTHLMLVDLRPMDLTGKASEKSLGRANITCNKNGVPNDPEKPAVTSGIRLGTPAATTRGFGTAEFREVGNLIVEVLEGLRKSNSEDNEIVEQAVKQKVIALTDRFPIYQGL

SEQ ID NO: 7864 - protein, 221 aa, Anabaena variabilis
MAEIKIYSAVVCPYAHRSRLVLQEKGIDFDLIEINLQNKPEGFTDISPYGKVPALAHGNHRVWESAVINEYLNEVFPQPPLLPSSPIAKAQARIWIDFANTRFVPAFSALLRSPDIQQQEAAKQELYKHLEFIENEGLGKLSGDGPYWFGESISLVDFTFYPWFERWPALKHYRGLALPEEFTRLRRWKKAVKQRDSVVAIANSKEFYIERYARFATPVAA

SEQ ID NO: 7865 - protein, 509 aa, Nitrosomonas europaea
MTSYLSEEAGPDLTQGISLSDFGNQPLLRGHVGDEPVILARIGDEITAVGATCTHYGAPLTEGLVVGETVRCPWHHACFSLRSGEALGAPAFDPLPCWQVERDGDRIMVRDKITPKPRSIPVAAANQPANVVIIGGGAAGFACAEMLRRRGYQGQLTMLSEDSDAPCDRPNLSKDYLAGNAPEEWIPLKSDDFYVRNRIDLQLHTTVTKINTTGHTVTTADGRIFPFDRLLLATGAEPVRLPIPGANQSHVFTLRTLADSRAIIERAKHAKAAVILGSGFIGLEAAAALRARELDVHVVSLDKHPLEKILGSEPGDFIRSLHEQHGVQFHMGTSLAHIEPHKVVLSNGKELTADLVIIGVGVRPCVSLAEAAGITVDNGILVNEYLETSVPGIFAAGDVARWRDEASGKTQRIEHWVLAERHGQIAAENMLGANTAFQDVPFFWSAHYDISIRYVGYAGPWDTLEIEGDMAAYDCLISYKTGGKTVAVAAIGRDKQALEYRALIAQQQH

SEQ ID NO: 7866 - protein, 526 aa, Streptococcus suis
MKFTDLQLSEDILLAVEKAGFETPSPIQEQTIPLALEGKDVIGQAQTGTGKTAAFGLPTLNKIDTNNQAIQALIIAPTRELAVQSQEELFKFGREKGVKVRSVYGGSSIEKQIKALRSGAHIVVGTPGRLLDLIKRKALKLDGVETLILDEADEMLNMGFLDDIEAIIERVPESRQTLLFSATMPEPIKRIGVKFMKEPEHVKIAAKELTNVNVDQYYLRVKEHEKFDTMTRLMDVDQPELSIVFGRTKRRVDELTRGLKLRGFRAEGIHGDLDQNKRLRVIRDFKNDQIDVLVATDVAARGLDISGVTHVYNYDIPQDPESYVHRIGRTGRAGQSGQSITFVSPNEMGYLAIIEDLTKKRMKGLKPATAQEAFEAKKKVALKKIEREMADETIRSNFDKFKKDAIQLAAEFTPEELALYVLTLTVQDPESLPEVEIAREKPLPFKFAPGQAKGKGGRGGRDRDRGGRRDGDRNRDRGGRRGDRNDRNRRDDKFKRDNRRQDNKKPHQRTSSEKKTGFVIRNKGER

SEQ ID NO: 7867 - protein, 482 aa, Haemophilus ducreyi
MALSKVQKVAVLLIIPTLFFCLPTPEGLSLIAWRLLGIYIATIVGLVLKPYGEPVLLLAAVAASATTIGNTEGAEQLVKVSQTLSGYQSGTTWLIFTAFTLSSAFVITGLGKRIAYHMIRLLGSTTLRLGYVTVFLDLLLAPATPSNTARAGGIVFPIINSVAVALGSEPEKTPKLAGRYLLLNVYMVVKTTSYIFLTAMAPNALALSLMLPILGFNVNWLQWLLAASVPGLLCLFLIPFICYIIAKPELKRVDNKAIAQKGLEELGPMSLREKALACLFVLALLGWVFSDFLHVNATVVALITMVLCIMLSIVSWDDIRKNKAGWDTLIWYGGIISMSTVLSKAGFFEWLATTLSENLNFGDYGNVALVVILLLSVSVRYLFASGGAYVAAMVPVFATVGKVAGAPVELLALGLLFSNSYGGSVTHYGGGPGPITFGAGYNDIKSWWMAGAVIAFGSLIIHVTLGIAWWQFLFNMWLPMAK

SEQ ID NO: 7868 - protein, 510 aa, Trifolium pratense
MSLWIIVFVTIVAAILINRLLNLIKKPTLPLPPGPSPWPIVGNLPHMGPVPHHALAALALKHGPLMHLQLGFVDVIVAASASVAEQFLKVHDANFSSRPPNSGAKYIAYNYQDLVFAPYGPRWRLLRKISYVHMFSSKALDDFRHIRQDEVARLIRNLSNSGSKAANLGQMLNVCTTNALARVMIGRRVFNEGNGGCECDPRADEFKSMVVELMVLAGVFNIGDFVPSLEWLDIQGVQSKMKKLHKRFDSFLTSIIEDHMVSKSEKHNDLLSTLLSLKEKVDEDGDKLNDTEIKALLLNMFTAGTDTSSSTTEWAIAELIKNPKLMIRIQNELDTVVGRDRLVTEQDLTHLPYLEAVIKETFRLHPSTPLSLPRVATNSCEIFNYHIPKGATLLVNVWAISRDPKEWTNPLEFKPERFLPGGEKFDVDIRGNDFEVIPFGAGRRICAGMSLGLRMVQLLTATLAHAYDWELENGLSPEKLNMDEAYGLTLQRAVPILAHPRPRLSPHLYL

SEQ ID NO: 7869 - protein, 413 aa, Brassica napus
MKRPLTTSPSSSSSTSSSACILPTQSETPRPKRAKRAKKSSLRSDVKPQNPTSPASTRRSSIYRGVTRHRWTGRYEAHLWDKSSWNSIQNKKGKQVYLGAYDSEEAAAHTYDLAALKYWGPNTILNFPVETYTKELEEMQRCTKEEYLASLRRQSSGFSRGVSKYRGVARHHHNGRWEARIGRVFGNKYLYLGTYNTQEEAAAAYDMAAIEYRGANAVTNFDIGNYIDRLKKKGVFPFPVSQANHQEAVLAETKQEVEAKEEPTEEVKQCVEKEEAKEEKTEKKQQQEVEEAVITCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTATTVTSVSWNYSV

SEQ ID NO: 7870 - protein, 800 aa, Triticum turgidum
MSWCCACKVLASPGPLHHFLGISPVSVYSICPLQGQIPPSLGNCFALRRLNLSFNSLSGAIPPAMGNLSKLVVMGISNNNISGTIPPFADLATVTVFSISSNYVHGQIPPWLGNWTALKHLDLAENMMSGPVPPALSKLVNLQYLDLAINNLHGLIPPVLFNMSSLDFLNFGSNQLSGSLPQDIGSILPKLRVFSVFYNKFEGQIPASLSNISCLEQVFLHGNIFHGRIPSNIGQNGYLSVFVVGNNELQATGSRDWDFLTSLANCSSLFIVDLQLNNLSGILPNSIGNLSQKLETLQVGGNQISGHIPSDIGKLSNLRKLFLFQNRYHGEIPLSLGNMSQLNKLTLSDNNLEGSIPATIGNLTELILLDLSFNLLSGKIPEEVISISSLAVFLNLSNNLLDGPISPHVGQLASLAIIDFSWNKLSGAIPNTLGSCAELQFLYLQGNLLNGEIPKELMALRGLEELDLSNNNLSGPVPEFLERFQLLKNLNLSFNHLSGPVPYKGIFSNPSTVSLTSNGMLCDGPVFFHFPACPYPVPDKPARHKLIHILVFTVAGAFILLCVSIAIRRYISKSRGDARQGQENSPEMFQRISYAELHLATDSFSVENLVGRGSFGSVYKGTFGSGANLSTAAVKVLDVQQQGATRSFISECNALKRIRHRKLVKVITVCDSLDHSGSQFKALVLEFIPNGSLDKWLHPSTEGEFLTPNLMQRLNIALDVAEALEYLHHHIDPPIVHCDVKPSNVLLDDDMVAHLGDFGLSKIIRAEESRQSLADRSSSVGIKGTIGYLAPGMMFPSYST

SEQ ID NO: 7871 - protein, 163 aa, Zea mays
  misc_feature (37)..(37): Xaa can be any naturally occurring amino acid
  misc_feature (60)..(60): Xaa can be any naturally occurring amino acid
  misc_feature (106)..(106): Xaa can be any naturally occurring amino acid
  misc_feature (127)..(127): Xaa can be any naturally occurring amino acid
  misc_feature (146)..(147): Xaa can be any naturally occurring amino acid
MFRRAATCYRLIINNAYPKTEYCRDVPDPNSRIYHEXMKITTADEVPYCVHLVSCDNDNXYSEALEDDQYYVCNKYMSKLATHDAFHLTCRPRPLHVLHIIEMLAXVGADKLHTATRCASGKTHATXAMTHPDQDLLSDRCHHDNXXHARENLLLAQLLFPGR

SEQ ID NO: 7872 - protein, 231 aa, Populus suaveolens
MVLAGSNSFSADKQESSLSSLLSDSSGSQQDSPCSNEKVLLAASRPKKRAGRRIFKETRHPIFRGVRKRNGDKWVCELREPNKKSRIWLGTYPTPEMAARAHDVAALAFRGKSACLNFADSAWRLPAPISNEAKDIRRAAGEAAELFRTSDLGGQVMEDFTTEGRGEVCSSSNDDIRDLPSENVSYIDEEAEFNMPWLLANMAEGLLLSPPHYTGDWNDGEIDADWSLWSS

SEQ ID NO: 7873 - protein, 301 aa, Unknown
  Vibrio sp. Ex25
MEAPYQKSWFKKGQADQSQERSSRFSKHDQASKLNQLLENHSEDLDANHKGFVSIVGAGPHDPDLLTVKAVKAIISAEVLLYDRLVNKDILELASPQADWIYVGKRCGQPSIGQEEICNLLVSLALQGKRVVRLKGGDPFVFGRGGEEALALVKHSIAYEVIPGITAAIGCSANSLIPLTHRGVARSVTFVTGQVVTGAFEAWSQLMQSGQTLVFYMGLEKSADIQIGLVGAGLNQDFPVAVITHGCSPQQQVHVTQLNQLNELSITLKGISPALIVMGEVVKLREQLIETVQSVTEYEGI

SEQ ID NO: 7874 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALSNEYENQQHRTTVSIGMDPELDQFMEAYCEMLTKYHEEL

SEQ ID NO: 7875 - protein, 568 aa, Saccharomyces cerevisiae
MPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKILANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVNTPTPEFQPLLKKNQVGY

SEQ ID NO: 7876 - protein, 565 aa, Saccharomyces cerevisiae
MKRTVISSSNAYASKRSRLDIEHDFEQYHSLNKKYYPRPITRTGANQFNNKSRAKPMEIVEKLQKKQKTSFENVSTAMHWFRNDLRLYDNVGLYKSVALFQQLRQKNAKAKLYAVYVINEDDWRAHMDSGWKLMFIMGALKNLQQSLAELHIPLLLWEFHTPKSSLSNTKEFVEFFKEKCMNVSSGTGTIITANIEYQTSELYRDIRLLENEDHRLQLKYYHDSCIVAPGLITTDRGTNYSVFTPWYKKWVLYVNNYKKSTSEICHLHIIEPLKYNETFELKPFQYSLPDEFLQYIPKSKWCLPDVSEEAALSRLKDFLGTKSSKYNNEKDMLYLGGTSGLSVYITTGRIRTRLIVNQAFQSCNEQIMSKALKDNSSTQNFIKEVAWRDFYRHCMCNWPYTSMGMPYRLDTLDIKWENNPVAFEKWCTGNTGIPIVDAIMRKLLYTGYINNRSRMITASFLSKNLLIDWRWGKRWFMKHLIDGDSSSNVGGWGFCSSTGIDAQPYFRVFNMDIQAKKYDPQMIFVKQWVPELISSENKRPENYPKPLVDLKHSRERALKVYKDAM

SEQ ID NO: 7877 - protein, 359 aa, Medicago truncatula
MLKSHKDWPEPIIRVQSLSEGCKDSIPDRYIKPPTDRPIVDTSSYDDINIPIIDLGGLNGDDLDVHASILKQISDACRDWGFFQIVNHGVSPDLMDKARETWRQFFHLPMEAKQQYANSPTTYEGYGSRLGVEKGAILDWSDYYFLHYLPVSVKDCNKWPASPQSCREVFDEYGKELVKLSGRLMKALSLNLGLEEKILQNAFGGEEIGACMRVNFYPKCPRPELTLGLSSHSDPGGMTMLLPDDQVAGLQVRKFDNWITVNPARHGFIVNIGDQIQVLSNATYKSVEHRVIVNSDQERLSLAFFYNPRSDIPIEPLKQLITPERPALYPAMTFDEYRLFIRMRGPCGKSQVESMKSSK

SEQ ID NO: 7878 - protein, 946 aa, Candida albicans
MISIVNGTSTLSLVAGSVETLNQAINFYTNILGLSVHSEQNDWTYLSNDDNKMIVKIQLDTKSGLSLDQINDRRTEIIAKLNITDWRSLDTTSVLKVQNLVALIETLTTFNYTLQITPNELYPNEVYCVDPLGYIIGFTACDEPLTLVPPLQKSHPKPGLVSNLMSKSGSQSRNIEETKAVRRNIAVMTSGGDSQGMNAAVRAVVRATIFHGSKAFAVQEGYAGLVKGGPEYIKEMKWQDVRGFLSEGGTNIGTARCMEFKERWGRLKGCKNLIDAGIDGLIVCGGDGSLTGADLFRHEWPSLIQELKDKGEITNEQFERHKHLYICGMVGSIDNDMAMTDATIGGYSALERICRAIDYIDATANSHSRAFVVEVMGRHCGWLALMAGIATSADYIFIPEKPASSKDWQDQMCDIVGKHRAQGKRKTIVIVAEGAITSDLKPITSDEVKDVLVDRLGLDTRITVLGHVQRGGTAVAFDRTLATLQGVEAVKAILELTPDVPSPLIAIDENKICRRPLVEAVRITKSVASAIEAKDFEKAMSLRDHEFKEHLANFMAMNTANHEKPTLPREKRKKIAIINIGAPAGGMNSAVYAMATYCMSRGHTPYAIHNGFAGLSRHESVKSIEWIDIEGWNSIGGSEIGTNRQTPEETDIGMIAHYFEKYQFDGLIIVGGFEAFVSLEQLERSRAMYPSFRIPMVLIPATISNNVPGTEYSLGADTCLNSLMEYCDIVKQSASATRGTAFIIDVQGGNSGYIATFASLISGAQASYVPEEGISLQQLEMDINSLREAFAVEQGMTKSGKLIIKSSNASKVLTPHTLADIFNDECHGDFDTKTAIPGHVQQGGLPSPIDRSRGDRFAIRAVQFIEDHCDVLAPYRYELDFPIDDKKILNTAAVLGIKSSRLRFTSIRHLFDFETELGRRMPKTIYWNTIRDISDQLVGRTRLDKP

SEQ ID NO: 7879 - protein, 418 aa, Psychrobacter arcticus
MFKDISIKDFDPVLAKAMAAESVRQENHIELIASENYCSQAVMEAQGTDLTNKYAEGYPGKRYYGGCEHVDVVEQLAIDRAKELFGAEYVNVQPHSGSQANSAVFLALLEANDTVLGMSLDAGGHLTHGAHINFSGLNYNAVQYGLVEGTGLIDYDQVESLAKEHKPKMIIAGFSAYSQVVDWARFREIADEVGAYLLVDMAHVAGLIAGGVYPSPVPFADVVTTTTHKTLRGPRSGMILARDEKLAKKLNSAVFPGNQGGPLMHVIAAKAICFKEALENNFKTYQQQVVKNAQAMAKVIQERGYEIISGGTENHLMLISLVKQEMTGKEADKWLGDAHITVNKNAVPNDPKSPFVTSGIRIGTPAITTRGFNEAQAGALAGWICDVLDSRGDEAATAEVRSKVEAICKELPVYAKNQ

SEQ ID NO: 7880 - protein, 522 aa, Triticum aestivum
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 7881 - protein, 174 aa, Triticum aestivum
NNHSKSSPTKQSPRNNPSSPLPFRSVPFQSTHPGRTPARPAGWISEQAALLGLRCETPSCSGATPPWAAGSTSYGSSSGRRSFLAQAATAKQRRAPAPAGNGGKSDGGGYFGPEAAVVLALMTAALLVLPLLLPPLPPPPPLFLFVPVAILAVLLLLVLLPSDARGLRVAPSYL

SEQ ID NO: 7882 - protein, 336 aa, Streptomyces coelicolor
MSKPVKAAVFGTGSWGTAFGTVLADAGCEVTLWGRRAALADAVNSTRTNPDYLPGVELPENLRATTDAAEAARDADFTVLAVPSQTLRAGLADWTPLLAPGTVLVSLMKGVELGSAMRMSEVIGDVAKVGAERIAVVTGPNLAREIAARMPAAAVVACPDETVAQRLQAACHTPYFRPYTNTDVVGCELGGAVKNVIGLAVGIADGMGLGDNAKGSLITRGLAETTRLGVALGADPLTFSGLAGLGDLVATCSSPLSRNHTFGTNLGKGMTLEETNAVTKQTAEGVKSCESVLDLARRHGVDMPITETVVAIVHEGKSPVVAVKELMSRSAKPERR

SEQ ID NO: 7883 - protein, 613 aa, Alkaliphilus metalliredigenes
MCGIAGWIDYQRDLRDENPIIERMTASLGHRGPDTKSSYISKHGLLGHRRLIVVDPSGGAQPMTKRLGEKTYTMVYNGELYNTEDLRKELKDKGHTFNSYSDTEVLLVAYMEWGENCVQHLNGIYAFGIWNEVEKTVFLARDRLGVKPLFYNLKNGGLFFASEIKALLAHPEIDPVVTTEGLCEVFGLGPARSPGNGVFKDINEIKPGYCLTYTPQGVKIKSYWQLESKPHEDSLGDTIENVRGLLIDAIERQLVSDVPICTFLSGGLDSSAIASVTANAFKRDGRGQLHTYSIDYVDNDQYFKPSEFQPNADSEWIGRMVSHIDSKHHDIIIDTPQLTEALEAAVLSTDLPGMADVDSSLYLFCKNVKQNDTVALSGECADEIFGGYPWFRRREDIEANTFPWSKATTERRNILSGDLRKLPLEEYVATKYEETLREVPRMKGESLETHRMREIFYLNMKWFMITLLNRKDRMSMANGLEVRVPFADHRIVEYAWNIPWEMKYLGQREKGLLRSALKDILPEDVRTRKKSPYPKTHNPAYLKAVQQWMGEIMQDPSSPILQVINQEKVKEIVETGGKSFGKPWFGQLMTGPQLIAYLIQVNLWMKHYNVSIE

SEQ ID NO: 7884 - protein, 378 aa, Thiobacillus denitrificans
MQPILIVGSGLAGYTLLKEIRKRDSTTPVTLVTADDGVFYSKPNLSNALAAGKSAAALAGASPEKMAADFGATVKPRTRVLAIDTTRRRVQTDQGELGYGKLVLALGADPIPHGLSGSAAGDVLAVNDLADYAAFRRAIEGKRRVAVLGGGLIGCEFANDLAQAGFAVDVVHLGAWPLERLIPPEAGERLADSLAALGVTWHFGRSAKSVEPDAGGYRLVLDDGSAVVAEVVLSAIGLRPRVQLAQAAGMQVGRGIRADRLLETSAADVYALGDCAEVDGANLPFVQPLLVQARALAATLTGTPTAVAYPAMPVMVKTPAQPVAVLPPKAGVAGGWQVDCGEGGVCALHLGKAGEMQGFVLTGSETGRRTALLKQLAA

SEQ ID NO: 7885 - protein, 839 aa, Unknown
  Vibrio sp. Ex25
MNSPLTIPVKNALSHIVVVGNGMVGQHLVEQLVQKNAHLEHRITVIGAERFIAYDRVQLSSLFAGKSHDDLMLSNQEWYDMHGIQLVLGSQVTGIDREQKRILLDGEDVLGYDQLVLATGSYPFVPPIEGKDRDNVFVYRTLDDLSQIKKACEGAKTGAVIGGGLLGLEAANALKLLGLETHVIEFAPRLMPVQLDDGAGLVLKEKIEALGLTVHTSTGTERICDGETAKHRMVFKDKDPLEVDVIVFSAGIRPQDELARLAELEVGERGGIVINNQCQTSDENIYAIGECALWEQKIFGLVAPGYTMARTTADVLTGMPSEGFKGADMSTKLKLLGVDVASIGDAQMQTEGAQEMVLQDAVAGIYKKLVVDASGTQLLGAILVGDNSDYDALLQCYLNKTVLPEHAANLLFDTGMLDGEMPDSAIICSCHNVTKGDLVAEIQAGTTNLTDLKANTKAGTGCGGCSNMVKSVLDTQLAAMGVEVNNHLCEHFELSRQEMFHICQVEQIKDFDTLIALHGKGHGCDICKPTAASVFASLWNEHIMEPQHQSLQDSNDAFMANLQKDGSYSIVPRVPGGEITPDKLIVLGEVAQQYDLYTKITGGQRVDLFGAQLEQLPEIWQTLIDAGFETGHAYGKSVRTVKSCVGSTWCRYGVDDSVGLAIELENRYKGLRAPHKLKFAVSGCTRECAEAQSKDIGVIATENGWNLYVCGNGGMRPRHADLFASDLSKSELITMIDRVLMFYVSTADRLQRTSVWMENMEGDLDYLKQVILDDSLNLCDSLDEQMARVVDTYQCEWKSTLDNPQKLQRFRPFLNSTSGSKVLPYQRVRGQRIPVKQEV

SEQ ID NO: 7886 - protein, 150 aa, Medicago sativa
MVPQNMKEQLALAVRSIQWSYVIFWSESVNQPGGLSWGEGYYNGEIKTRKTSQGVELSSDEIGLQRSEQLRELFRSLKTVDANPQIKRPSAALSPDDLTDTEWYYLVCMSFVFNIGQGLPGRALENGQPIWLIDADSVDCKVFSRALLAK

SEQ ID NO: 7887 - protein, 227 aa, Triticum aestivum
MDTHVGSVDGPSPAAVNGAVGCPASAPGCPIMSSHPVVSAGEASLGRHLARRLVQVGVSDVFAVPGDFNLTLLDHLVDEPGLRLIGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFL

SEQ ID NO: 7888 - protein, 379 aa, Cytophaga hutchinsonii
MAKRDYYEVLEITKSASADEIKKAYRKLAIKFHPDKNPDNPEAEEKFKEAAEAYEVLSTPEKRQRYDQYGHQAAGGGGYGGGMNMDDIFSQFGDVFGSGGSPFESFFGGGGGGRGRGVRKGSNLRIKLKLNLEEIANGCEKKIKVKRQVACDECSGTGAKNGAVQKCGTCNGTGQVKRVVNTMLGQMMSATTCPTCNGEGTTIKDKCTSCHGQGTVEKEETITIKIPAGVVDGMQLSMSGKGNMPPRGGVAGDLLILIEEIEDEQLKRDGLNIIYELYVTFFDAVFGTSVEVPTVDGKVKIKIEPGTQSGKILRLRSKGLKDVNSYQKGDQLIYVNVWTPQTLSKEEKELLATIKESENFKPNPGKNDKSFFERMKEFF

SEQ ID NO: 7889 - protein, 493 aa, Unknown
  Synechococcus sp. CC9605
MAALQIVWFKRDLRIVDHQPLAAAVERGLVLPLYVVEPELWRQPDASERQWMFCRESLLELRQALADRGQPLVVRAGDVVQVLERARRQFGIDGLWSHEETGNGWTYQRDKRVGAWARRHGIAWMELPQFGVTRRMHSRNGWAKRWEVQMTEPITPVPAALQALDGIDHGVIPERPCSELLLDACPQRQIGGRSTGLEELNDFLQHRAQRYQRSMSSPNTAFTGCSRLSTYLTWGCLSMREVLQTSRTHSGRGVSSFESRLHWHCHFIQKLEDQPAIEFSDFHPFMRGIRAADAERLTAWSEGRTGVPFVDACMRALRAHGWINFRMRAMLMSFASYNLWLPWRDSGLHLARQFVDYEPGIHWSQCQMQSGSTSINTIRIYNPIKQGMDHDPQGLFIRQWCPELKDVPTIHIHEPWMLGGGMPAPIVDVTASMQDAKDRIWDIRRSAGFDRHADAIQCKHGSRKAGLKPTTARRRRRQPQPPDNGSQQLSLGF

SEQ ID NO: 7890 - protein, 694 aa, Thiomicrospira crunogena
MSKFIKSFQYGKHEVRFETGEIARQADGAVMVAMGDTQLLVTVVGAKNAKAGQDFFPLTVQYQEKAYAAGRIPGGFLKREGRPSEKETLTSRLIDRPIRPLFPKGFMNEVQVIATVVSLDPEIGTEVPAMLGTSAALSISGIPFDGPIGAAVVGYKDNDYILNPSSQELQESDLELSVAGTSDAVLMVESEASELSEEIMLGAVMFGHEQMQVAIDAIKELKAEVGKPAWNWEAAEEDIDLKTKVFDAIRSDIEAAYDIADKMDRYAAIDAAKTKVMEALAATEENPEGYDAGDIEKMVGKLQKEIVRGRIIAGEPRIDGRDTQTIRSIDCQVGILPKVHGSALFTRGETQAIVVTTLGTEKDAKMVDDLTGSYNDRFMLHYNFPPYSVGECGRVGSPGRREIGHGMLARRGVAALLPTADEFPYTIRVVSEITESNGSSSMATVCGTSMSLMHAGVPLAAPIAGIAMGLVKEESGFAVLSDILGDEDHLGDMDFKVAGTEQGVTALQMDIKITGITQEIMHIALKQAKEGRLHILKEMEKAIGSSNQDVATTAPRFFTVKVKPEKVREIIGKGGATIRSITEETGVTIEIDDDGNVKIAAVDDESANAAKARIAEITAEPEIGKVYDAKVVKIVDFGAFVSYMPGREGLVHVSQIADERVEDVNEYLKEGQEIKVRLTDVDKQGRVKLSIKAV

SEQ ID NO: 7891 - protein, 582 aa, Unknown
  Chrysanthemum x morifolium
MSHATLSSSTLWANPKTTLTCIPKPPSSIRISSSKKSKQIKCALQSHSITSFPKESPFELPKSNFPDSWNIFQKISALALDAVETSLIKQEQKHPLPKTANPDIQISGNFAPVPEQPVRHHLPVQGTIPRHIDGVYLRNGANPLFEPISGHHLFDGDGMIYAVKFDQGEASYACRFTETQRLVQERAIGKPVFPKAIGKLHGHSGIAKLLLFYARGLCGLVDHSHGIGVANAGLVYFNNRLLAMSEDDLPYEVKVTSNGDLKTVGRYNFDEQLKSTMIAHPKVDPVSGELFALSYDVVKKPYLKYFRFSPDGVKSKDVAIDLGKPTMVHDFAITENYVVVPDHQVVFKLSEMITGGSPVVYDKEKVSRFGVLDKYAEDGSGIKWVEVPDCFCFHLWNAWEEPENDEVVVIGSCMTPADSIFNESNEELKGVLSEIRLNLKTGKSTRRPIIAPENDVNLEAGMVNKNLLGRKTKFAYLAIAEPWPKVSGFAKVDLQTGETKKFIYGDEKYGGEPLFLPRDPNSEAEDDGHILAFVHDEKTWKSELQIVNAMTLELEAVVKLPSRVPYGFHGTFISAKDLATQA

SEQ ID NO: 7892 - protein, 65 aa, Zea mays
MTSRICSCMRDLMLLECYGMECAYDDGYLKRLAGFSCLTWEPDGVAGMCTDCSLVCDDGHEIVEL

SEQ ID NO: 7893 - protein, 629 aa, Agrostemma githago
EKLSPDHGFPVRMIIPGFIGGRMVKWLKRIIVAPVESDSYYHYRDNRVLPSHVDAELANSEAWWYKTEYIINELNINSVITTPCHEEILPINAWSTQRPYTLRGYAYSGGGKKVTRVEVTMDGGETWRIAELDIQQKGSKYGKYWCWCFWSLEVEVLDLLGAKEIAVRAWDQTHNTQPEKLIWNVMGMMNNCWFRVKTNVCKPHKGEIGIVFEHPTQPGNKPGGWMARERHLELTVPGGNNLKRTSSTPFMNTNSKMFSMSEIKKHNSAESAWIVVHGHVYDATRFLKDHPGGSDSILINAGTDCTEEFDAIHSDKAKKMIEDFRIGELITTGYQSDSTSSSPGNSVHGGSLMSSLAPITEIDPFRNVALKAREKIPCKLIEKVSLSHDVRRFRFALPSKDQVLGLPCGKHVFVCASVDDKLVMRAYTPTTAIDEVGYFDLVVKVYFRDQHPRFPNGGVMSQHLDSLPLGSIIEVKGPLGHIEYLGKGNFMVHGKPKFAKKLTMICGGTGITPIYQVMKAILKDEDDDTEMHVIYANRTIDDILLRPELEKWAIEYKERVKLWYVVEKGNEEWKYDVGFINEKILRDHVPESGEHVLALTCGPPPMIQFAVQPNLEKMGYDVKEQLLIF

SEQ ID NO: 7894 - protein, 449 aa, Bacillus cereus
MISIGGVIGAGLFVGSGAVVHSAGPGSIVSYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAIVVTLLPWNSANILKSPFVAVLEHIGIPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLNIRKKMGRVEQQNLKVKMWFFPYVTYVTIAAIIAVLIAMLAIESLRSQALLTMFVTVLIIISYFIFNRNKNSTVLNTKSKNEESIRF

SEQ ID NO: 7895 - protein, 320 aa, Anabaena variabilis
MKIARNITELVGRTPLVRLNNIPQAEGSVADIVVKLESMNPSASVKDRIGVSMVESAEEAGLIHPGKTILVEPTSGNTGIALAMVAAAKGYHLILTMPETMSTERRSMLRAYGAQLELTPGLEGMRGAIARAEQIVTELPNAYMLQQFRNPANPKVHRQTTAEEIWSDTDGQVDIVVGGVGTGGTLTGVAQVLKERKPSFQAIAVEPSNSQVLSGGKSGAHKIQGIGAGFIPAICRLELIDQIIAVSDEDAIAYSRRLAREEGLLSGISTGAALYAAIQVAKRPENSGKLIVMVQPSFGERYLSTTLFKDLSELEISALN

SEQ ID NO: 7896 - protein, 552 aa, Oceanobacillus iheyensis
MLHATWYWMWEKHDQVKDLFRLFVNPNEIIEKNKKDSTPSSTTSNSNNGDDGGNNRQYNKAQLIGLFLGPISFILTLLFFSPEGLSSEGQAVLASTIWIAIWWMTEAIPIPATALLPIILFPLTNGLDIGATTSAYGSDTIFLFMGGFVIALAMERWNLHRRIAISIISVIGTNTDRIILGFMVATGFLSMFISNTATAMMMVPIGLAIIYQVSDTLKEQGGFDTSPENFSFGKSLMLGIAYSASIGGMATLIGTPPNVIFAGTINTMYGIEVSFASWMMFGVPFAWIFIFLTWFYLSKIAFKLEVSHIPGGAKIIKEEKKKLGNASYEEKAVFVVFILAAIAWISREFLLGPYVSENINDAIIAITAALVLFLIPAKNKKGDFLMNWESAIKLPWGILLLFGGGLAIAAGFTDSGLSDWIGEQLTGLENVAPIIIILSIAALVIFLTEITSNTATATMMFPIMAALAVAVGVHPFILMIAAALAASCAFMLPVATPPNAVVFGSGYLRIPDMAKAGFFLNIVGIILVTLTVYFLVPMALGIDINEIPAYVE

SEQ ID NO: 7897 - protein, 959 aa, Unknown
  Photobacterium sp. SKA34
MTNTTFLQALSDDNDFSHRHNGPNALEQQRMLETIGVGSIDQLIAQTVPASIRLTEPMTLPQAQSEAAMLAELKQIAGKNIINKSYIGQGYYNTFTPNVILRNVLENPGWYTAYTPYQPEISQGRLESLLNYQQMIMDLTAMELANASLLDEATAAAEAMTLCKRAGKNKSNAFFISTDLHPQTIDVVTTRAKYIGFEIITGSVEDLAKHDVFGALLQYPASNGELKDLTDIIDAAHDKKTLVAVASDLLALTVLKAPGEMGADVVIGSAQRFGVPMGFGGPHAGFMATKDKHKRTMPGRVIGVSKDAKGNQALRMAMQTREQHIRREKATSNICTAQALLANMAAFYALYHGPEGLKKIGRRVHHFTAVLAAGLRNNGFELENQHFFDTLTIKTGTKTNTLYQKALDAGVNLRKYSDKLGVSIDETTLAEDIEQLLGLFTNQDLKVSMFSDDIAADEFAAIPPACRRSSAYLTHSVFSRYHSETQMMRYMKQLENKDYSLTHGMIPLGSCTMKLNAVAEMIPVTWPEFGQLHPFAPQAQTLGYQELAKNLSEMLCSITGYDAFSLQPNSGAQGEYAGLIAIQRYHEANGDSHRNVCLIPSSAHGTNPASAAMVSMKVVVVGCDELGNIDINDLKAKIEKHRDALSCIMITYPSTHGVYEEAVQEVCDLVHEAGGQVYLDGANMNAQVGLTSPGFIGSDVSHLNLHKTFCIPHGGGGPGMGPIGVKSHLTPFLPGHVEGTNSDEQQYAVSAAALGSASILPISYAYIAMMGEQGLTQATELAILNANYVMERLRPHYPVLYRGTEGRIAHECIIDLRPIKDASGISEEDIAKRLMDYGFHAPTMSFPVAGTLMIEPTESEDIAELDRFCDAMIAIKEEINLVQSGEWPLDDNPLVNAPHSQVDMMESEWNHAYSREVACFPSAHTKAAKYWPSVNRVDNVFGDRNLVCSCPSIENYIED

SEQ ID NO: 7898 - protein, 283 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLTFLLLIVNKNLLQDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 7899 - protein, 447 aa, Corynebacterium glutamicum
MTVDEQVSNYYDMLLKRNAGEPEFHQAVAEVLESLKLVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKATPEAVEVFRERDIRFGPGKAVNVGGVATSALEMQQNASRETCAETAAEYGHENDYVVGANIAGFKKVADAMLAQGVI

SEQ ID NO: 7900 - protein, 736 aa, Thermosynechococcus elongatus
MGTPQISALAVQSGPYLHHNHNTSERMQPTETVSSLCPYCGVGCGLEAVPQGKGTYKIRGDRQHPSSQGMVCVKGATILEAIDRDRLAYPLWRERLDHPFTVISWDEALTRLVERIQWVRHEQGADAICMYGSGQFHTEDYYVAQKLMKGCLGTNNFDANSRLCMSSAVSAYMASFGADGPPCCYDDLEATDCAFLIGTNTAECHPIVFNRLRNHHKRDRRVKLIVVDPRRTPTAEVADLHLAIRPGTDIDLLHGIGYLLLQWGHIDVDFIEKCTEGFADYVKLLAAYTPEWVAQRCGIPESDLEQAARYWGHAQAVLSLWSMGINQSAEGTAKARCLINLHLLTGQIGRPGSGPFSLTGQPNAMGGREAGGLSHLLPGYRQVTNPQHRQEVEDFWGLPRGQISDRPGRTAWQIIEGLEQGEVGLLWIAATNPAVSFPHLERTKAAFLKSPFTVYQDAYFPTETAAYAHLILPAAQWSEKTGVMTNSERRVTLAPAFRVPPGLARSDWEIFAEVGRRLGYGHLFSFADAAAVYAEFVQLTAGRPCDQSGLSHERLARLGALQWPCPASMDDEEARKPKRLYTDWRFHTPNQRAYFCLAHSQGVAEPTDHIYNFTLTTGRLYGHWHTQTRTGRIAKIQKMHPNPFVEMHPEDAANLHLQDGDWVEVRSRRGQVCLPVTLTKAIRPGTLFVPMHWGFLFADSGEVNQLTHPIACPVSKQPELKACAVQVLPLKLQQTS

SEQ ID NO: 7901 - protein, 240 aa, Haemophilus influenzae
MAQVSMRDMINAGVHFGHQTRYWNPQMKPFIFGARNGVHIINLEKTLPLFNEALAELTRIASNNGKVLFVGTKRAASEAVQAAALDCQQYYVNHRWLGGMLTNWKTVRQSIKRLKDLETQSQDGTFDKLTKKEALMRSREMEKLELSLGGIKDMGGLPDALFVIGADHEHIAVKEANNLGIPVFAIVDTNSTPAGVDFVIPGNDDATRAIQLYVSAAAAAVKEGRGNEAQVAEELAADAE

SEQ ID NO: 7902 - protein, 203 aa, Mycobacterium tuberculosis
MGHHHHHHHHHHSSGHIEGRHMTSNQKAILAGGCFWGLQDLIRNQPGVVSTRVGYSGGNIPNATYRNHGTHAEAVEIIFDPTVTDYRTLLEFFFQIHDPTTKDRQGNDRGTSYRSAIFYFDEQQKRIALDTIADVEASGLWPGKVVTEVSPAGDFWEAEPEHQDYLQRYPNGYTCHFVRPGWRLPRRTAESALRASLSPELGT

SEQ ID NO: 7903 - protein, 699 aa, Unknown
  Shewanella sp. MR-7
MNPIVKSFEYGQHTVTLETGVIARQADAAVLASMGDTTVLVTVVGKKEAEAGRDFFPLTVNYQEKTYAAGKIPGGFFKREGRPSEDETLIARLIDRPIRPLFPNGFTNEVQVIITVVSVDPQIEPDIISMIGTSAALAISGIPFSGPLGAARVGYINGEYVLNPTVTQLANSQLNLVVAGTEGAVLMVESEAQALPEEVMLGSVVYGHDQQQVVIKAIAEFKAEAGKPAWNWTAPVANEALVAQVKELAEAGLAQAYQIQVKQERYAQVAVVKAAAKEALLAANPEVDLREVDGLLGSLEKKVVRGRIIRGEPRIDGREPDMVRALSVLAGVLPRTHGSALFTRGETQALVTCTLGTERDAQKIDSIMGERTNRFMLHYNFPPYSVGETGMVGSPKRREIGHGKLAWRGINAVMPTAEEFPYSVRVVSEITESNGSSSMASVCGTSLALMDAGVPIKTSVAGIAMGLVKEGDNFVVLSDILGDEDHLGDMDFKVAGTRDGVTALQMDIKIEGITKEIMEIALQQAYGARVHILNVMDQAIGSHRDDISDHAPRITTIKINPEKIRDVIGKGGAVIRALTEETGTTIELEDDGTVKIASSNGEATKEAIRRIEEITSEVEVGRIYNGKVIRIVDFGAFVNILPGKDGLVHISQISDERVANVSDHLELNQEVTVKVMEVDRQGRVRLSIKEAQTKEAAAE

SEQ ID NO: 7904 - protein, 450 aa, Unknown
  Synechococcus sp. RS9916
MKRDDAAKMPHLTMTSQAVPEPSAELLRLATGVRRAAIDLGQTTDQQRQQALETMAAALERHREQIAAANAADLEQAAADGLAPALVSRLKLDQDKLAGAIEGVRQVAALEDPLGSRQLHRELNEGLVLERITVPLGVLGVIFEARPDAVIQIASLAIRSGNGAILKGGREANRTNQAVMEALKEGLADSVVSADALALLTTRQESLALLRLDGLVDLIIPRGSNELVRFIQDNTRIPVLGHADGVCHLFIDTEADCAQALRIAIDSKTQYPAACNAIETLLVHEAIAPQFLADAVPAFAAVGVALRGDEASCALGVPHPVTEADWSTEYLDLILAVRVVPDLESALEHIRRYGSRHTEAIATTNGTTAERFLRAVDSAGVYHNCSTRFADGFRYGFGAEVGISTQTLPPRGPVGLEGLVTYRYRLRGDGHIAADFASGARQFSHRNLPL

SEQ ID NO: 7905 - protein, 944 aa, Triticum turgidum
MVETRPWLLRLLALLTTTTALLLSPSTSTSSSISTVDDLPALLSFKSLITMDPLGALSSWAINSSSNSSTHGFCSRTGVKCSRTHPGHVMVLRLQDLATVTVFSISSNYVHGQIPPWLGNWTALKHLDLAENMMSGPVPPALSKLVNLQYLDLAINNLHGLIPPVLFNMSSLDFLNFGSNQLSGSLPQDIGSILPKLRVFSVFYNKFEGQIPASLSNISCLEQIFLHGNIFHGRIPSNIGQNGYLSVFVVGNNELQATGSRDWDFLTSLANCSSLFIVDLQLNNLSGILPNSIGNPSQKLETLQVGGNQISGHIPTGIGRYYKLTMLEFADNLFTGTIPSDIGKLSNLRKLFLFQNRYHGEIPLSLGNMSQLNKLTLSDNNLEGSIPATIGNLTELILLDLSFNPLSGKIPEEVISISSLAVFLNLSNNLLDGLISPHVGQLASLAIIDFSWNKLSGAIPNTLGSCAELQFLYLQGNLLNGEIPKELMALRGLEELDLSNNNLSGPVPEFLERFQLLKNLNLSFNHLSGPVPYKGIFSNPSTVSLTSNGMLCDGPVFFHFPACPYPVPDKPARHKLIHILVFTVAGAFILLCVSIAIRRYISKSRGDARQGQENSPEMFQRISYAELHLATDSFSVENLVGRGSFGSVYKGTFGSGANLSTAAVKVLDVQQQGATRSFISECNALKRIRHRKLVKVITVCDSLDHSGSQFKALVLEFIPNGSLDKWLHPSTEGEFLTPNLMQRLNIALDVAEALEYLHHHIDPPIVHCDVKPSNVLLDDDMVAHLGDFGLSKIIRAEESRQSLADRSSSVGIKGTIGYLAPEYGMGTEISVEGDVYSYGVLLLEMLTRRRPTDPFFGDTTNLPKYVEMACPGNLLDIMDVNIRCNQEPQVTLELFAAPVSRLGLACCRGSARQRIKMGAVVKELGAIKRIIMASQNYASWSTVQ

SEQ ID NO: 7906 - protein, 416 aa, Neisseria meningitidis
MFSKSVTLAQYDPDLAAAIAQEDQRQQDHVELIASENYVSCAVMEAQGSQLTNKYAEGYPGKRYYGGCEYVDIVEQLAIDRVKKLFGAQYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRGLRIVSGRTESHVFLVDLQPMKITGKAAEAALGKAHITVNKNAIPNDPEKPFVTSGIRIGSAAMTTRGFNEADARVLANLVADVLSNPEDEANLAKVREQVTALCNKYPVYGA

SEQ ID NO: 7907 - protein, 441 aa, Unknown
  Mycobacterium sp. MCS
MTNTPAPRARRSVLSRGSWSETARIAGILRKETVGGAVLLVASAVALVWANSPWAESYFALRDLKIGAEPFGLHLNLTLGTWAADGLLAVFFLVVGLELKREFVAGDLRDPARAALPMAAAVGGMVVPALIFVAVTAPVGDGATRGWAIPTATDIAFAVAVLAVISTHLPAALRTFLLTLAVVDDLLAVTVIAVFYTDEINLTALGLSIVPLALFALCVQRRIRSWWLLLPLGVATWVLMHESGVHATVAGVLLGFTVPVLRSVAAGGPEAGPGLAEHFEHRLRPLSAGVAVPVFAFFAAGVAIGGVSGLTRALSDPITLGIILGLVVGKPVGIFLTTRVLTAVTRANLDDALRWIDVFGVALLAGIGFTVSLLIGDLAYGLGSDRDDFVKVGVLTGSLVAALIAAVLLRVRNRHYRAVWLQETADTDRDGVPDVYQSQRD

SEQ ID NO: 7908 - protein, 502 aa, Unknown
  Shewanella sp. MR-4
MNTGRLNPNKVQRKMGSELLINVTPSEARVALVEHGVLQEVHIERRMKRGLVGNIYKGKISRVLPGMQAAFVDIGLDKAAFLHASDIVPHTECVADVEKGHFVVRDIAELVRQGQDIMVQVVKDPLGTKGARLTTDITLPSRYLVFMPGSSHVGVSQRIEQEEERSRLKKITLPFVDEDGGFIIRTAAEGVGEDELAQDAAFLRRVWSKVSERRQRRGVALLYQDLALPVRIVRDFVGTELDRIQVDSRRTFAELQAFAQEFMPEIADKIEHYSGPAPIFDLYDVENEIQRALGRKVELKSGGYLIIDQTEAMTTVDINTGAFVGHRNLEETIFNTNLEATQAIARQLRLRNLGGIIIIDFIDMLSDEHKTRVLNSLNSALAKDRVKTNVSGFSGLGLVEMTRKRTRESLEHVLCGECPACQSTGSMKTVETVSYEIFREIIRLNRAYDADEFLLYCSPAVYNSLSGDESHLVAELEVYIGKRIRLQNEPMYSQHKYDVVMM

SEQ ID NO: 7909 - protein, 412 aa, Kluyveromyces lactis
MGKEQIRKRQTKKVRKGSQPVANGKSSVVGVSKDGKPEFCAIDTPIERRLQTLSVAWYVECIPLMIIIMLFVWVNPLMWSFVIPYTIYYFIDRTASNGNAVKRHSKWFRSLKVWFYFRDYFPISMHKSTELEPTFTSIDSTELENDASEPGYLDSSQPVLPDKWWNPFREKDETVRPTGPRYIFGYHPHGIAAFGAFGAFATEACNWSKVFPGIPVCLLTLVNQFQIPVYRDYLLALGITSVARKNAMKVLEKNYSIAIVIGGASESLLTNLGSSDIILSKRKGFVKLALQTGNVSLVPVYGFGETDTYKILKLKNDSIIGRIQIWLKENYSFTVPLFFARGVFNYDFGLLPFRHPVNVVVGNPIHIKEKIDHPTIEEIDHYHSLYIEELKRLYDDNKAKFNYSEKTLNIVE

SEQ ID NO: 7910 - protein, 433 aa, Psychrobacter arcticus
MSQMNTADITAYMQNVGKEARAASRALAAANTGDKNAALMAIHDVLKNAKQDILSANKIDMDNGQKNDLDAALLDRLELNDARFDGMLQGLKDVAALPDPIGEVTDMTYRPSGIHLGKMRVPLGVVGMIYESRPNVTLEAASLALKSGNAIILRGGSEAFESNQAIAKCILEGLKKVGMSEYSVQVLETTDRAAVGELITMTDYVDVIVPRGGKGLIERISRDARVPVIKHLDGNCHTFIDSDADPEIAIKVSVNAKTHRYGTCNTMETLLVDEAIANELLPKIAEAIVKADDAMQLRLDDKAQAILNDNTTLKGHLSAATAEDWDTEYLAPILAIKILSGIDEAIEHINTHGSHHTDVIITDNYTKSQRFIREVDSASVMINASSRFADGFEYGLGAEIGISTDKIHARGPVGLEGLTSQKWIVYGHGETRA

SEQ ID NO: 7911 - protein, 190 aa, Methanococcus maripaludis
MRAFKVKRDTNETKIQLELNIDGTGKYSITTGIPFFDHVLSSFAKHGSFDLKLDVLGDLEIDDHHTVEDVGIVLGKAFENMEKKNIKRFGWAIIPMDEAKATVSIDIGGRPFVVGNYVPNTERIGSFSTENVVHFFESFSNNAKINLHFEVTGENEHHKVEALFKAFGVAMDMATQIDERKGIVSTKGVI

SEQ ID NO: 7912 - protein, 558 aa, Xylella fastidiosa
MTESFAELFEASQANLAKLKPGAIVTGTVVDVRGDVVVINAGLKSEGIVPIEQFRNDAGEIDVGVGDQVKVALDAIENGFGETILSREKAKRSMVWDELEEALEKNETISGRINGKVKGGFTVDIKDVRAFLPASLVDVRPVRDPAYLEGKELEFKLIKLDRKRNNVVVSRRAVVESEHSEEREQLLDKLQEGAVLTGTVKNMTDYGAFVDLGGVDGLLHITDMAWKRVRHPCEVVNIGDEVEVRVLKFDRERNRVSLGLKQLGEDPWDNISRRYPANCRVFGKVSNVTDYGAFVEIEAGVEGLVHVSEMDWTNKNVNPSKVVQVGDEVEVMILDVDEERRRISLGMKQVAANPWETFALTHKKGDKVSGQVKSITDFGIFIGLDGGIDGLLHLSDISWNTTGEDIVRNFKKGDTLETVVLAVDPERERISLGVKQLEQDPFGQYMATHPKGSKVIGTVKEVDAKGALIELDEGIEGYVSARDIANERVDDATQYLKVGDSVEAKFIGMDRKGRTLQLSIKAKDDAEMREVLEEYQSSSGGTTKLGTLLREQLGNKPE

SEQ ID NO: 7913 - protein, 188 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYIGVLKPEYYM

SEQ ID NO: 7914 - protein, 465 aa, Unknown
  marine gamma proteobacterium HTCC2080
MSPWLPIKSLFADPSQVGQSITVKGWLRSKRDSKAGISFLAVHDGTCFDAIQAVVPNTLSNYDEEVLQLATGCAVEVAGQLVVSEGKGQSVEIQATAVTVIGWVDDPESYPIAKKRHTFEYLRTQAHLRTRTNTFGAITRVRHVLARAIHEYFHRQDFYWVNTPIITASDCEGAGELFRVSTLDYANLPRNPDGSVDHSQDFFGSEAFLTVSGQLAVESHCLSMSRVYTFGPTFRAENSNTTRHLAEFWMVEPEIAFADLNDNAALAEGLLRHVIAEVLEHCADDMAFFQQRIDKSVLQRLQGIVDSNFERMTYSEAIAILENCGQSFEFPVHWGIDMASEHERYLAEEHVGRPIVVTDYPSDIKAFYMRLNDDGKTVAAMDVLAPGIGEIIGGSQREERLDVLEGRMDQAVLEDLWWYRDLRRYGTVPHAGFGLGFERLLAYITGMENVRDVIPFPRTPGRADF

SEQ ID NO: 7915 - protein, 644 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLLLNYFCIVRKRMNLLRDHAIEDDKGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 7916 - protein, 460 aa, Candida albicans
MIRSTTATTTTSRYCARIFRNLSRSYSTENSQPNPNEQPPLEHTLSHKELREQAIAEALAREEEAILKTKKLRELTQESQNLISALNKTPTTLINERLNKLHEDLSKLSQDKIKQLDEELKDYLNQNMILPDHLKANRPWLRSSDNNEDISKKLKSSINSASSSDSNHTSTTTTSSRYTEQFPNLKPTPDYKPYSEQELYIRQLNHTRINGRIGSRLTQVYKPQRDINNPPKFDNTTIAKLMAAGCHLGHSTSSFRPSMQPFIYGIYDKVHIIDLNKTLEKLTLACKVIEGVVEKGGVVLYVGTHKNNSSIQEALVKASERSHGYYVNKRWIPGTITNYTEVTKQYGQIKTKMEVDMKDQKITTKNSNKIIKPDLVVLLNPVENRNCIKECISAGIPTIGLCDTDMEPSLLTYPIPCNDDSVRSVNLMLGIMSKSAESGLQKRISAVKKLEENDGKVVKA

SEQ ID NO: 7917 - protein, 179 aa, Unknown
  Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 7918 - protein, 257 aa, Bromus catharticus
CELDNIMRLTGITGIVNGMDVTEWDPTKDKFIAVNYNAATALEAKALNKEALQAEVGLPLDSKVPLVAFIGRLEEQKGPDVMIAALPEIVKEVDVQIVLLGTGKKKFERLLKSIEEKFPGKVRAVVRFNAPLAHQMMAGADILAVTSRFEPCGLIQLQAMRYGTPCACASTGGLVDTVVEGRTGFHMGRLSVDCNVVEPADVKKVATTLKRAVKVVGTPAYQEMVKNCMIQDLSWKGPAKNWEDMLLELGVDGSEPG

SEQ ID NO: 7919 - protein, 246 aa, Methanopyrus kandleri
MAGKLVLVGAGPGDPELLTFKAARAISRGDVILKDRLVPDEIIKEHAPEDAEVIDVGKKPGGEGWTQEEINELIVREGSKGKTVVRVKSGDPLIFGRGAEEIEVALKHGMDVEVVPGVTSAIGVPTSLGLPLTHRKCASSFAVATGHEDPSKPENRVDFGALAEAADTLVVLMGARRLREIAREILEKRGNEPVAILERGTTEQERVKVGTLEDAAEGKLKARPPAVVVVGEVVKWWREVLGRETR

SEQ ID NO: 7920 - protein, 470 aa, Candida albicans
MSAYALSQSHRQLTEGHLKDTDPEVDQIIKDEIDRQQHSIVLIASENFTTTAVFDALGTPMCNKYSEGYPGARYYGGNEHIDRMELLCQERALKAFGLTPDKWGVNVQTLSGSPANLQVYQAIMKPHERLMGLDLPHGGHLSHGYQTDSRKISAVSTYFETMPYRVDLETGLIDYDMLEKTAVLYRPKVLVAGTSAYCRLIDYKRMREIADKVGAYLVVDMAHISGLIAAGVIPSPFEYADIVTTTTHKSLRGPRGAMIFFRRGVRSVNPKTGQEILYDLENPINFSVFPGHQGGPHNHTIAALATALKQANTPEFKEYQEQVLKNAKALESEFTKKGYKLVSDGTDSHMVLVSLKDKQIDGARVETVCEKINIALNKNSIPGDKSALVPGGVRIGAPAMTTRGLGEEDFKKIVSYIDFAVNYAKEVQSQLPKDANKLKDFKNAVSGDSEKLKAVRDEIYQWAGSFPLAV

SEQ ID NO: 7921 - protein, 487 aa, Agrostemma githago
KYWCWCFWSLEVEVLDLLGAKEIAVRAWDETLNTQPEKLIWNLMGMMNNCWFRVKTNMCKPHRGEIGIVFEHPTQPGNKSGGWMARERHLELSDAVSHALKRTASTPFMNTNSKMFSMSEVKKHNSAESAWIVVHGNLYDATRFLKDHPGGSDNILINAGTDCTEEFDAIHSAKAKKMLEDYRIGELITTGYQSDSTTSSPGNSVHGWSIMSSLAPITEIAPFRNVALKPREKIPCKLIEKDSLSHDVRRFRFGLPSKDQVLGLPCGKHIFVCATIDDKLCMRAYTPTSTIDEVGYFDLVVKVYMKGQHPRFPNGGLMSQHLDTLNLGSILEVKGPLGHIEYLGKGNFMVHGKPKFAKKLAMISGGTGIPPIYQVMQAILKDPEDETEMHVIYANRTEEDILLREELDTWAIDYKDRVKVWYVVEKANEEWKYDTGFISEQILRDHVPESSSHVLALTCGPPPMIQFAVQPNLEKMGYDIKEQLLIF

SEQ ID NO: 7922 - protein, 1137 aa, Yarrowia lipolytica
MSRLSVSSSRQSLQLGSEDLGPNAIGSLVEATEGYKPPTIKDIEQVKLPSIARVSQQKYNEYLQEVQQEYRQYCQLKRGGSDVPGDVNSSLDSVPQAFFEPDFRLDNQRIFDTVTEHKTDVTTYNILQEKLSYYIDTVEVNLIEEISKSSDSFFMAIDELKQIHSDTESAVEVVRDLRTQMQTLDQIHVERGLQMVQLQQQYAQVEELENGVTQLQEIVRLFQEAERLSEEQPQTNLLPCLELVDSTDALIHGDSEYLASTTVKMKTPISNLSPLTGLKPLRDSLLSLRVKVGHKIGKQFTLLLIDDLQSHGQAVPTGDTIVRLMQQFNRQRNRASPPEAVNTSFNDVDPAFRGKLASLLNQLLRAGQVQDAFKAYQDAIADYSRRLIKQHLPSSTDTNSMSSGLSGVSGVSSGSAASRSERGMALAGKLRALSASEFENTLAEIYASLSEFVRRLLTHQKLLLDLISSQPALLEQCGELAFGLRQVISGTVDKQLAYMTKIVNARREQTAQLPCDLFLNFYALNGIFVRECEQSVGVVSNPLQTTLVGHLKQFIQTLFNRADEHLLSELEKDKWKDTEISAQTQQKVDDIVAAATQDPIKWKELLFVNLMGGTPNNTDVPKEGKMRPKNVFVEAASFIIPNGTTHLVDGLVGFLQLVVIFPGQTPELVDVITSLIKRYNVSANELILQAGATRSAAKLAHISAKNLALVSQSLGFIVTLIPYMREYCRRHVTSQQIPAQFDRTKRDLLKHQDDIHTKLVSIMVERMVNHSRTLRRIDWSKPVTTANGVHEYMQQLISDTNTLSKSLKKVLASENYIGVAEESKLEIPTGVPPKDEAKDESKAEVSTAVSEPVPEVKKDVEGHQVESKDDAKKSQTEDVKETAMELNDTEMDSTNVEEKTKEASEEESREESKTGDVAVEETNSESQHVSDDIVPEGADAESVKVEPGPENADEVIASEPDTKEAVSGTKESEAQSTIDALDEAAVEEKERGDKVGDKVEDKVEDKVGDKVEEMKGEVEEGETGTTTELDAVNSENGAKENGTVKEEAKNEVEEVKEEVQAEPEKVADKPESADKDETKAESETTSTPDLSKETADEAKDDGKDDKDDSAPSLQPEPKPASISSPKKKKNKKKGKKK

SEQ ID NO: 7923 - protein, 497 aa, Agrostemma githago
DIQEKGSKYGKYWCWCFWSLEVEVLDLLGAKEIAVRAWDQTHNTQPEKLIWNVMGMMNNCWFRVKTNVCKPHKGEIGIVFEHPTQPGNKPGGWMARERHLELTVPGGNNLKRTSSTPFMNTNSKMFSMSEIKKHNSAESAWIVVHGHVYDATRFLKDHPGGSDSILINAGTDCTEEFDAIHSDKAKKMIEDFRIGELITTGYQSDSTSSSPGNSVHGGSLMSSLAPITEIDPFRNVALKAREKIPCKLIEKVSLSHDVRRFRFALPSKDQVLGLPCGKHVFICASVDDKLVMRAYTPTTAIDEVGYFDLVVKVYFRDQHPRFPNGGVMSQHLDSLSLGSIIEVKGPLGHIEYLGKGNFMVHGKPKFAKKLTMICGGTGITPIYQVMKAILKDDEDETEMHVIYANRTIDDILLRPELEKWAIEYKERVKLWYVVEKGDEEWKYDVGFINEKIVRDHVPECGEHVLALACGPPPMIQFAVQPNLEKMGYDVKEQLLIF

SEQ ID NO: 7924 - protein, 429 aa, Thiomicrospira crunogena
MTESGIKMSEKEMDVKAYMQKLGQQAREASRQLMVATTRQKNTALLNIATALEEQAETLKTENAKDLEQGKANGLDAAMLDRLALTDKVINGMATGLRQIAALNDPIGEISDMNYLPSGIQVGKMRVPLGVVGIIYESRPNVTIDAAALCLKSGNAALLRGGSEAAYSNRALAKCIQSALHESGLLPTAVQVVETTDRAAVGEMIAMPEYVDVIIPRGGKGLIERISEGAKVPVIKHLDGICHVYIDDDADADKATRVAFNAKTHRYGVCNAMETLLIADSRAAEILPGLVELYEEKGVELRGCEQTRAICDMKAATEEDWATEYLAPILSIKVVDDVDEAIDHITQYSSGHTESIITENLTTSRQFLARVDSSSVMVNASTRFADGFEYGLGAEIGISTDKFHARGPVGLEGLTSQKYIVLGDGTIRE

SEQ ID NO: 7925 - protein, 213 aa, Brassica napus
  misc_feature (135)..(135): Xaa can be any naturally occurring amino acid
MAVGEVMRMEVPTGGDLTVSSPDLHVLAVDDSIVDRKVIERLLRISSCKVTTVESGTRALQYLGLDGNTGASDLKDLKVNLIVTDYSMPGLTGYDLLKKIKESSTFREIPVVIMSSENILTRIEQCLKEGAEDFXLKPVKLADVKRIKELIMRNEAEDCKTLSHSNKRKFAEYIDDASSPSPSSSSTHDESAAKDFPSSKRMKSEDDKFSSLL

SEQ ID NO: 7926 - protein, 170 aa, Oryza sativa
MAAAAAAAKRKPVFVKVDQLKPGTGGHTLVAKVLSSKTVVQKGRAAAGAGPAARPTRIAECLIGDETGCILFTARNEQVDLMKADSTVIIRNAKIDMFKGSMRLAVDKWGRIEVTEPASFNVKEDNNLSLVEYELVNVEGSYVFQAYLVKFYLLSWLKKVKDEGDSEVRL

SEQ ID NO: 7927 - protein, 235 aa, Oryza sativa
MAAGAGGDGGGELKLLGTWASPFVQRVRLALNLKGLAYEFIEEEIGGGKSELLLASNPVHKKVPVLLHRSNPICESQVIVQYLDDAFPGGAAGGDLLPSDPHARAVARFWAAYIDAEFFAPWNRSFYTASEEEKTAEMGRAAAALATIERAFAELSRGKGFFSGEDRPGFVDVVLGGFVGSMRAYGTAVGVEVLDAGRTPLLVAWAERVAALDAARGVIPDVERVVELSRYARKK

SEQ ID NO: 7928 - protein, 586 aa, Magnaporthe grisea
MAALQELADRTKAEDNVYVDTDVGVDGNEADGSEQKPYKSLGYAFIRNHGLPTKTYQIRASTTGALGPDEEPSTRLIWKEPAKSAVKKAQSMLDAHKKKLLKADQAAAAEEELRQKRLKNLEDAKNIKITEDPSLPPATRVELWQKDLELGEGDNKGPRVKVFGRIHHLRVQKHATFLTLKSGPDQLQCILSGDLTKTYEALLFAQGTALFVYGELRKVLDGKNAPDGRELQVDYYEVTGRAPGDADAIANKVSWSQDIWESDMLDNRHLVLRGDQTTSVLTVREAVELAFIKTFESMRIKKVSPPALVQTQVEGGSTLFKFDYYGEAAYLTQSSQLYLETVLPSLGNVYCIEKSFRAEKSLTRRHLSEYTHVEGELDGINFEDLLVHIEEVICRVVDSVLDNPEVARHVKALNPDFVKPSRPFMRMKYSDAIDWLNAQDPPILNEEGHPHVFGDDIAEAAERRMTDIINRPILLTHFPVEIKAFYMKKDPNDLRVTESVDVLMPGVGEIVGGSMRMEGYEDLMAAFKREGIDPAPYYWYLDQRKYGTSPHGGYGLGLERFLAWIAKQHTVRTCCLYPRFMGRCKP

SEQ ID NO: 7929 - protein, 268 aa, Glycine max
EMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIGLYERAVGIYASLVNINAYHQPGVEAGKKAAGEVLALQKRVLAVLNEASCKEPVEPLTLEEIADRCHAPEDIEMIYKITAHMAANDRALIAEGSCGSP

SEQ ID NO: 7930 - protein, 438 aa, Brucella melitensis
MSQANAATKASSDVFFNASLEDIDPEIFGAIRNELGRQRHEIELIASENIVSRAVLEAQGSILTNKYAEGYPGKRYYGGCQYVDVVEELAIERAKKLFGAEFANVQPNSGSQMNQAVFLALLQPGDTFMGLDLNSGGHLTHGSPVNMSGKWFNVVSYGVRKDDHLLDMDEVARLARENKPKLILAGGTAYSRIWDWKRFREIADEVGACLMVDMAHIAGLVAGGQHPSPVPHAHVCTTTTHKSLRGPRGGMILTNDADIAKKINSAVFPGLQGGPLMHVIAGKAVAFAEALKPEFKLYAKNVVDNARALAEELKSHGLDIVSGGTDNHLMLVDLRPKNATGKRAEAALGRANITCNKNGIPFDPEKPFVASGVRLGTPAGTTRGFGVAEFKEIGSLIAEVLDGLKVANSDEGNAAVEQAVKEKVIALTGRFPMYGYQG

SEQ ID NO: 7931 - protein, 360 aa, Kluyveromyces lactis
MAIKRLINEHDMELWNNSKTFEDVIGFINTLALSVRGRENNDYTQPISDNVQRVSNLLSKVTEIIGKHEVIKDANTSRFGKIEFRDFYDDISEHSNELISKIFEGIEKPDTGKLDDICTYFINSWGDRSRIDYGSGHELNFICFLYCLTESKVFDLENDSSNIVLMLFIKYLGIMRSLELKYWLEPAGSHGVWGLDDYHFLPFLFGAFQLSTHKHLKPKSIHNPEVVEMFQDRYLYFGCIAFINKVKTTASLRWHSPMLDDISGVKRWSKVAEGMVKMYKAEVLQKLPIMQHFYFGYFLKCPEGVSEPSARAQDHHEDDSCCTDGSHGHSTWADCCGIAVPSAIAASQMANKDVRLFPFD

SEQ ID NO: 7932 - protein, 175 aa, Oryza sativa
  misc_feature (164)..(164): Xaa can be any naturally occurring amino acid
  misc_feature (169)..(169): Xaa can be any naturally occurring amino acid
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAXKPPGXEESGAN

SEQ ID NO: 7933 - protein, 661 aa, Triticum aestivum
  misc_feature (392)..(392): Xaa can be any naturally occurring amino acid
  misc_feature (596)..(596): Xaa can be any naturally occurring amino acid
MPLRPYLGDTYRTSLYKKPRLVPVRNSPGYRRPTRPPLNTSIIHSLLRLQPHPPPKPASSVAASTTMCGILAVLGCADWSQAKRARVLSCSRRLKHRGPDWSGLFQCEGNFLAQQRLSVVSPLSGDQPLYNEDRTVVVVANGEIYNHKKIRKQFAAKHTFTTGSDCEVIIPLYEEYGENFVNMLDGVFSFVLYDTRNKTYMAARDAVGVNPLYFGRGSDGSVWIASEMKALHEDCPKFELFPPGNLYSSAAGGFRRWYNPQWFAEHVPATAYQPLVLREAFEKAVIKRLMTDVPFGVLLSGGLDSSLVASVTKRHLIETEAAKKFGTELHSFVVGLEGSPDLKAAREVADYLGTIHHEFHFTVQDGIDAIEEVIYHNETYDVTTIRASTPMXLMARKIKALGVKMVLSGEGSDELLGGYLYFHFAPNKEEFHKETCRKVKALHQYDCLRANKATSAWGLEVRVPFLDKEFIDVAMSMDPEWKLYDANLGRIEKWVLRKAFDDEKEPYLPRHILYRQKEQFSDGVGYNWIDGLKAFTEQQVTDEMMKNAAEEYPYNTPINKEAYYYRMIFERLYPQESARETVPWGPSIACSTPAAXIEWVAQWKASNDPSGRHIASHNDAAPAHAHANGNGNGAVANGKANGNGTANGNANANANGTLVPC

SEQ ID NO: 7934 - protein, 970 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSLRKLRHLHLGGNIFSGGIPPEYGHGGSFKYLALRQTSLSGYPPGGLGNLTSLREFYIGYFNSYSGGIPPELGNMTDLVRLDAANCGLSGEIPPELGNLANLDTLFLRVNGLAGGIPRELGKLASLQPKVDLSKKGLAGEDPAKVRRLQRTFTLLNLFRNKLQGDIPEAFVGDLPSLEVLQLWENNFTGGMPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSLPTGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKPNNILLDSDFEAHVADFGLAKFLQDSGTSERMSAIAGSYGYIAPEYAYTLKVDETSDVYSLGAVLLEPDHRKDPTDARSRESWGWPSPSFHGPKNHDLDAIGLDTKLLQISLIWLCTLEELDDRPLNGGDVDNLSAPSVAVEF

SEQ ID NO: 7935 - protein, 224 aa, Glycine max
MDQYQDDYDFEGGNGKSGKGGRDKSKGRRDNSLNVLTRKFIDLIRKSPNQTVDLNNAVKILNVQKRRIYDITNVLEGIQYIEKVLKNKIKWVGKQVTEELDDKINELEELENLQKEESDIDHWINYLQENLGDLTKDEVNNNYSYVTFDDVKSVNTLAREDDQPFLVIRAPKGTVLEVPVVDNETEENFPHRMQLTSQDEEILIYVVSNDQNAAPGGEVTKLNR

SEQ ID NO: 7936 - protein, 969 aa, Prochlorococcus marinus
MNPSINSDLFIGRHLGLKENDEKKMLQKLGFNNIDEFINQVIPEDIQFKEKYSNSLPIGCSEIEALNELEEISNKNHKIRSLIGLGYYGTHTPKVVQRHVLENPRWYTAYTPYQAEIAQGRLEALFNFQTLICELTAFSVANASLLDEGTAAAEAMTMSFSARKNKSSNIFLVDENVFDHTFNVLLTRAKPLGIDLKRFNQKHLKNYDDVFGLLIQLPGKNGELFDPTFLVSQAQKAEIIVTSIIDPLAQVLIKPIAEFGVDIAVGSLQRFGVPMGFGGPHAAFFACSEKYKRLIPGRIVGQTLSKNGEQSLRLALQTREQHIRREKATSNICTAQSLLAIISSFYAIYHGANGLTKMAKRLVLLRRYLESCLCELGFKIPLGNRFDSVDIYCEESEKIHKEALKNGFNFRILPLGSSIEDSTGFGISLDELTDENEIRKIVSLIANGVGKKEDFKHIKVNNSFHFEGIPLRNKEWMQQNIFENYQSETDLMRYIFKLAEKDFSLVDGMIPLGSCTMKLNSAAELSPISWANLSSIHPFAPANQTRGYSKIISDLEKWISELIGLNSVSFQPNAGSQGEFAGLLAINSYFASKGDLARKKCLIPQSAHGTNPASAVMAGFDVVTIKCDSEGNISYEDLLIKVKELDNKIGALMLTYPSTHGVFELKIKEICELIHSVGAFVYLDGANLNAQVGLCKPGDYGVDVCHLNLHKTFCIPHGGGGPGVGPVATSDILSPFLPSHSLTDNIFSHLGYSVSSSQHGSASILPISWMYIKMAGQSGLRKASTHAILSANYIANKLKNKFRILYKGQNNFVAHECILDFRDLKSKTGLSVNDIAKRLIDYSFHAPTISWPVPETIMIEPTESESLTELNRFCEAMLLISEEIEEIENNIDLKNNNLISNAPHTISELISDNWNYPYSKEKAAYPYKGKYEYKFWSSVSRIDNAYGDRNLICSCNVNDQDFLEEKKCA

SEQ ID NO: 7937 - protein, 536 aa, Desulfitobacterium hafniense
MAGLATSFGSGAMTNSINEIPNAEVMFVIGSNTTEAHPIIGTKMKQALARGAKLIVADPREIELARDAHIWMRLKPGTDIALINGIMNIIVENGWEDRAFIEERTEGYQELRENLKKFPPEEVSKITGVPVELMAEAARLYTSVERAQIFYTLGITEHVCGTDNVMSLANLAMLTGNIGKESSGVNPLRGQNNVQGACDMGALPNVYPGYQSVTNPEARAKFEEAWGVSLNPNQGFMIPDMFDSAVKKELRAMYIMGEDPVLTDADANHVRKGLKALDFLVVQNIFMSETAELADVILPGASFAEKDGTFTNTERRVQRVNRAIKPIANTKADWEIICELANRMGYPMAYPSPAEIMLEVASLAPQFAGVTYERLGKKGLQWPVPHAEHPGTKFLHQGKFTRGKGVFTVIEHQLPDELPDEEYPFLLTTGRKLQHYNISTRFSAALDEHAPEELAELNPKDARRLGIQDGEKIKVVSRRGEVVTKVWVTKRVPPGVLFMTLHYRESPTNVLTNGAYDKVTKTYEYKVCGVRVEALK

SEQ ID NO: 7938 - protein, 968 aa, Solanum lycopersicum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPSSLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 7939 - protein, 295 aa, Xylella fastidiosa
MTTHLLPVALIQERNHGTAEANLSIIEARVAEAAAQGAQLVLLHELHNNAYFCQHESVNEFDLAEPIPGPSTERLSALAKQHRVVIIGSLFEKRAAGLYHNTAVVLEKDGRLVGKYRKMHIPDDPGFYEKFYFTPGDIGFKPIDTSVGRLGVLVCWDQWYPEAARLMALAGAELLLYPTAIGWDPNDEHDEQTLQRDAWLLSHRGHAIANSLPVLSCNRTGHEPSPLCTSGIHFWGNSHVLGPQGEFLAEANSNGPEILTCEINLQRSEHVRRIWPFLRDRRIDAYGDLLKRYID

SEQ ID NO: 7940 - protein, 992 aa, Actinobacillus pleuropneumoniae
MLINATQKEELRVALVDGQRLFDLDIESPGHEQKKSNIYKGKITRVEPSLEAAFVDYGAERHGFLPLKEISREYFPADYVFNGRPNIKDIIKEGQEVIVQVSKEERGNKGAALTTFISLAGSYLVLMPNNPRAGGISRRIEGDERLELKEALDCLDVPEDVGLIVRTAGVGKSPEELQWDLKVLLHHWEAIKKAAESRPAPFLIHQESDVIVRAIRDYLRRDIGEILIDNKKIFEKAKNHIRLVRPDFINRVRLYEGEVPLFSHYQIESQIESAFQREVRLPSGGSIVIDVTEALTAIDINSSRSTRGGDIEETALNTNLEAADEIARQLRLRDLGGLIVIDFIDMTPVRHQREVENRIREATRQDRARIQFSRISRFGLLEMSRQRLSPSLSEASSHVCPRCQGTGKVRDNESIALSILRLLEEEAIKENTAQVHTIVPVQIASYLLNEKRKAISSIEKRHDVQVVVVPTESMETPHFSVYRLRENEVLPTLSYDLAKHYHDREEDTQLNTHTVSEEVLVTRNEPVITVESVLQSSELNLQPAPTPVEPAKPSLLSRLIAKVKSFFAPEEKAEEKPKPKARNQRDRRNRRERPNRADRQERKQTQTQDEQKAQRQERNQERNEAKKARRQVVEEVAGVQETQTEQRSNKDNATTERRQRRDLRKKVRVENVETSIVTTEPITQPIEEKVQNIAQIQPLVAQETQPETVNEERQDVRENGRQRRLPRHLRVGNQRRRDNNNRKENVVAAMPLAAAVASPEMASGKIWVKFSEPVSTNKPNSKAEEKARFLSVDEMLEQQTTEVNEPIVESNIENNSASSVAPVVGFIKQQSDRDLVKENKARLHHQVEESEQADEQLVEKAMAKHVAPLGGFVSQHSDRDLVKEKNERVQKFQAQATQVPAIGNATAEAISVPVSNYQSDYSFNGRLGTFSRVMHTKAEMTVASAPEKALETVTVNEWTQSKYYFYGKGFGGHSSAVSHVHSAPRVANTDHE

SEQ ID NO: 7941 - protein, 826 aa, Solanum lycopersicum
MMMVSSKIFSLLQFFALLNLFTVTFASTEEATALLKWKATFKNQDNSLLASWTQSSNACRDWYGVICFNGRVKTLNITNCGVIGTLYAFPFSSLPFLENLNLSNNNISGTIPPEIGNLTNLVYLDLNNNQISGTIPPQTGSLSKLQILRIFGNHLKGSIPEEIGYLRSLTDLSLSTNFLNGSIPASLGNLNNLSFLSLYDNQLSGSIPEEIGYLRSLTDLYLSTNFLNGSIPASLGNLNNLSFLSLYDNKLSGSIPDEIGYLTSLTDLYLNNNFLNGSIPASLWNLKNLSFLSLSENQLSGSIPQEIGYLRSLTNLHLNNNFLNGSIPPEIGNLWSLSIIDLSINSLKGSIPASLGNLRNVQSMFLDENNLTEEIPLSVCNLTSLKILYLRRNNLKGKVPQCLGNISGLQVLTMSRNNLSGVIPSSISNLRSLQILDLGRNSLEGAIPQCFGNINTLQVFDVQNNKLSGTLSTNFSIGSSLISLNLHGNELEGEIPRSLANCKKLQVLDLGNNHLNDTFPMWLGTLLELRVLRLTSNKLYGPIRSSGAEIMFPDLRTIDLSNNAFSKDLPTSLFQHLEGMRTIDKTMKVPSYEGYGDYQDSIVVVSKGLKLEVVRILSLYTVIDLSNNKFEGHIPSVLGDLIALRVLNMSHNGLKGHIPPSLGSLSVVESLDLSFNQLSGEIPQQLASLTSLGFLNLSHNYLQGCIPQGPQFRTFENNSYEGNDGLRGYPVSKGCGNDPVPDTNYTVSALDDQESNSEFLNDFWKAALMGYGSGLCIGLSIMYFMISTGNPIWLARIIDEMEHQINTRRRKKQQGQRNHRRRNNHF

SEQ ID NO: 7942 - protein, 235 aa, Oryza sativa
MAGGGDELKLLGTWFSPFVSRVKFVFHLKGLSYENIEEDLKNKSELLLKSNPAIKKVPVLFHNGKPLCESMIIVEYIDETFAGVGPSVVPTDAYERAVARFWVSYIDNKLVAPWFQVFRSKSMEEKAEGLKQIFVAVMVLEEAFKECSKGRPFFGGDNAGIVDIALGSQLGWVRASQALSGIKLFDPAKTPLLAAWAERFLALDAAKASMPEFGRLIEYAKMRQAESDAANAAAN

SEQ ID NO: 7943 - protein, 134 aa, Alteromonadales bacterium
MTFKVDFKVRHYECDLQGIVNNSVYFNYLEHARHEFLFSNGVDFALLAKQKVNLVVIRSEVDYKHSLVPEDEFYVSVKPVRISRLKFAFEQTIVRKHDQQVMLKAKVIGTAVNEKGRPFLPPEMQTLFNNNDLS

SEQ ID NO: 7944 - protein, 300 aa, Mycobacterium smegmatis
MTSTWSPDRLGDLGDKRIIVTGATNGVGLGTTRALVRAGAHVILAVRNTDLGARRAAEVGGTTTVVEVDLADMSSVRAFPGRLTAAGIDDVDILINNAGALTQRRTETVDGFETTLGTNLLGPFALTNLLLGRVRSQVIIVGSDAHRMATLRLDDMHLRRNRWTPLGAYGRAKLAVMLWGLELDRRQRVARSPVVTHLTHPGWVASNLPNVSQTRLMSVIQRGVTTVADRFAASIDEGAAPTLYCISEPIPPGSYVGVEGRLGLRGAPVLIGRSAVACDYETAAAVVDFAERETGTAIPY

SEQ ID NO: 7945 - protein, 929 aa, Salmonella enterica
MLNAVGAESLNALTGQIVPKDIQLATPPQVGEAATEYAALAELKAIAGRNKRFTSYIGMGYTAVQLPPVIPRNMLENPGWYTAYTPYQPEVSQGRLEALLNFQQVTLDLTGLDMASASLLDEATAAAEAMAMAKRVSKLKNANRFFVAADVHPQTLDVVRTRAKTFGFDVIVDDADKVLDHQDVFGVLLQQVGTTGEIHDYGALISELKARKVIVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQSMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASCLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 7946 - protein, 944 aa, Solanum lycopersicum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTKLSLGNNFLSGSIPASLGNLNNLFMLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEVPSYERYYDDSVVVVTKGLELEIVRILSLYTVIDLSSNKFEGHIPSVLGDLIAIRVLNVSHNALQGYIPSSLGSLSRVESLDLSFNQLSGEIPQQLASLTFLEFLNLSHNYLQGCIPQGPQFRTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 7947 - protein, 178 aa, Clostridium acetobutylicum
MREDIKEVLLDEEKINEKVKELGKKISEDYKGKDLILIGILKGSVVFMGNLVKYIDIPCAIDFMSVSSYGNGTSTSGIVKVLKDLDSDVEGKDILIVEDIIDSGVTLKYLMGHISGKKPNSIEIITLLNKPERRRVEINVKYTGFIVPDYFLVGYGLDYAEKYRNLPYIGILKDEIYE

SEQ ID NO: 7948 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGKEAEAIKAKILAHPQYPSLLGAYIDCQKIGAPPEVVARLDALTHEYENQQHRTTVSIGMDPELDQFMEAYCEMLTKYHEEL

SEQ ID NO: 7949 - protein, 621 aa, Citrus unshiu
MKTKVWALCLILVVHSSWLASANMEGDALHSLRSNLIDPNNVLHSWDPYPCQSLHMVSCYMQMNNSVILVDLENAALSGQLVSQLGLLKNLQYLELYSNNITGPIPSDLGNLTSLVSLDLYLNSFTGPIPDTLGKLSKLRFLRLNNNSLSGPIPMSLTNISSLQVLDLSNNRLSGVVPDNGSFSLFTPISFANNLDLCGPVTGRPCPGSPPFSPPPPFIPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQLPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNNYVEAEVEQLIQVALLCTQGSPMDRPKMSEVVRMLEGDGLAERWDEWQKVEVLRQEVELAPHPNSDWIVDSTENLHAVELSGPR

SEQ ID NO: 7950 - protein, 541 aa, Poncirus trifoliata
MDQAISSVVRKLQMVNTSDHNSVVSINIFVALLCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLNHINTRSAFQFIGNFLYLFFTSTLLGVIGLLSAYVIKKLYFGRHSTDREVAIMVLMAYLSYMLAELFYLSGILTVFFCGIVMSHYTWHNVTESSRVTTKHTFATLSFVAEIFIFLYVGMDALDIEKWRFVKGSPGTSVAASAMLMGLIMAGRAAFVFPLSFLTNLAKKSPTEKISIKQQVIIWWARLMRESNSMALAYNQFTRSGHTQLRENAIMITSTITVVLFSTVVFGLMTKPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 7951 - protein, 542 aa, Citrus reticulata
MDQAISSVVRKLQMVNTSDHNSVVSINIFVALLCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFIFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTKPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 7952 - protein, 224 aa, Rhodobacter sphaeroides
MFLLNRKKSEMVSAAEALPGRPDPIPTAETHFLSGLPLKSPVPAGMAEAVFGMGCFWGVERKFWQVPEGVWLTMVGYAGGYTPNPTYEEVCSGRTGHTEAVRVIYDPSVVSYAMLLKLFWENHDPTQGMRQGNDSGTQYRSAIYTYGPEQAEAARASATAYQGALSAAGRGRITTEILPAPPFYFAEAYHQQYLAKNPAGYCGVGGTGVSCPIGTGVGAASPAR

SEQ ID NO: 7953 - protein, 173 aa, Glycine max
MARMPLEPLIVGRVIGEVLDSFTTSTKMIVSYNKNQVYNGHELFPSTVNTKPKVEIEGGDMRSFFTLIMTDPDVPGPSDPYLREHLHWIVTDIPGTTDATFGKELVSYEIPKPNIGIHRFVFVLFKQKRRQCVTPPTSRDHFNTRKFAAENDLALPVAAVYFNAQRETAARRR

SEQ ID NO: 7954 - protein, 299 aa, Methanopyrus kandleri
MAKPYDVIVIGAGPAGLSAAIHAARAGAEVPVVAQELGGQLTTAPEVGNYPGFPPAPGYELVDRMVEHAETVGVELNVKYSNRVEGIELTDGTFRVLDEECRAVVIATGARPKRLGVPGERELEGRGVSYCAICDGPAFQNRIVAIVGSGTHAANTALFLSEIAERVYVITPDGKLESPDRALIERVLSCRNVEVVHDEVRRIVGDERVEGVELSDGDILPCEGVFIAAGKVPNSEPFRDLVETDDRGYIVVDSEMRTSLEGVYSAGDVTTIPHRNVPSAVYQGSVAGINAAEYALKSR

SEQ ID NO: 7955 - protein, 383 aa, Ustilago maydis
MAPHHPASETAGQRAQPHDADDTSLQASSTTTSGEAPSDASKSKSDPTNKENVIRFAPISIPRSRRLQTLGVLFWALLLPICLSIFFLLLSFPILWPVLIPYLVWINFIDKAPENGGRRFSWVRKLPVFRYFAEYFPISMIKTTNLPADRPYIFGYHPHGILGVAAVANLATDATEFPESFPGITPHLLTLATNFTIPLFRDCLMAMGICSVSKRSCEAILRKGKGSAIAIVVGGASESLAAHPGTADLTLKRRLGFIKIAIRNGADLVPVFSFGENDVYEQLSNEEGTKIYALQKQFQALFGFTLPFFHGRGLFNYSVGLMPYRHPIVSVVGKPIHVKKNPNPSKEEIEEVQHRYIEELMNIWETWKDAYAANRTKELTIVA

SEQ ID NO: 7956 - protein, 371 aa, Zea mays
VSCSNSTVPLASDTVLHVVARCRVVENSSAQVASSKEDLVPKCGQITQNGNCNGVSVLQVSMQLKAMDIGAENGNKENVPGADLPKPMSIEPPFAVDWLEISWEELELKERVGAGSFGTVYRADWHGSDVAVKVLTDQDVGEAQLKEFLREIAIMKRVRHPNVVLFMGAVTKCPQLSIVTEYLPRGSLFRLINKAANGEMLDLKRRLRMALDVAKGINYLHCLNPPIVHWDLKTPNMLVDRNWSVKVGDFGLSRFKANTFISSKSVAGTPEWMAPEFLRGEPSNEKCDVYSFGVILWELLTMQQPWSGLGPAQVVGAVAFQNRRLPIPKDTSPELAALVEACWDDDPRQRPSFSSIVDTLKKLLKALLGGS

SEQ ID NO: 7957 - protein, 468 aa, Raoultella planticola
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQKAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 7958 - protein, 416 aa, Haemophilus influenzae
MTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYPNPLPHAHVVTTTTHKTLGGPRGGLILSSCGDEEIYKKLQSSVFPANQGGPLVHIIAAKAVCFKEALEPQYKEYQANVIKNAKAMVEVFKQRGYDVVSNGTENHLFLVSFIKQGLTGKAADAALGKANITVNKNAVPNDPQKPFVTSGIRVGTPSVTRRGSNENDVRELAGWMCDVLDALGKENEEQVIAETKEKVLAICKRLPVYPK

SEQ ID NO: 7959 - protein, 157 aa, Daucus carota
QGRLSQEQSYRGVRKRKWGKWVSEIREPGKKARIWLGSYEAPEMAAAAYDVAALHLRGSAAHLNFPEMVGSLPKPVGSSHADVQRAAQEAAMSMRFGRSENRGPVTVQLSSSEIRAINESPLDSQEMWMEMGGSVFVEERRDDEELEEMQCSSLWKF

SEQ ID NO: 7960 - protein, 504 aa, Rhodospirillum rubrum
MTATFTGNRGLQLEEPLIFELDTPGSTAVDLTPPAPFTDRLGGLTRQGPIGLPGLSEPQVVRHYTRLSQKNYSIDAGFYPLGSCTMKYNPRLNERMARLPGFADIHPFQPVSTVQGALALMDHLARWLKELTGMPAVALSPAAGAHGELCGMMAIRAALQARGDERKVVLVPESAHGTNPATAAACGFKVETIPADARGRVDSAVLTARLGPDVAAVMLTNPNTCGLFEGDIITLSKAVHAAGAFFYMDGANFNAIVGRVRVGDLGADAMHINLHKTFSTPHGGGGPGAGPTVLSEALAPFAPLPYVVHDTEGFRLIETDLDAQADGTAPFGRLKGFHGQFGVFVRALCYMMSMGKDGLRQASGDAVLNANYLLASLKDTLSASFEGPCMHEALFDDRFLKDTGVSTLDFAKALIDEGYHPMTMYFPLVVHGALLIEPTETESRQTLDLFIATLKDLARRARENGAEAFKAAPQLTPRRRLDETLAARKPVLRWTPPALKDAAE

SEQ ID NO: 7961 - protein, 448 aa, Rhodospirillum rubrum
MRYLPHSEADRAAMLATIGAASVEDLFRDVPREALDQAAFDALPDHGGEMEVERALSALAARNLTAGSVPCFLGAGSYRHHVPAAVDALIQRGEFLTSYTPYQAEVSQGTLQYLFEFQTQVALITGMEVANASMYDGATACAEAAAMAVRITRRRKVLMAGGLHPHYTATTQTLLACLGHEGEGLPPDPLALGDLIGRVGSDTACVIVQNPDFFGRLRDLSPLAEACHAAGALLVVAVCEPVSLGLVAPPGAMGADIVVAEGHALGSPTGFGGPGVGLFATREKYLRQMPGRLAGETLDESGKRGYVLTLSTREQHIRREKATSNICTNSGLIALAFTIHMTLLGEAGFTRLAWINHANAVALAEKLARVKGVKVLPETFFNEFTLRLPKPAAEVVEALAARSILAGVPVSRFLPTYPELANLLLVNATELTTPEDADALVAALKEVL

SEQ ID NO: 7962 - protein, 799 aa, Solanum lycopersicum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLKENALNGSIPASLGNLNNLSRLYLYNNQLSGSIPEEIGYLSSLTNLYLGNNSLIGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSKFFNDFWKAALMGYGSGLCFGISIIYFLISTGNLRWLARIIEELEHKIIMQRRKKQRGQRNYRRRNNRF

SEQ ID NO: 7963 - protein, 451 aa, Oryza sativa
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQADSVICFVIRLRLILQITKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKFLENHATFHSPVNILVEHHT

SEQ ID NO: 7964 - protein, 1016 aa, Solanum lycopersicum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTYLDLGENALNGSIPASLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 7965 - protein, 605 aa, Propionibacterium freudenreichii
MTSDQNMTSDQHSETPPIRALLGEDEERTADARAKLEMALSLTQPTGAVDPHDTSWFETAVFYEVMVRSFADSSGDGIGDLAGLTEHLDYLQWLGVDCLWLPPFFASPMTDGGYDVADYRAISPDLGTLSEFGDFIDKAHDRGIRIIIDFVMNHTSDHHPWFEESRRHPDGPYGDFYVWRDNPDGYPDARIIFIDTETSNWTFDPVRGQYFWHRFYSHQPDLNYENPKVLAEMLDALRFWLGFGVDGFRLDAVPYLVEEEGTNCENLPGTHDILKQVRKMVDEEFPGRILLCEANQWPHDVVEYFGDNDECQMAFHFPVMPRLYMGVARHTREAITTILASTPPVPQGCQWATFLRNHDELTLEMVTEDDRQYMWREYAPDPRMRLNLGIRRRLAPLMGNDPDKIRLMNAMLLSLPGSPVLYYGDEIGMGDDIWLHDRDGVRTPMQWTADPSAGFSTATPDKFFLPLLADPYSPQQVNVTDQMADPGSLLVWVRSMLTTRRQFPVFGRGEFIDMGGQNDAVLSFLRVLDDDKHGSQRLLCLNNLSPEEQDVLLYLPDDAGTKPVSLLTSQAMAPIAANGEFHDTLPAWGFAWLDLSKGSDEHESE

SEQ ID NO: 7966 - protein, 178 aa, Arabidopsis thaliana
  misc_feature (74)..(74): Xaa can be any naturally occurring amino acid
  misc_feature (116)..(116): Xaa can be any naturally occurring amino acid
  misc_feature (125)..(125): Xaa can be any naturally occurring amino acid
  misc_feature (171)..(171): Xaa can be any naturally occurring amino acid
SGIFGANHPSGLKTQWSFHPWFPKISVSFPVTRKARDDITSITSNGGRVSCMKAWPPIGKKKFETLSYLPDLSXTVELVNEADYLLRNKWIPCVEFELEHGFVYREHGISLGYYDXRNWTSLKLXLVGGTDSAQRATEVEDCQKEYPGAFFLIIGFDNTRQVQCISFIAHXPPSFTEA

SEQ ID NO: 7967 - protein, 72 aa, Streptococcus suis
MAKEDVIEIEGKVVDTMPNAMFTVELENGHQVLATVSGKIRKNYIRILVGDRVTVELSPYDLTRGRITYRFK

SEQ ID NO: 7968 - protein, 427 aa, Chromobacterium violaceum
MTSPTFKRYSVLASSTLAFTLCFMVWMMFAVLGIPIKQQLGLNETEFGILAATPVLTGSLIRVPLGIWTDRYGGRPVLFALMLSCVLPIYLMQFASAYWQFLLAGLFVGLAGGSFSVGTPYVARWFRKEQQGLAMGIFGAGNAGSALTKLVAPALILAWGWQSVPTAYALIMLAAAILFWLFSFSDPAHKAPSTVTLRQQLALMKHPAVLRYCQYYSVVFGGYVALALWMTKYYVGEYGLDLKHAALLAACFSLPGGVLRAVGGYLSDRFGPYVVTWAVMWVCWVAFFLLSYPQTEMRVATTGGPLSLHIGLNVYLFTGLLFLVGVAMAIGKASVFKFISDEFPDSIGAVSGVVGLSGGLGGFLLPILFGVLLDLTGVRSSAFMLLYGTVCVSLVWMHFSFKSAARAKARARAAEPVNPIPLTNERG

SEQ ID NO: 7969 - protein, 239 aa, Brassica napus
MALQAAYSLLPSTTASIHKEGRFSASLKETNLTSFSFSNNLRSDKISIKKQRRQNPQFSTGIRAQTVTATPPANEASPEQKKTQRKGTAVITGASSGLGLATAKALADTGKWHVIMACRNFLKAEKAAKSVGMSKEDYTVMHLDLASLESVKQFVDNYRRTERPLDVLVCNAAVYQPTAKEPSFTAEGFELSVGTNHLGHFLLSRLLLDDLKKSDYPSKRMIIVGSITGNTNPGAGNVP

SEQ ID NO: 7970 - protein, 326 aa, Mycoplasma pulmonis
MIKKIAILTSGGDSPGMNNAIRAIIKTARLYDIETYLVYEGFLGLYNGWIKPSEGIDEDSYINKGGTFIFSARFVEFAQEKYRQVAKENLLKLGIEALVVIGGDGSYKGAQKLHEMGIKTIALPGTIDNDITSSDFTIGYDTALNTIVEAVDKIRDTASSHKRCIMVEVMGHGASDLALYSGMATGSEIIVSNDYKLSVEEMAKIVKKQFEKPNKRSVIITVSEFVFKDLQQVAKQIEELTNITTKAVVLAHIQRGGYPSARERINATILGKHAVLRLKQGQSGIALGLIKNQVAATPILEALAMPQTRKDLLERRTKSYNDINQA

SEQ ID NO: 7971 - protein, 511 aa, Unknown
  marine gamma proteobacterium HTCC2143
MNMNRRRFLTVGAIGAAAGVLPLSALSNVGAAATKRSWSAAFKDALEQRPWLAGYKSVASDSFQGRAEIRGRWPADLKGTLFRNGPARHEIGNFRYQHWFDGDGMLHGYRMSEEGVTHSAQMIQTHKYKAERAADRALYPGFGTIPPNPSAVTSADTMNSGNISVLPHHGKLLALWEAGSPWEMDADTLDTKGIYRFSEKTAGVPFSAHPRVEPDGTLWNFGYVSGANLIVLWHLDKNGRVIKMGKVASDPISMPHDFIVTTKHIVLMMPPLNYQRRESSFLDSHDWQPELPTRVLVVDKNDFSNFHWLELPSQWVFHFGNGWEDHSGVIRFDGAREPSPVNMLTNFRDVMRGDLVGLSPSHHHQYRIDTKTWRAEEERIFAPNIYTEFPVIDPRVSCRQNKRLIMMSADDQSLPIHGNLNRTSTFDIESGKFSSYRYDDSQIPEEHLFVPKSGSAVETAGWIVGTAHDWKRQLTVLNVFNVDAVDAGPIATATLPYSMPLGLHGKFVASA

SEQ ID NO: 7972 - protein, 599 aa, Zea mays
MASAKESYRAELRASSRQLGERCLYSAAKWAAELLVGVELDGTPVPSAATDSPSSSSAASAGRLLHLHRSGGSSFRHRPRPGGGSSSEAGTPLGGVSYVSTPIPDDDAFDSGGDKYLLAKTYFDCREYRRAAHVLQNQVGRKAVFLRCYALYMAGEKRKEAEMIELEGSLGKSNAVNQELVALEKELSTHRRTGSIDSFGLYLYGIVLRDKGCEGLARTILVESVNTYPWNWSAWSELQSLCTSSDILNNLNLKNHWMKDFFLASAYLELKMHEEALKRYERLMGVFRCSGYIQAQIATVQYSMRDLDEAEMIFEELLRTDPFRVDSMDIYSNLLYAKESLTALSFLAHRVFLTDKYRPESCCIIANYYSLKGQHEKSVLYFQRALKLNRKYLSAWTLMGHEYVELKNSPAAIDAYRRAVDINPRDFRALYGLGQIYEMMGMPFYALYYFRKSSYLQPNDARLWIAMAQCYESDPLQMIEEAIKCYERAANSNDTEGIALHQLAKLHGMLGQSEEAAFYYKKDLERMEVEERQGQNFVEALLFLAKHYKSIGRFEDAEHYCTRLLDYTGPEKETAKNMLQGIKRLQSGFPSMDIDHFAL

SEQ ID NO: 7973 - protein, 359 aa, Mycobacterium tuberculosis
MATHQVDAVVLVGGKGTRLRPLTLSAPKPMLPTAGLPFLTHLLSRIAAAGIEHVILGTSYKPAVFEAEFGDGSALGLQIEYVTEEHPLGTGGGIANVAGKLRNDTAMVFNGDVLSGADLAQLLDFHRSNRADVTLQLVRVGDPRAFGCVPTDEEDRVVAFLEKTEDPPTDQINAGCYVFERNVIDRIPQGREVSVEREVFPALLADGDCKIYGYVDASYWRDMGTPEDFVRGSADLVRGIAPSPALRGHRGEQLVHDGAAVSPGALLIGGTVVGRGAEIGPGTRLDGAVIFDGVRVEAGCVIERSIIGFGARIGPRALIRDGVIGDGADIGARCELLSGARVWPGVFLPDGGIRYSSDV

SEQ ID NO: 7974 - protein, 581 aa, Coprinopsis cinerea
MFSRYLLRAHPHRTSQPLKKVPPTLSSLTRTYAQQHKPSPNAFRLPPTLTQLVTNPSNHLNGEIEVSGWIKSIRKQKNVAFAVLTDGSSDKGLQAVLVRGEGEEDGDVLRSLTNGAAVRLRGRLVESPGKGQSHELLVERGKEGAVEVLGECDPETYPIQKKLLSNEYLRDNVHLRARTSQNAAMLRLRSGLSRRLGEWFENQGFYAVNTPILTANDAEGAGESFRIAPLPSGHPAASPSPSTPTSSTPSTSPSTSPSTCPSPSPSHPNSNQNQQLEEFFGRPAHLTVSHQLHLEAIATGLSRVYTLSPCFRAEPSLTGRHLAEFWMLEAEWAFIQQQHQNGGGVHEVCDVVEAMLRGTVGPLVNPANLNPDIQTLWKSSASSSGQNAALHDKKLSNLQSAFGTNEWWPRMSYTEAITHLETAPRSTKAKWEFEPKWGRPLQSEHERWLVDELVGGGRPVFVTDYPVGVKPFYMRENELREGEGDEGRGTVACFDLLVPGVGELVGGSVREERPEILSRKMREAGLADGGAYKWYEDIRKYGGAPHAGFGMGFERLVSWVGGVENIRECIPFPRWAGRLLL

SEQ ID NO: 7975 - protein, 221 aa, Triticum aestivum
  misc_feature (50)..(50): Xaa can be any naturally occurring amino acid
  misc_feature (99)..(99): Xaa can be any naturally occurring amino acid
  misc_feature (104)..(104): Xaa can be any naturally occurring amino acid
SATTHASAHASYSARKRKPTPRTCSRTRGRRPTPPPYRSPTAQYQNPQTXVLMALMQGLCAARYRKADNTPCLVDQGLYLGSVGAALNNEALKSLRVAXVLFVXRSLNPAFPAEFTYKKIEVLDSPDTDLGKHFGECFTFIDEGICTGGNVLVHCFAGRSRSVTVVLAYLMKKHQMSLQSAMSLVRSKRPQIAPNAGFISQLVNFEKSLQVEQGQRTLQSN

SEQ ID NO: 7976 - protein, 347 aa, Solanum tuberosum
MAFLSSLVASLLLVGLLIQITGAQPIGVCYGKIANNLPSDQDVIKLYNANNIKKLRIYYPDTNVFNALKGSNIEIILDVPNQDLEALANPSNANGWVQDNIRNHFPDVKFKYIAVGNEVDPGRDSAKYARFVGPAMENIYNALSSAGLQNQIKVSTATYLGLLTNTYPPRNSIFREDYRSFINPIIGFLARHNLPLLANIYPYFAHADDNVPLSYALFNQQGRNDAGYQNLFDALVDSMYFATEKLGGQNIEIIVSESGWPSEGHPSATLENARTYYTNLINHVKGGTGTPKKPGKTIETYLFAMFDENRKDGKPSEQHFGLFYPDKRPKVSTQFQLMITCLINSTI

SEQ ID NO: 7977 - protein, 137 aa, Thiobacillus denitrificans
MRLLHTMLRVGDLDRSIDFYTRVLGMTLLRRKDYPDGKFTLAFLGYEPEDRAAVLELTYNWGVDRYEIGTGYGHIAIEVDDAAAACTAAADKGVRILRPAGPMANGSTVIAFVEDPDGYPIEFIQKGTAGWVKEWAE

SEQ ID NO: 7978 - protein, 488 aa, Physcomitrella patens
MNRDMVGIVSSASARLEENPRLESYIASTGELAGWVEKSASVEATRSSLQLSQSQAFFEQYSTQYPQSDISSSSQADISAHDYLNIFKGTHAQAKADMKPRITQFMIPVQNQLEAGSYLLPHMAHDDSNNFSTSSNIGRATQSLCTMHQDMETLRQVPKSNDLLIAITASAAAAVNQERGSGSETGQHDRDDDEKNKATDRGKLPENEEEQLLRDAIVDHPLYPELVVAHISIFKIGAPKGLLIKLDEMEKKFQRFQYGESSWNVLHVTKFGQDPSLDFFMRSYIDLLTKFREDLENPYNKFAQYKDKVTKDLEDLCGHYIETTPDEEDNFGSDIGTKDMSQDLNDLEILGEENLMYTADIDESIVIDPDAADEELKKMLRLKYGKHIAGLKAEFNRVRKKGKLPTNARQILKDWFSRHSYWPYPSEMEKAYLQRLCGLNLKQINNWFINERKRHWSCKGKCMYPNTKFYPRDGHVDPNNHGEGYLEQ

SEQ ID NO: 7979 - protein, 515 aa, Gibberella zeae
MGFQITHLWKAPEVNPISRKARSVPMLNPIDMYGRVFSFSWLGFMLAFWAWYTFPPLLTVTIKEDLHLTPAQIANSNIVSLSATFFLRFLTGPLCDLYGPRRVFAYLILLGCLPIGLAPLVNSATGLYVSRFFIGILGATFVPCQVWCTGFFDKNVVGTANALAGGWGNAGGGITYFIMPAVFDSLVANHGLTPSKAWRVTFIVPLVCLIVCGLGMLLLCEDSPMGSWDNQNELVRKNMEAHGISSSGDVTPIGTRTPDRAGSDEEKSPGEEKDVKVGDHEHSISRTEAMEIARGEIVVKPSLREALPVTYSPQTIFHIATYACSFGGELAINAILSSYFKKNFPHLDQTKASNYAAIFGFLNFVNRPLGGVIADLLYNNFGRSLWLKKVWIITCGLVTGALLIVIGKVNPSEANGGNIGTMVGLVVVMAIFIEAGNGANFALVPHVHPSANGILSGLTGGGGNIGGVIFAIVFRFMHGGNDYAMGFWVIGIITIALNLAVCWIPPLPKGQIGGH

SEQ ID NO: 7980 - protein, 316 aa, Unknown
  Synechococcus sp. CC9605
MSTPGTVLITGTTSGVGLNATCALVKRGWTVITANRSPQRAAAAADELDLPKDRLKHVLMDLGDLDSVRRAVDALPERLDAVVCNAAVYKPKLKQPERSPQGYEISMATNHFGHFLLVQLLLGRLKASTHPSKRVVILGTVTANSKELGGKIPIPAPADLGDLSGFEAGFKDPVAMASGKPFKPGKAYKDSKLCNMITTQELHRRLHGDTGITFTSLYPGCVADTPLFRNTPKAFQTIFPWFQKNITGGYVSQSLAGERVADVVAHPDFAESGVHWSWGNRQKKDGEQFSQELSDKATDPETARRVWELSMKLVGA

SEQ ID NO: 7981 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGKGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 7982 - protein, 157 aa, Daucus carota
NQQGRLSQEQSYRGVRKRKWGKWVSEIREPGKKARIWLGSYEAPEMAAAAYDVAALHLRGSAAHLNFPELVGSLPKPVGSSHADVQRAAQEAAMGFGKSENRGPVTVQLSSSEIRAINESPLDSPKMWMEMGGSVFLEERRDEEQLEEMQCSSLWKF

SEQ ID NO: 7983 - protein, 743 aa, Unknown
  Synechococcus sp. RS9916
MGASTPTCSEFPAMSDLKCPFSGHGSATTPARDSGLHQWWPNQLRLEILHQHHPAANPLGEQFSYREAFAQLDLEALKLDLRALMTDSQPWWPADWGHYGALFIRMAWHSAGTYRSADGRGGAGHGNQRFAPLNSWPDNTNLDKARRLLWPIKQRYGNAISWADLIILTGNVALESMGLKTFGFAGGRTDTWAPEQDVFWGSETSWLSDQRHNSEGQLDNPLAAVEMGLIYVNPEGPEGHPDPVASGRDVRETFARMGMTVEETVALVAGGHTFGKCHGAASADHLDAEPEGAALEQQGLGWTNRFATGMAEHTITSGIEGAWKPHPTRWDQGYFEMMFTYDWELTKSPAGAWQWVAKDVRPEHMIPDAHVAGKNAAPIMTTADLSLRHDPLMEPVARRFHQDQEAFADCFARAWFKLTHRDLGPKALYLGADVPNETLIWQDPLPIVDHPLVNSDEQNELKQDLLSLGLSVGELVSTAWASASTFRNSDRRGGANGARIRLQPQNNWEVNDPAQLDRVLGALQDLQSRFNRSNPSGAQISLADLIVLGGNAAVEQASRDAGHIIEVPFQAGRVDAGEEHTDAASFNVLKPMADGFRNWQRQGLPIRAEELLLDRAQQLTLSAPEMTVLLAGLRVLGANSGGNLEGVFTHRIGVLSTDFVVNLLDMDTTWAPTDQTNNHYEGRDRDTGALRWRASRADLVFGSNSQLRAIAEVYAQRDGGKRFVTDFVKAWVKVMELDRFDLL

SEQ ID NO: 7984 - protein, 93 aa, Arabidopsis thaliana
  misc_feature (40)..(41): Xaa can be any naturally occurring amino acid
  misc_feature (44)..(44): Xaa can be any naturally occurring amino acid
  misc_feature (58)..(58): Xaa can be any naturally occurring amino acid
  misc_feature (60)..(60): Xaa can be any naturally occurring amino acid
  misc_feature (65)..(65): Xaa can be any naturally occurring amino acid
  misc_feature (68)..(68): Xaa can be any naturally occurring amino acid
MAAPEAPVKYVGICKDSAAFKLMKSMGWEEGEGLGKDKQXXKGXYVRVTNKQDTCGCXGXINPNXWAXLRAWKVRCGRLDLGVRMLIRFCVCT

SEQ ID NO: 7985 - protein, 1102 aa, Schizosaccharomyces pombe
MPQSQVATASPSQNAQPNHGMGSKVLSSDPNASLPPQTAYYASPLHANSVSLPPSHLPRSTLHPLLSQQQQPAQQSPSLGPAQQNIQQPPSVSIASQPHYAEAIVPIQQVLQPQQYRQLPPNMVAATNAPQQHPQLQRMMPILSSNQPIQQLPLPNQASPYIPVPLQQQQQSQPQQQPQQQQHQQPQQPQPPQQPLQQQQQQRQLHSGIQQPVSTIVSQNGTYYSIPAVNHPMAGQPIAIAPVPAPNQAALPPIPPQALPANGTPNTLASPVTLPAANSAVQNAQPVPMTSSPAMAVVPQNKTAATSTLAAQQGANVLPPNAPESVRHLISLNEETWIQIGRLAELFDDQDKALSAYESALRQNPYSIPAMLQIATILRNREQFPLAIEYYQTILDCDPKQGEIWSALGHCYLMQDDLSRAYSAYRQALYHLKDPKDPKLWYGIGILYDRYGSHEHAEEAFMQCLRMDPNFEKVNEIYFRLGIIYKQQHKFAQSLELFRHILDNPPKPLTVLDIYFQIGHVYEQRKEYKLAKEAYERVLAETPNHAKVLQQLGWLCHQQSSSFTNQDLAIQYLTKSLEADDTDAQSWYLIGRCYVAQQKYNKAYEAYQQAVYRDGRNPTFWCSIGVLYYQINQYQDALDAYSRAIRLNPYISEVWYDLGTLYESCHNQISDALDAYQRAAELDPTNPHIKARLQLLRGPNNEQHKIVNAPPSNVPNVQTAKYINQPGVPYSNVPVAQLSGNWQPPHLPQAQLPSATGQSGVVQQPYQTQPSVTNNNVATQPVIASTVPVQTAAPSSQTAVPQTIHQSNAFTPRGKHASGSRNSISSTKSPQHKLSDQPRSRNNSISNVSHRERSNSVSSKSRETRTSASNESDPKKSTQRDSSKKLENSTVVSGSPSSSSKSDAAKSIKPQKPEPALKPVEGTADPKSTKRNHQETEKTADTDVSSTEPVKRQKTADVNDDVGEEEVKQSVSEQVDSAQLTSEPKSESLPKSPEEKSDDTSNDVTTENTNDINGDSNMDNVATVDKSTDAVDTSTATVAATTTTAEEELPQKESQERSSPSPENQDSTPLAPKSVSPKQAARTLDIDENYDDDEGEKETVSV

SEQ ID NO: 7986 - protein, 300 aa, Prochlorococcus marinus
MVRLNEIKMQDGKVFLITGANSGLGYETSKFLLERGATVIMSCRDLIKGEKAKQELLKFNFSGKIELVELDLSDLINVKKFAESIKNKFDYLDVLINNAGIMAPPKTFSKQGFEIQFAVNHLAHMFLTLELLPMLEEKNNSRVVTVTSGVQYFGKIQWADLQGNLKYDRWASYAQSKLANVMFGLELDSKLKESNSKTSSLLAHPGFARTNLQPKSVEANQSWQEELAYKLMDPMFQSAKMGALPQITAATLTSASGGEQYGPRFSFRGYPKICSNAPKALNQTSRKKLWEISEKLIKGV

SEQ ID NO: 7987 - protein, 521 aa, Solanum lycopersicum
MGICASKGKPNNANNGHHGSGSGGVPIHRNEIQYTKSPGPEAQLHVRPPPSPKPAVRYDTILGKPYEDVKLHYTLGKELGRGQFGVTYLCTEIATGQQYACKSISKKKLVTKADKDDMRREIKIMQHLSGQPNIVEFKGAYEDKGSVYLVMELCGGGELFDRIIAKGHYSERAAATMCRAIVNVVHVCHFMGVLHRDLKPENFLLSDKSENAALKITDFGLSVFIQEGKSYKDIVGSAYYVAPEVLRRCYGKEIDIWSAGVMLYILLSGVPPFWAETEKGIFDAILKGTIDFESKPWPSVSSSAKDLVQKMLTKDPKKRITAAQVLEHPWLKEGGVASDKPLDGAVLSRMKQFRAMNKLKKLALKVIAENLSAEEIHGLKAMFHNIDTDNSGTITYEELKSGLAKLGSKLTEAEVKQLMEAADVDGNGSIDYTEFITATMHKHRLERDENLYTAFQYFDKDSSGFITRDELEAAMEEHGIGDPSCIREIISEVDTDNDGRINYEEFCTMMRSGAKQPGKVF

SEQ ID NO: 7988 - protein, 135 aa, Actinobacillus pleuropneumoniae
MSDILKTLSNIRNLRALAKDSTLEQMESLLEKVSIVVEEKRELVKAQELEQAKVMEGLKKYKELLAQDGISAEELVALLNNATEHKKREPRAPRPAKYKYVDENGNEKTWTGQGRTPRPIQKALDEGKSLASFAI

SEQ ID NO: 7989 - protein, 277 aa, Zea mays
MEDVLTPPPQPELAGEKRKREESSLDASIEDAPSAPASTCSAEDAAGSDVARHPMWKTSLCSFFRRRGAGAEGCSHGDSCRYAHTEEELRPRPDGTWDPTSDRAKELRKVAAEAQEEAEEEVTVDEQSLDKCLVGLPRGWTADRLKSLLQDQGISYATAKKKKGMTVGFVTFQSVEQLTNAVQVLKENPSDGKQIKIVDANRRSHQKAHAGAPVSNTGTATENGSSPTTPAEETSVPESVSSSKKGARDAVTPLAHMTYIDQLEHKKASMAQILKKL

SEQ ID NO: 7990 - protein, 783 aa, Wigglesworthia glossinidia
MKRMLINATQQEELRIALVDGQKLYDLDIENLRYIQKKSNIYKGKITRIEPSLEAVFIDYGEERHGFLPFKEIAIEYLYKNNIYYNKSNIKDILKENQELIVQIEKEARGNKGAALTTFISLAGSYLVLMPNNPKSGGISRHIEGEDRTELKEILYSLEIPNGMGIIIRTAGLGKSIKDLKLDLSFRLSHWDKIKKAAQKKRAPCLIYRESDVVSRAFRDYLRPDIKEILIDNPKILELSKEYIISLGRPDFIKKIKLYSGEVPLFSHYQIESQIESAFQREVKLPSGGSIFIDNTEALTAIDINSAKSTRGIDISETAFNTNLEAVHEISIQLRLRDLGGLIVIDFIDMNTSKHQREVEKLLKELAKQDRARIQIGQISKFGLLELSRQRMSHSLRESSHYICPRCNGTGTIRDKESLSLSILRLIEEESIKDNTYKVYTIVPVDIASYLLNEKRDAVSAIEKRKQGVRTVIIPNDKMKTPNYLVLRVKIGEQSNIPSYLIPKIYESDCINIPNGSFYDKKCYDNQNLFFNELKYTEKNSSLYFYKSQSKKTNFNNLVKYQNLFKRLIYNLKNLLYILKNQKNFDKKNNIFISENFSCDSSKDIFNKKIFKEKNIENKNYLNDKKIKNIKKFSENNNDSFFYCSSYEESNKLKIKKNNSKFTHINYNNKFFSQNKNLNSIIRENLNEKNIKLISNTKNNNIIFNKNKKHLVFTNKIRRIPKYLRLVCSKKKYQNKSNNFLIKKISYKNKNSNVEKNKIINKNNINKAKIIKKVQIKKKQKII

SEQ ID NO: 7991 - protein, 164 aa, Arabidopsis thaliana
MGLKQSSPFPCVSPLFLLAVNIHGSTRISAFGILAGIKTIAGLFGTLVARFLPIALTFQVSAISFFVGLVYMRVFLKEKLNDDEDDDLHHGTYHQEDHDSINTTMLAEPILNDRPIKTQVFHKKYSSLKDMISLMKTSTIFFQALVVTFFSSFSDSGMESAFLV

SEQ ID NO: 7992 - protein, 284 aa, Fulvimarina pelagi
MALPDYSMRQLLEAGVHFGHQTHRWNPKMSPYIFGARNNIHILDLAQTVPLLHRALQAVSDTVARGGRVLFVGTKRQASDIIADAAQRSAQYYVNARWLGGMMTNWKTISHSIQRLRKLDELLSGEAQGFTKKERLTLTRERDKLETALGGIRDMGGVPDMMFIIDTNKESIAIDEARRLGIPVVAVVDSNCDPARVDYPIPGNDDASRAIALYCDLIARAAVDGIARQQGDSGMDIGEMEDAPAEVIEEAKTEAEVPGDQPGEAPVEEQPVGQAAQTAATPTP

SEQ ID NO: 7993 - protein, 559 aa, Symbiobacterium thermophilum
MAQRKIVIVGGVAGGATAAARARRTDEHAEIVLFEKGPYISFANCGLPYYVGKEIGDRSALLLQTPESFRARFEVDVRVLHEVVAIDRAAKRVTVRNLETGEVYHESYTALVLAPGSVPIRPPLPGIGLPNVFTVRTVPDAVAIRELVERESPARAVVVGAGFIGLEMVENLAGLGLAVTLVEKADQVLPPLDPEMAAFVQSHLEQMGVEVITGDGIAAFTGNDRATAARLESGREVEGDLFILGLGVRPDTRLAREAGLAIGPTGGIQVNERMQTNDPAIYAAGDAVETIHLVTGRPALIPLAGPANKQGRVAGANAAGDSLTFPGAIGTAIVRVGSLVAAVTGLSEKAARREGLKVYTSYTLSGDHADYYPGMQELMTKLVVESDTGRLLGAQVIGANGVDKRTDVYATAILGRMTVDQLANLDLAYAPPFGAAKDAAVVAGMVAQNIRRAALRVITPEELLGRMEAGEELQVVDVRNPYEYDMGAVPGAVNIPVDELRSRLGELDPSRETVVYDRTGAMAYVAARILAQRGYSVSSLAGGYALFPAAEAVRAQRTL

SEQ ID NO: 7994 - protein, 555 aa, Rubrivivax gelatinosus
MRVLFIHPNYHSGGAEIAGNWPPAWVAYLAGYLKAGGYTDVIFVDAMTNDLSEDQVREKITTLKPDIVGCTAITPAIYKAERTLQIAKEVNPDIVTVLGGIHGTFMYPQVLKEAPWIDAIVRGEGEQVMLNLVTAVDQGRFMADRNCVNGIAYAAPDGKVVATPAEPPIEDLDRITPDWGILEWEKYIYIPMNKRVAIPNFARGCPFTCSFCSQWKFWRDYRIRDPKKVVDEIEVLVKQHDVGFFILADEEPTIHRKKFIEFCEELIKRDLGVLWGINTRVTDILRDEKLLPLFRKAGLIHVSLGTEAAAQLKLDMVNKETTIEQNKRAIQLLKDNGIVTEAQFIVGLENETAETLEETYKMARDWNPDMANWAMYTPWPFSDLFQELGDKVEVFDFEKYNFVTPIMKPDAMDRGELLDRVMSNYRRFFMNKAFLQYPFTKDKERRKYLMGCLKAFLKSGFERKFYDLGRVGYWGPQTKKTVNFSFDKNRRIDAQTADELSRVDDGWVTMHGPKIEMRRRKGDDNFEIAKAAMACGGGTEQLTEEQQAATEVRAS

SEQ ID NO: 7995 - protein, 99 aa, Cryptococcus gattii
FNDQEIVALSGAHAMGRCHTTRSGFDGPWTFSPVTFSNQYFALLRDEPWQWRKWNGPAQYEDKKTKTLMMLPTDMALVKDKSFKKYVDIYANDEEKFFN

SEQ ID NO: 7996 - protein, 363 aa, Coprinopsis cinerea
MRYYEQKYPEVDELVMVQVRQIAEMGAYVKLLEYDNTEGMILLSELSRRRIRSVQKLIRVGRNEVVVVLRVDKEKGYIDLSKRRVSPEDIVKCEERYMKSRAVASILRHVASKTPSFAPDGTIIPASTEQQERDREAKRAARKARQAAKADLPIDEETAVKAAAAEMTEIQIPGTSQNEEEKLEHLYETIAWPLGKIYGHPYDAFKLALTEPDVVFSSLPNPVPEETLSLLRATIAKRLTPQPIKLRADIELTCYTPAGIGAIKKALRAGEKQSTEAVPIKAKLVAPPLYVLSTNATDKYAAVDRLEKSIEAIQNSIEKEGGSLVLKMKPKAVSETEEQDLANLMLKAGQENAEVSGDEDDED

SEQ ID NO: 7997 - protein, 637 aa, Unknown
  Vibrio sp. Ex25
PESEASKYLDADKGITDTKAALDGARAIIMERIAEDANLLEKIRNHLNRNAELVSRVVEGKEQEGEKFKDYFNHNEPLSKVPSHRALAMLRGRNEGFLTLAMNADPEQEEGARQSYCETIIADHYGVTLSSAPADAWRKQVISWAWRIKVSMHMETELMGAMKERAEIEAIEVFATNLKDLLMAAPAGPRATLGLDPGLRTGSKIAVVDSTGKVLATETIYPHPPQKQYDKSAQIVDQLVRKYNVDLIAIGNGTASRETDSFVADVIKRGNLKVQKIIVSEAGASVYSASELAAKEFPNMDVSLRGAVSIARRLQDPLAELVKIDPKSIGVGQYQHDVSQSMLAKRLDAIVEDCVNAVGVDVNTASAALLTRVAGLSSTIAQNIVDFRDENGRFEARTTLKKVPRLGPKAFEQCAGFLRIMDGKNPLDASAVHPEAYPVVKAIAEKNSKDIKALIGDSAFLKGLHAVDYTDEHFGVPTVTDIIKELDKPGRDPRPEFKTATFAEGVNSVSDLEPGMILEGVVSNVANFGAFVDIGVHQDGLVHISALTDRYVSDPREVVKAGDIVKVKVMEVDVQRKRIGLSMRMKDEPGQDNRSQRSSAAPRRNDQAQRRQPRRDESSSNSAMGGAFAAAFAKAKK

SEQ ID NO: 7998 - protein, 177 aa, Mycobacterium leprae
MARTNTRKAILAGGCFWGIQNLFRRQPGVISTRVGYTGGGTPNATYRNHGMHAEAVEIIYDPAITDYRTLLEFFFQIHDPTTRNRQGNDQGTSYRSAIFYLDDEQKKVALDTIAAVEASSLWPGKVVTEVSLAEDFWEAEPEHQDYLQHYPNGYTCHFVRPNWKLPRRAPADAKADS

SEQ ID NO: 7999 - protein, 561 aa, Unknown
  Polaromonas sp. JS666
MSESFADLFNESLQRSEMRTGEVITAEVVRIDHNHVVVNAGLKSEAYVPLEEFKNDQGELEVQVGDFVSVAIDSVENGYGDTLLSRDKAKRLASWMSLEKALESGEFVTGQTSGKVKGGLTVLVNGIRAFLPGSLIDTRPIKDLSPYENKTMEFKVIKLDRKRNNVVLSRRAVVEASMGEERAKLMETLKEGTAVKGIVKNITEYGAFVDLGGIDGLLHITDMAWRRVRHPSEVVTAGQEIVAKILKFDTEKNRVSLGLKQMGDDPWMGVNRRYPQGTRLFGKITNIADYGAFVELEPGIEGLVHVSEMDWTNKNVAPSKLVALGDEVEVMVLEIDEDKRRISLGMKQCKANPWQEFAQDTKRGDRVKGPIKSITDFGVFVGLAAGIDGLVHLSDLSWNEPGEAAVRNYKKGQEVEAIVLAVDVDRERISLGIKQLDSDPFTTFVSINDKGAIVTGKVKTVDAKGAEIDLGEDIIGYLRASEISRDRVEDARNVLKEGDEVSAVVVNVDRKTRNIQLSVKAKDNADQQEAMANLSQQSSRENAGLTNLGALLRAKLDNNEK

SEQ ID NO: 8000 - protein, 181 aa, Triticum aestivum
MSSTGAAGPDADAAAGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYPAEDYHQQYLEKGGQSAKKRCSDPIRCYG

SEQ ID NO: 8001 - protein, 485 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALGNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 8002 - protein, 180 aa, Streptococcus pyogenes
MLEQDIQKILYSENDIIRKTKKLGEQLTKDYQEKNPLMIGVLKGSVPFMAELMKHIDTHVEIDFMVVSSYHGGTSSSGEVKILKDVDTNIEGRDIIIVEDIIDTGRTLKYLRDMFKYRKANTIKIATLFDKPEGRVVKIEADYVCYNIPNEFIVGFGLDYAENYRNLPYVGVLKEEVYSK

SEQ ID NO: 8003 - protein, 553 aa, Unknown
  Vibrio sp. Ex25
MFCIQCEQTIQTPAVKGCSFAQGMCGKTSEVSDLQDVLVYTLQGVSFWASKALEFNIINDEINQWAPKAFFSTLTNVNFDPERVLELTSQAATYKALLKEQVMSAATLADTEVADIPAVAHFELPNSAEAILAFAPQVAVNRGKDQVHEDVIGLRLLCLYGLKGAAAYMEHARVLEQTNNDIYAEYHEIMAWLGTDPEDLGELLDCSMRIGLMNYKVMEMLDQGETTTFGHPEPTTVNVKPVKGKCILVSGHDLHDLEKILQQTEGKGINVYTNGEMLPAHGYPELKKYSHLVGNYGSAWQNQQKEFANFPGAIVMTSNCLLNPNVGQYADRLFTRSIVGWPGVAHIEGDDFSQVIECALAQDGFQHDEIEHHITVGFGRNALMNAAPAVIDQVKQGNIKHFFLVGGCDGDKAERSYYTDFTAEAPEDTLILTLACGKFRFNKNTFGDINGIPRLLDVGQCNDAYSAIQLALALAQEFDCDINELPLTLVLSWFEQKAIVILLTLFALGVKGIYTGPTAPAFLTPNLIAIIQEKFDMRSIGNVQDDLKAILAA

SEQ ID NO: 8004 - protein, 88 aa, Arabidopsis thaliana
  misc_feature (5)..(5): Xaa can be any naturally occurring amino acid
  misc_feature (9)..(10): Xaa can be any naturally occurring amino acid
  misc_feature (13)..(14): Xaa can be any naturally occurring amino acid
  misc_feature (18)..(20): Xaa can be any naturally occurring amino acid
  misc_feature (22)..(24): Xaa can be any naturally occurring amino acid
  misc_feature (27)..(28): Xaa can be any naturally occurring amino acid
  misc_feature (32)..(32): Xaa can be any naturally occurring amino acid
  misc_feature (37)..(37): Xaa can be any naturally occurring amino acid
  misc_feature (45)..(45): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(60): Xaa can be any naturally occurring amino acid
  misc_feature (62)..(63): Xaa can be any naturally occurring amino acid
  misc_feature (67)..(68): Xaa can be any naturally occurring amino acid
  misc_feature (75)..(75): Xaa can be any naturally occurring amino acid
  misc_feature (77)..(80): Xaa can be any naturally occurring amino acid
  misc_feature (86)..(86): Xaa can be any naturally occurring amino acid
ISMEXKQGXXSVXXGVSXXXTXXXTAXXSNPXMALVXERMSTEGXGLPFGLSXTLLXWXXFXXFGLXXTFFLVYXSXXXXDEEFGXSL

SEQ ID NO: 8005 - protein, 422 aa, Thiomicrospira crunogena
MKYYCETKSATDLTRKTLALVLAGGEGSRLKDLTKWRAKPAVPFGGKYRIIDFVLSNCVNSGIRKIGVLTQYKSHSLIRHVQRAWSFMRYEVGEFVELLPAQQRVDKGWYKGTADALYQNLDIMRRHTPDYVLVLGGDHIYSMDYSKMLYEHAESGADVTIGCIEVPRMEATGFGVMSVDECFKITKFTEKPANPDAMPHKPDKALASMGIYVFSTEFLFQKLIEDADNPNSSRDFGKDIIPSIIEDWQVRAFPFEDETGLPVYWRDVGTIESYWKASLDLCSITPDLNLYDEDWPIWTYQAQMPPAKFIFDDEGRRGEAIDSLVAGGCIISGARIKRSVISSGGHVHSFCLVKDSVLLPRVKVERNCRIQNAVIDKGCVIPEGTVIGEDLEADRKRFYVEEASGIVLVTPDMLGQRLHITR

SEQ ID NO: 8006 - protein, 485 aa, Taxus cuspidata
MNTFSFLEFIQLQSILFLTLLALLLLCLFRYKTQSSAVKLPPGNLGFPFIGETIPFLRALHSETPQTFFDERMKRFGNVFVTSLIGQPIVVLCGPAGNRLLLSNEDKLVEMSPPKFSLKLIGQDSLLSKREDEHRTLRAALARFLRPQALQSYMGIMSSEIEHHINEKWKGKDEVKMLPLIRGLIFSIATTLFFDINDEHLKDRLHHLLETILVGTVSLPLDFPGTSFRKAVEARSKLDEILSSLIKSRRSDLHSGIASDGQDLLTVLLTFKDERGNSLADNEILDNFSLMLHASYETSVSPTVLMFKLLSSNPECYDKLVQEQLGILANKKEGEDISWKDVKAMKYTWQVVQETMRIFPPGFGSYRKAIIDIDYDGYTIPKGWQLYDALYYTWERTVLPYPEQFRPSRFEEGELVAPYTFLPFGAGARICPGWEFAKTEILLFVHHFVKNFSSYHLVDPKEKISGNPFPPLPNNGFSLKVFPRS

SEQ ID NO: 8007 - protein, 246 aa, Kluyveromyces lactis
MSDYRAPVNHYGSRNSTRPLNPKLLEEIQPFDLNAQPREKEIVDTLGEIYSIIITLDHVEKAFLKDDIGSEEYTRLANKLINQYRTYLSDEDVEEQFKSLDHFKAKWQITASNAITRLERGIPVTVEHGTSGDTDSLDNSRAADNTTNLNKYSGKRVAEATGNFITVMDALKLNYKTREQLHPLMAELLLSINRVTSNDFENRSKLVEWIVKINKLPKDEQLSDADSQQLLYSLESAYKSFYTLLE

SEQ ID NO: 8008 - protein, 352 aa, Campylobacter jejuni
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCACRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKALGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 8009 - protein, 320 aa, Daucus carota
PRAEFGTRYSDPCSEELMKALEPFMKSASSTDTSSSISSLSPSPTSNFYYPFDSSFSTQPPTFPVYSPPESTTQMFSTGFSGFAHMGMDQTGSLGLNQITPSQILQIQAQIQLQNQQNYYSSISSLPPQPQRSSNFLGPKPVQMKHTGSPTKPTKLYRGVRQRHWGKWVAEIRLPKNRTRLWLGTFDTAEEAALAYDRAAYKLRGDFARLNFPHLKLDQELSTFKPLHSTVDAKLQAICQNLNKEPKQKSAKKPKTSKPAFVKVEEASNGSDLSGGSSPESEISFLDFSEPCFDESENFMLQKFPSVEIDWEALTSSLMS

SEQ ID NO: 8010 - protein, 432 aa, Neisseria gonorrhoeae
MPSETALPLYADTRAAHTLVWFRQNLRIRDNAALCAAVAEGSPVIGIWIDDAETDNPRRAAFYRQSAAELAQGLARRGIPLYTAASPAGLVRLAVRLNIRAVIADESHTFADKLADNALWHELDKHGIALTFVNDRSVFGKTDLTPDNGTAHTDFNRYREVWLDRFSKQPPAGSDLFAAYRQPFPENLPAPPPAALSDGIFLPQNGGETAAWRQWRRFLEQAASYSVLKDFPSRKNTSLMGAYLSVGCISPRLLARESLERRLNAWADNIIRRDFFLQLALQHADDDPSDGNPEHTLRLTLWQQGRTGIPIIDAAMRCLHKTGSLHPALRRLSADFFCHVLNLPRREGEIWFARQLTDFDAAINQGNWRLAASRHTCPDIAAASYRTDPDGTFIKRHIPELAHLSADTVHTPWRFACSVDTHGYPARPVAGV

SEQ ID NO: 8011 - protein, 197 aa, Zea mays
MSVPEAGQSAGRDEQEMDNYEQHQTRVLMALMQGLCAARYRKADNTPCLVDQGLYLGSVGAALNNEALKSLNITHILVVARSLNPAFPAEFTYKKIEVLDSPDTDLGKHFGECFTFIDEGICTGGNVLVHCFAGRSRSVTVVLAYLMKKHQMSLQSAMSLVRSKRPQIAPNAGFISQLVNFEKSLQVEQGQRTLQSN

SEQ ID NO: 8012 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 8013 - protein, 422 aa, Unknown
  Magnetococcus sp. MC-1
MNTADLKSFDPEVQSAIDEELGRQRHQIELIASENIVSPAVMAAQGSVMTNKYAEGYPAKRYYGGCEFVDKVEVLAIERAKQLFGCAYANVQPHSGSQANMAAFMAIAPAGSTILGMSLAHGGHLTHGAKVNFSGQIYNAVQYGLNGESERIDFDQVQALAMEHKPAIIVAGASAYSRIIDFAKFREICDAVGAKLVVDMAHFAGLVATGEHPSPFPHADIVTTTTHKTLRGPRGGMILTNDEELAKKINSKIFPGIQGGPLMHVIAAKAVAFKEALSPEFKIYTQQVRKNAVALAEVLVEGGLRIVSGGTDNHLMLVDLTSRDITGKDTEHALERAGLTCNKNAIPNDPRSPFITSGVRLGTPAATTRGFDEEAFRAVGRLIVRVVDAVAASGGAGDPAIEAEVHKEVDALCQKFPIYADI

SEQ ID NO: 8014 - protein, 432 aa, Clostridium josui
MSNLILGSDGKLLKTKRKWTKAIGVALSISVLSSLVSFIPQTNTYAAGTYNYGEALQKSIMFYEFQRSGDLPDDKRDNWRGDSGMKDGSDVGLDLTGGWYDAGDHVKFNLPMSYTSTMLAWSLYEDKDAYDKSGQTKYIMDGIKWANDYFIKCNPTPGVYYYQVGDGGKDHSWWGPAEVMQMERPSFKVDASHPGSAVCASTAASLASAAAIFKSSDPAYAEKCISHAKDLFDMADKAKSDAGYTAASGFYSSSSFYDDLSWAAVWLYIATNDSTYLDKAESYVPNWGKEQQTDIIAYKWGQCWDDVHYGAELLLAKLTNKQLYKDSIEMNLDFWTTGVNGTRVSYTPKGLAWLFQWGSLRHATTQAFLAGVYADWEGCTPSKVSVYKDFLKSQIDYALGSTGRSFVVGYGVNPPQHPHHRTAHGSWTDQMN

SEQ ID NO: 8015 - protein, 234 aa, Escherichia coli
MCANTPLVTTLTPMTDFRESDTMSLFDKKHLVSPADALPGRNTPMPVATLHAVNGHSMTNVPDGMEIAIFAMGCFWGVERLFWQLPGVYSTAAVYTGGYTPNPTYREVCSGDTGHAEAVRIVYDPSVISYEQLLQVFWENHDPAQGMRQGNDHGTQYRSAIYPLTPEQDAAARASLERFQAAMLAADDDRRITTEIANATPFYYAEDDHQQYLHKNPYGYCGIGGIGVCLPPEA

SEQ ID NO: 8016 - protein, 338 aa, Pseudomonas syringae
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMADVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 8017 - protein, 570 aa, Unknown
  Magnetococcus sp. MC-1
MTDDLILDDIADEDFEALLEESFSKGVGREGSVVTGTIIQREGDEFIIDVGLKSEGRLTIREFYDADGQLTIGVGDSVDVFVERCEDQNGLAVLSREKAKREEAWVLLEEAFNDGKTVDGRIMGKVKGGYTVDLGGLAAFLPGSQVDVRPVHDISRLQEETQPFDILKMDRRRGNIVVSRRTVIEKHRENARSALLETLHEGMVLDGIVKNITDYGAFVDLGGLDGLLHITDMSWKRVKHPSAVVNVGDTVTVQVIKFNSDTQRISLGMKQLLIDPWEGIGAKYPAGAKFSGHVTNITDYGSFVELEPGVEGLAHVSELTWTKKNIHPSKILEVNQIVEVMVLDVDADRRRISLGIKQCQENPWEAFATSHPVGAMVKGEIKNITEFGLFVGLEGDIDGLVHLSDITWDTNAGEEVLKDFQKGQEVEAMVLSLDPDKERISLGLKQAQPDAWGQWVDANPKGNVVMGKVKEVLSSGVLVQLADEVDGHIRKAEFSQDDREGTNLTLETEVECRVMQVDRQKRKISLSIKAMEVQQERDAIKEYASDSSSAATSSLGEALSQALEKANAAE

SEQ ID NO: 8018 - protein, 271 aa, Anabaena variabilis
MKSYLAAAIQMTSVPDLHKNLAQAEELIDLAVRRGAELVGLPENFSFMGEEQDKLAQAEAIARESEIFIKTMAQRYQVTLLGGSFPVPVSDTGRVYNTTILVSPSGEELARYNKVHLFDVNVPDGNTYRESSTVVAGQQLPPVHFSENLGNIGVSICYDVRFPELYRHLSDKGTDIIFIPAAFTAFTGKDHWQVLLQARAIENTAYVIAPAQTGNNYGRRLTHGHAVVIDPWGTILADAGDKPGIAIAEINPSRLEQVRRQMPSLQHRVFS

SEQ ID NO: 8019 - protein, 131 aa, Arabidopsis thaliana
  misc_feature (3)..(4): Xaa can be any naturally occurring amino acid
  misc_feature (8)..(8): Xaa can be any naturally occurring amino acid
  misc_feature (43)..(43): Xaa can be any naturally occurring amino acid
  misc_feature (46)..(46): Xaa can be any naturally occurring amino acid
  misc_feature (49)..(50): Xaa can be any naturally occurring amino acid
  misc_feature (54)..(54): Xaa can be any naturally occurring amino acid
  misc_feature (62)..(62): Xaa can be any naturally occurring amino acid
  misc_feature (66)..(67): Xaa can be any naturally occurring amino acid
  misc_feature (73)..(74): Xaa can be any naturally occurring amino acid
  misc_feature (83)..(83): Xaa can be any naturally occurring amino acid
  misc_feature (91)..(91): Xaa can be any naturally occurring amino acid
  misc_feature (105)..(105): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (124)..(124): Xaa can be any naturally occurring amino acid
  misc_feature (128)..(128): Xaa can be any naturally occurring amino acid
MGXXPARXYRQIKGKPYPKSRYCRGVPDPKIRIYDVVMKRKGXDDXPFXXHLVXWEKDNVSXEALXXARIACXXHMVKSAGKXAFHLRIRXHPFHVLRINKMLSXAGADXLXTXMRGAFGKALXTCAXVAI

SEQ ID NO: 8020 - protein, 236 aa, Hyacinthus orientalis
MATGAEEVKLLGMWASPYAMRPRIAMNLKGVGYEFLPETYGAKSDLLLKSNPVHKKIPVLIHNGKPVCESMIIVEYIDEVWSAGAAPILPAAPYDRAVARFWAAYIDDKLFPSLRAVTAEAKADAVSQVHALLQLLEEAFQKCSQGKGFFGGDTIGYLDIALGCYAGWIKAAETMSRTKLLDEENTPLLAGWSEPFCADARSERGDAGDRQAGGSWPIYVWLRFTDAPPCSMRGLF

SEQ ID NO: 8021 - protein, 451 aa, Schizosaccharomyces pombe
MSLEENVKEAKNAFNILQTLSVEDRDDALDKIVEELRIKKSEVLAANAEDMKAAKLLAESGKLSSSMVKRLDLSSSDKYDSMVQGVLDVKSLPDPLGRVTYARSLDDGLDLYKVSCPVGLLLVIFEARPEVIINITSLAIKSGNAVVLKGGTESAKSFAALSNVVRSALGKSKVPQAAVQLVQSREEVSQLLKLDEYIDLVIPRGSTNLVRHIKDNTKIPVLGHAAGLCSMYVHEDADMELASKLVLDGKTDYPAACNAIETLLINEAVLSSHLPKIAETLTEAKVTLKCDPASLKVLKDMPKVSALVEPSVDQDYNTEFSDLILAIKTVPSLQSAMQHINTHGSKHTDCIITSSEAAANRFMAGIDASGVYWNASTRFADGFRYGYGTEVGISTNKIHARGPMGLDGLTIYKYQLRGNGQVASSYGVGPGKRAFKHTPINIDNISQVSKK

SEQ ID NO: 8022 - protein, 325 aa, Mycoplasma mobile
MAKKIAILTSGGDSPGMNNAIRTIVKTSKIHGIEVFLVYNGYKGLVEKTIKNANEINVDQYIGSGGTFIGSARYLEFKKLEVRQKAVQNLKEMGIDSLVVIGGDGSYAGAQLLHELGVKTIGLPGTIDNDIASTEYTIGLDTALNTIVENVDRLRDTMNSMNMVALVEVMGHGAGDLAMLSGLATGAEIIVTNAHRKSIDEMIEIVKDQMIAKTKRSVIGIVSEFIYDDLKKVAKEIEDKTGIRTRAIILAHTQRGGNPKAYERINASFLGIAAVESLLKNESGVALGFKGNKIISTPIPEALKAQNSAKNENELVTKINKINQS

SEQ ID NO: 8023 - protein, 381 aa, Mycobacterium avium
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKARRGREVPEVRSTHAGGGLFSRLRETFTGR

SEQ ID NO: 8024 - protein, 618 aa, Magnaporthe grisea
MTFDIAGNLLELTRRAAEEPEPGGMAVGLALRVFAVDGLQDLVSFDYQIFFNLLLPPIILSSGYELHQANFFRHIGTILTFAFAGTFLSAVVIGVILWLYTRVPLEGLTMNWIDAISVGATLSATDPVTIIAIFNSYKVDPKLYTIIFGEAILNDAVAIVIFESAQKSARGLTKGSAAGISTFFWGFWIFLRDFFGSLFIGALLGILTALMLKYTYLRRFPKLESCLIVLIAYATYYFSQAIHMSGIVSLLFCGITLKHYAYFNMSRRTQLTTKYMFQVLAQLSENFIFIYLGVSLFTDKDLQFQPLLIIVTVMAVCAARWVAVFPLSWAINWFHKYRAERRGIKNVPEELPYKYQGMLFWAGLRGAVGVALAALLTAKDHRAFKATVLVVVVLTVIIFGGTTVNVLEILEIRTGVTDEIDSDDEFDIEAVGGYYKRSGNGIGYSPAGRNGVVPLDTRPGRRRDSNGAVGGRDASGWSSGHRSPLSAARPGSLVRTGSTREEAERLDLLGNPGGSTDSDDFGSDIDTSDLPPPAPRRRSSPMPPTGDEEAAGLPAGGSRTRSNTETGGLSATAAIRQLFSTEDPTALFRQLDEDYIKPKLLLDGGAGRGNGGGAGGSS

SEQ ID NO: 8025 - protein, 346 aa, Glycine max
MSESHSTGKCSSMTSILLLFMLLITNTGTTGAQSGVCYGRVGNNLPSPQEVVALYKQYDFRRMRIYDPSQQVLQALRGSNIELLLDLPNVNLQSVASSQDNANRWVQDNVRNYANNVRFRYISVGNEVKPWDSFARFVVPAIQNIQRAVSAAGLGNQIKVSTAIETGALAESYPPSRGSFRSDYLTSYLDGVIRHLVNNNAPLLVNVYPYFAYIGNPRDISLDYALFRSPSVVVQDGSLGYRNLFNAMVDAVYAALEKAGGGSLNIVVSESGWPSSGGTATSLDNARTYNTNLVRNVKQGTPKRPNRPLETYVFAMFDENQKQPEYEKFWGLFLPNKQPKYSINLN

SEQ ID NO: 8026 - protein, 174 aa, Unknown
  Synechococcus sp. CC9605
MYGRYSRLTSALHPCFTMAISVSAVSVTTPDGSSKSLGDYAGKVLLIVNVASRCGFTKQYAGLQALNEAYAAKGLAVLGFPCNDFGAQEPGSLDEIKSFCSTTYGADFELFEKVHAKGSTTEPYTTLNQMEPSGDVEWNFEKFLVGKNGTVIARFKSGVTPEDLKSAIEAALAA

SEQ ID NO: 8027 - protein, 157 aa, Saccharomyces cerevisiae
DRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 8028 - protein, 242 aa, Unknown
  Photobacterium sp. SKA34
MATVSMRDMLQAGVHFGHQTRYWNPKMKPFIFGARNRVHIINLEKTVPMFNAALAEIEKIAARKGKVLFVGTKRAASESIKEAAISCDQYYVNNRWLGGMLTNWKTVRQSIKRLKDLEAQSTDGTFEKLTKKEALMRTREMEKLEKSLGGIKNMGGLPDAMFVIGADCEHIAIKEANNLGIPVFAVVDTNSDPDGVDFVIPGNDDAIRAIQLYTGAVAQTVKEARNQDIAVQAEEDGFVAEA

SEQ ID NO: 8029 - protein, 407 aa, Bacillus subtilis
MSEVSVKAKLAKEAAAEMIMKTTAEKDEALSLIANGLRKELDFLLAENAKDIVNGKENGLTPDIIDRLSLDEKRIRDIADAVELLIDLADPIGDSLETIEKENGLFIQKIRVPLGVVGMIYEARPNVTVDAATLCLKTGNAVVLRGSSSAIHSNKALVSVIYRALEQSALPIHTVQLIEDTSRETAKELFTLNDGLDVLIPRGGKKLIDLVVRESTVPVLETGAGNCHIFIDETAKPQMAEKVVVNAKTQRPSVCNAIESLLIHKAWARQNGKELLDQLENAGVEIRGDELVCELHPSSKQASKEDWETEFLAPVLSVKTVENVQEAVKHIQQYGTNHSEAILTENDKNAVYFQTAVDAAAVYHNASTRFTDGFGIRLRSRNRHQHAKASCKRTDGASCTDFYKIHH

SEQ ID NO: 8030 - protein, 662 aa, Dianthus caryophyllus
MSFFENMGYYPNFEFPPQVTVVREEEPVAEVEQEGNDEDYSDDDVDVDELERRMWRDKMLLKRLKEQNKDRCREWIDNVKKRQSQEQARRKKMSRAQDGILKYMLKMMEVCKAQGFVYGIIPEKGKPVSGASDNLRAWWKDKVRFDRNGPAAIAKYQADHLVQGMDEDCTAMGSTPHTLQEFQDTTLGSLLSALMQHCDPPQRRFPLEKGHPPPWWPVGNEEWWPQLGIPNDQGPPPYKKPHDLKKAWKVSVLTAVIKHMSPDIEKIRKLVRQSKCLQDKMTAKESATWLAIINQEESLARKLFPDRCPPPAPGGGGSLVISDTSDYDVDGAGPDSSSDVEDCKPQNINVFNFREKFMGHPVNMITPAIKGEVVETGFDFPVKRKQPSSGSQTVIDQKVFLCENPQCPYNDPCLGFPDRILRHDHQLNCPFRSRGVEVTNTQTTLEKHPSSESTNFTSSFAQQEKFSLQSAMQSPATFNPCTGTVLETGDQLQQNMQRKTTDGRFVGQGSALYGNSTYLGQQSQFQIDNVGFFASHGGNGSQGMFVNGKNNNQVKQKPSLQMSNGFNGVFQSRQQMQAPMDGGFRGLSNMSGNIPQGTKTSAGHQVFSSGGMQQQQQLDQCRTFDSSFPMHLNDDITDFGFNSPFNIDFEPLLRPDNPIWNI

SEQ ID NO: 8031 - protein, 248 aa, Prochlorococcus marinus
MIKKIIKYLTLIIDKLYSDKSIEKTNKKLQHTILKNDLTAKLKDNEQEILFGCGCFWGAEKGFWRLPGVITTAVGYAGGEKEKPNYREVCSGLTGHTEVVRVVWNNNEIDLSDLLKLFWECHDPTQGNRQGNDSGSQYRSAIYTTSKEQLSKAIESKNSYQIELQNNGFGIITTEIENDIKFYFAEDYHQQYLAKPGSRPYCSAMPTKVKFKNFSGANFKLNEKIWSNYNWDITHCILRGENTPIESN

SEQ ID NO: 8032 - protein, 195 aa, Thiobacillus denitrificans
MRTAQVSRNTLETEITVSLNLDGSGTSRLATGVPFLDHMLDQIARHGLIDLDIAAKGDLHIDAHHTVEDTGITLGQAFAKALADKKGIRRYGHAYVPLDEALSRVVIDLSGRPGLEYHVDYTRARIGDFDVDLFLEFFRGFVNHAGVTLHIDNLRGINAHHQAETIFKAFGRALRMAVETDARLGDVTPSTKGAL

SEQ ID NO: 8033 - protein, 591 aa, Dianthus caryophyllus
MVMLFEEMGICGGEMRFFGEFQEGGGSGGPQFPRDGGPTVEELISDEEMDVEELERRMWRDKMRLKRLKDQSKVKEGVDVAKQRQSQEQARRKKMSRAQDGILKYMLKMMEVCKAQGFVYGIIPEKGKPVTGASDNLREWWKEKVRFDRNGPAAIAKYEADNLIFMNSNAGDSIRSSAHALQELQDTTLGSLLSALMQHCDPPQRRFPLEKGLPPPWWPMGNEEWWVELGLPNDYGPPPYKKPHDLKKAWKVSVLTAVIKHMSPDIAKIRKLVRQSKCLQDKMTAKETATWLTIINHEEGIARQLYPHLCPLLIGGSGGPSYVISDSGDYDVDGTVEEPIVEPQEQKGASSEVNNETQPVILQMPNQIKGEMMFSDGDFTRKRKAAASSEQVINEQFPIYTCGFSGCLHQQRGFGFSDRVSRDNHQLICRFRNNNCLQFGNIQTNTNQVKAANNFQHSYLGSEVGNPGNNSALPLINLQGVGIPDAGQKMIGELMSMYDVNNNSGSVNQNVVQQIGFRQNDQIQFQGRGLTQNSFGPTAIQMNQIGFNRSNRFEHNMQENALNSTLPSPFDLPFIDFMDDVQAGTSSAWYR

SEQ ID NO: 8034 - protein, 764 aa, Oryza sativa
MATPDDGGGGVGGGAGKKFWRSASWSASRDTPPDAATPAGAGGGGGAGAGQARRIPPPPPLTPRGGKGRSCLPPLQPLNITRRSLDEWPRAGSDDVGEWPNPTTPGASKAEGAGSAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRSLARVYSDSALIRDLDPRVDRVQHLAAEASTSPPFLSPSSLSSDSSISSKYSSDSPSLSPSTSSPTSLGLSPASSNFSHTLVPSSRSPLHQSSNEEPSKSGLGSIRSPSKTSSIAERRGGFSSLKLPSFQKDLVLPPRVPTSLRREEEVTDKSNNNSVKQLTGVCCPEKCTGNTSTVHTKTGITERTDSISEACGNLQLLVYRWPSKEKLTTFTRKDLDPKSVLIFVTPEDSRSEAVKTVHIWVGGEYESSKCVDTVDWQQVVGDFFHLKELGNTLPVKVYKEHETENLLEVLNAR

SEQ ID NO: 8035 - protein, 704 aa, Dianthus caryophyllus
MGLFENMGYCTNSEFPPAQTAFGVEERERECEECSDDDVDVEELEQRMWRDKMLLRRLKEQTKDKCATEVDCGKKHQSQEQARRKKMSRAQDGILKYMLKMMEVCNAQGFVYGIIPEKGKPVSGASDNLRAWWKEKVRFDRNGPAAIAKYQADHSVPGMDEDCSATGSTPHTLHELQDTTLGSLLSALMQHCDPPQRRFPLEKGIPPPWWPVGDEEWWPQLGIPNDQGPPPYKKPHDLKKAWKVSVLTAVIKHMFPDIAKIRKLVRQSKGLQDKMTAKESATWLAIINQEDSLARQLYPYRCPPPLPCGNGFLVVGDASDYDVDGVGPDLVSDIEECKPRSNNGFDFQVCSEGEKFTANPMNMITPAIKGEAVDASFDFPQKRKQPSSESQLANEKKVFICENSRCPYSGSRLGFPDRISRHNHQLNCPFRVNSTRRVDIGTFLNTIEKLPSLESSNLTSSVAPQSETPSTSTISASGLGIPEYGQKFIANLISVYDSNLQPNENFNLGTGIASETSDLMQKNMLLNMDGTTAGNFNDHKQTQLQPQSLNDRDFFTLEGMIGDNASRGMNNAGATESSNFRTVTGSAVASKAKNVIHSPTKNAASREQTSFINQGITQTAQDRMDYHFHGQAAKLGDNFSRGSNVSGFVYETDGTQQQQLDQCRTFNSSFVMPLNEDAADFGFNSPFNLDFESLLTPDSSVWNI

SEQ ID NO: 8036 - protein, 324 aa, Mesorhizobium loti
MTTKHAPVLIIGSGPAGYTAAVYAARAMLKPMLVAGLQQGGQLMITTDVENYPGFADPIQGPWLMEQMMKQAEHVGTDIINDIITEVDLNVRPFRAKGDSGTTYTADALIIATGAQAKWLGIPTEQDFMGFGVSACATCDGFFYRGKDVAVVGGGNSAVEEALYLSNLAKSVTVIHRRSDFRAERILRERLLQKDNVRVIWDTVVDEITGRPGKAPLPPSVEGLKLKHAVTGAETHLKVDGVFVAIGHAPAVELFVGKLKQKPNGYLWTAPNSTRTDVPGVFAAGDVTDDVYRQAVTAAGLGCMAALEAEKYLAGIEVHREAAE

SEQ ID NO: 8037 - protein, 309 aa, Listeria innocua
MGKALLIVNPSSGKEKGKTYQGKTEEVLKKRYDEVEVRLTEKAGDATEFASWASEQGFDAVIAMGGDGTLNETINGLAIHEKRPDFGFIPLGTVNDLARSVGIPLKPEKAIQALEKAKAIPMDIGRIGDQYFMNVLAIGMIAQAVDQVSVEQKTKFGSVAYFLEGLKAFNRNELLHFKLEYDEEVWEGEAALVVAGLTKSVGGMESWAPDAKIDDGYLHVVVLTKLGLLDAANMIPQLIRGNLKNSDGVVYIKTKKLTIDASGDDLSINVDGDPGPGVPAEIEVLGSHLNILAPKKSSQKRFGPFILKK

SEQ ID NO: 8038 - protein, 376 aa, Yarrowia lipolytica
MESFRLGTTAIADHSFNKDHTFVAVARENNVTLLQRANGKIRPVPGKAGTLRFHDKTVTGVDISCDGRIVTCSQDRNATVWELQQDGTWKPFLVVLRINRAATTVRWSPDGSKFAVGSGARIIAVCYFEAENDWWISKHIKKPIRSTITSVAWHPNNVLLAAGSTDGHARVFSGYIKGVDAKPAPTAWGERLPFQHLCGEFANKTYAWVHDVAFSPSGNSLAYVSHDSSITVVYPSAPDAPPKAVINLDTSFQPFRSLVWTTEDQIVAGGYDCYPIIFGGSQSGWKQTGAIDDPKKNKKNSGPASQFDEDGMPTGSALNMFRAMDLKGTTQQPNDDDLLTIHQSPIVTLRPLDEEGGRVTTISSTGGDGQLVIYRV

SEQ ID NO: 8039 - protein, 601 aa, Prunus persica
MGMFEDMGFCGNLDFLSAPPGEGEAAPEHDPEATAEEDNSDKEMDVDELERRMWRDRMLLKRLKEQSKGKEGVDNARQRQSQEQARRKKMSRAQDGILKYMLKMMEVCKAQGFVYGIIPEKGKPVSGASDNLREWWKEKVRFDRNGPAAISKYQADHSIPGKNEDCSAVASTPHTLQELQDTTLGSLLSALMQHCDPPQRRFPLEKGVAPPWWPTGNEEWWPQLNLPKDQGPPPYKKPHDLKKAWKVSVLTAVIKHMSPDISKIRKLVRQSKCLQDKMTAKESATWLAIINQEEALARRLYPDRCPPPSAVGSGSFTISGTSDYDVEGVDDEQNVEVEDCKPLVNHFNIGTAGQRERMVPQIKGELIETNSDFGQKRKQLAEEPQMMLNQKIYTCEYPQCPYHDCRLGFLDITARNNHQLNCAYRGNSSQVFGMSGFHLNNDKPVGFSLPITQPKPAIQQPVNQTSSFNASGLGLAEDGQKMISQLMSFYDSNVQQNKNSNPGNLNVVEDHNQQQVKFQFPMEDNFYGQGLVIGRNMSEPTSLPMLHSVFPSTEIQFDPCKLFDSPYGNHPNDPVNLGFGTHLNSVDYNDDSMLKQDAFWI

SEQ ID NO: 8040 - protein, 214 aa, Triticum aestivum
PVVNLEMCMTGLDKKKASVFFKTNADGNTTCAKEMTKLSGISEIIPEMEICDFDFEPCGYSMNAIHGSAFSTIHVTPEDGFSYASYEVMGFEGPALSYGDLVKRVLRCFGPLEFSVAVTIFGGRGQAGTWGKQLGAEVYDCNNMVEQELPGGGLLIYQSFCAAEDAVATSPKSVLHCFEGVNMENAPVKDRKLANLLCWEEVDAMEEKDGVLDE

SEQ ID NO: 8041 - protein, 579 aa, Triticum aestivum
RPVHSKESSVTPSAVTLLEGGKRKRGRPKRVPDSSVTPSSHSGLSVDVDSGDTSKRGRPKKIDTSLLHLPSLFSDDPRESADNVLMMFDALRRRLMQLDEVKQVAKQQQNLKAGSIMMNAELRLNKNKRIGEVPGVEVGDMFYFRIEMCLVGLNSQSMAGIDYMSAKFGNEEDPVAISIVSAGVYEDAEDDDPDVLVYSGHGMSGKDDQKLERGNLALERSLHRGNPIRVVRTVKDLTCSTGKIYIYDGLYQIREAWVEKGKSGFNMFKHKLLREPGQPDGIAVWKKTEKWRENPSSRDRVILHDISYGVESKPICLVNEVDDEKGPSHFTYTTKLNYMNSPSSMRKMQGCKCTSVCLPGDNNCSCTHRNAGDLPYSASGILVSRMPMLYECNDSCTCLHNCRNRVVQKGIQIHFEVFKTGDRGWGLRSWDPIRAGTFICEYAGVIVDKNALDAEDDYIFETPPSEQNLRWNYAPELLGEPSLSDLNESSKQLPIIISAKHTGNIARFMNHSCSPNVFWQPVLYDHGDEGYPHIAFFAIKHIPPMTELTYDYGQSQGNSGCRRTKSCLCWSRKCRGSFG

SEQ ID NO: 8042 - protein, 344 aa, Vitis riparia
MALTRNKPLVVVLLLGFVIMSTLTIGAQSIGVCYGTNGDNLPSASQVINLYKSNGIGSMRIYDPNSDTLQALKGSGIELILDVPNTSLQSLASDASDASTWVQNNVVNYASDVKFRYIAAGNEVLPTGSNAQYAQYVLPAMKNVQSAITSAGLQGQIKVSTATYSSVLGTSYPPSAGSFSSDVSSFINPIISFLAENGSPLLANIYPYFSYTGNTQSIQLDYALFTSPEVVVKDGSYQYQNLFDALLDALYAALGKAGGSNLKIVVSESGWPSEGGTAATVDNARTYYKNLINHVKGGTPRKSGAIETYLFAMFDENQKTGLETEKHFGLFTPSQESKYQISFS

SEQ ID NO: 8043 - protein, 308 aa, Oryza sativa
MAEAVASGAAGRWTLRGKTALVTGGTRGIGYSPQHPSLVLPYRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 8044 - protein, 449 aa, Haemophilus influenzae
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 8045 - protein, 901 aa, Magnaporthe grisea
MPPSSAEPPAASAANAARHVSIDEPRRDGRKDPNQNEQSPLLSPQDDEVDSLMARRESAIEDDDDEIDPFETTKSVWYLILLTISIGGLQIAWSVELSNGSPYLLSLGLSKSLMALVWIAGPLSGTLVQPYVGMLSDNCRISWGKRKPFMLVGAAATITSLLFLAWTREIVSGILGLFGAPADSDGVKTTIIVVAVLWVYILDFAINTEAANSMASRITGVGNIVGYVAGFVNLPKIAWWLGKTQFQDLCAIASIALGVTVIITCILIPERDPRLEGPPPRDQPGVLSFFTKIFTSIKRLPPVTKRVCQVQFCAWVGFFPMLFYTSAYIGEIYVQPFLRNNPNMTPKELDELYERATRVGTFALLIYSITSLSTNVFLPFFIQPTYDAAPVVSADAPGEGPSVLANAKNANGSSRSWLDRLVIPGFTLRRAWMFSHILFAFSMGCTVLVESVEAATVLIGLVGITWALTLWAPWSLISSEISRRDAVLRAQQRRRGLTLDQPYDEDETPSSETSSGQLEVERDEQVADQAGIILGIHNMAIAAPQIIATVGSSIIFKFFQKPRGTPGDRSISIVMALGGITVLGAAWLVHRIDDDVAVPADELSGIMEAGASDGILTGGPPRPSLSQRTSFSSTRPSFSRSRNQSTESLSRYSQERAALICKGEPAAPGFTQAKVPLLRAAGKPMSSITDATVLIGTQTEHVLPIRSPPARNNAHQQSSYPRPRRPPILSSRAVGRAVQRPKTAQDLNKWSWANQAGPYQYYIHGSGSVDKYISLSPGYKNPNETASARGARFALDGAVFWIGQNMRRTELISQTTAGIHFTEMTYGWISGEQGTSNKNLQWMVGQRSLWKTEWKPDVWHNVAYEIDFGARTVGFWHSEGGTPLERKFAPVSESTSSNGAD

SEQ ID NO: 8046 - protein, 626 aa, Desulfotalea psychrophila
MVYIVYSRFLGGWQCGRIMLFLEHYLATAWSSANVNLDLEKKLMSLTTVWARLWDMHDETKLLFLPSTKLISKKFKKEHIFLSEESLGKDAVLSEGMQDAPAEHIKRLKSGPGGVEEGEPREYTTRQRVGLFLGPALFLLMLFIPAPAGMEPVAQKMAAVALLIATWWMTEAIPIPATSLLPIALFPIMGIMHTKQAAAPYASHLIYLFMGGFIIALAMQRWNLHRRIAMNIVKVVGFSPSRLIFGFMVATAVLSAFVSNTATTVMMLPIGLAIIAHVIEEGRKEGLERFQDFDKNHFNFGLNLMLGIAYAASIGGMATLIGTPPNTVLAAYLQKTYGYEITFVTWMKIGVPLVCIMLPLCWFWLTRIANPMKLTKVPGGRVLIDQELEEMGSMSTGERWTALVFFLTAMGWMFRKQLDFLFPDPSLVTDATIAMTGGLILFLIPINFKKNIFVMNWEWASKMPWGVLILFGGGLSMAGGFKASRLANWIGGQVSLLDQAPVFVLLLACLCLIIFLTELTSNTATAALVMPILSAVAVGLGQNPLLLLVPAAITASCAFMLPVATPPNAIVFGSGYVTIPQMVKSGFGLDVVGLSLALTVTYLIAIPLFGIELGVLPEWVLAVAPK

SEQ ID NO: 8047 - protein, 262 aa, Agrobacterium tumefaciens
MSIPQILNSIAAKGPVFEAGHVWLAGAGPGDVRYLTLEVALALSQADIIVRDALVSDDVVALGPQAEVVFAGKRGGKPSATQDDITASLIDFALQGKKVLRLKGGDPFIFGRGGEEAEALVHAGIPFRILPGMTSSFTALASARIPATMRGISRAVTLATGHAAGTEEDLDWLALAKTQEPIVVYMGLKNIGTIAGLLMQGGRSGKTPVAVIMSATTAKERIFIGTLQSIADDAKRESFEAPALIIIGEIVSMRDRLGVSGS

SEQ ID NO: 8048 - protein, 500 aa, Crocosphaera watsonii
MCGIAGIWGQTEQTNVEAMMKSIIHRGPDAKGIFTVPNGSGILGHQRLSIMDVDGGDQPIYSKANTQAIIGNGEIYNYPKLQPELAKKYKFLTKSDTEAVLHLYEEKNTTAVGELDGMFAFAIIDDNKFIAARDPIGIKPLYYSEKDGNFWFASELKAITQFCENVEEFPPGHFFSSETGFSQYYSLPDIPPELDANVDELLQEIRETVEASVVKRLMSDVPLGAFLSGGLDSSIIAAIAKKHKSELHTFSVGIAGSKDINAARLVSDYLGTIHHEYIITPEEAIAKLPEIIYYLESFDQDLVRSGIPCYFTSRLASEYVKVILTGEGADELFAGYTYYKDIPSDDTLHRELRRSVNSLHNINLQRVDRLTMAHSIEGRVPFLDLKMIELGQKVPAHLKLKGTPPVEKWILRKAFEDILPEEIVWRKKEQFDEGSGTVDLLTETLKDVMNEQQAQQYQKEHPDIKLRSAEECYYHQIFMKAFDNPDALLTNVARWAETRF

SEQ ID NO: 8049 - protein, 77 aa, Amborella trichopoda
MKEQKLIHEGLITESLPNGMFQVRLDNGDLVLGYVSGRIRRSFIRILPGDRVKIEVSRYDSTRGRIIYRLRNKDSND

SEQ ID NO: 8050 - protein, 163 aa, Zea mays
  misc_feature (93)..(96): Xaa can be any naturally occurring amino acid
  misc_feature (100)..(101): Xaa can be any naturally occurring amino acid
  misc_feature (103)..(103): Xaa can be any naturally occurring amino acid
  misc_feature (108)..(111): Xaa can be any naturally occurring amino acid
  misc_feature (113)..(114): Xaa can be any naturally occurring amino acid
  misc_feature (118)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (131)..(132): Xaa can be any naturally occurring amino acid
  misc_feature (135)..(136): Xaa can be any naturally occurring amino acid
  misc_feature (138)..(139): Xaa can be any naturally occurring amino acid
  misc_feature (141)..(143): Xaa can be any naturally occurring amino acid
  misc_feature (146)..(151): Xaa can be any naturally occurring amino acid
MELLSSSPAQVGRPNLSSRALLPPLTSIASSHPPPPRFLVMNSQSQHRPSISCASPPPGDNGFPAITTASPIESARIGEVNRDTQETNVSVKXXXXGHGXXDXSTGIXXXXHXXDQLXXXXLXXVHXRRSXXSDXXDXXSXXXCSXXXXXXALGTPPLAQSLP

SEQ ID NO: 8051 - protein, 205 aa, Macadamia integrifolia
SSFDFMDGHEKPVEGRKINWMKAGILESDRVVTVSPYYAQELISGEQKGVELDNIIRKTGITGIVNGMDVQEWNPSMDKYIDVKYDATTVFEAKPLLKEVLQAEVGLPVDGKIPVIGFIGRLEEQKGSDILAKAISQFIGENVQMVVLGTGKKNMEKQIEQLEIKYPEKVRGVAKFNVPLAHMIIAGADFVLIPSRFEPCGLIQL

SEQ ID NO: 8052 - protein, 205 aa, Hakea victoria
SSFDFMDGHEKPVKGRKINWMKAGILESDRVVTVSPYYAQELISGVKKGVELDNIIRKTGIAGIVNGMDVQEWNPSTDKYIDVKYDATTVLDAKPVLKEDLQAEVGLPVDGNIPVIGFIGRLEEQKGSDILAAAISQFVGENVQIVILGTGKKAMEKQIQQLETKYPEKAIGIAKFNVPLAHKIIAGADFMLIPSRFEPCGLIQL

SEQ ID NO: 8053 - protein, 106 aa, Novosphingobium aromaticivorans
MPTKAVTDASFASDVLGSSKPVLVDFWADWCGPCKMIAPALEEIAEELGDKVEIAKVDIMENTDTASKFGVQSIPLLILFKDGQPVAQKLGAAPKSQLKGWLESVL

SEQ ID NO: 8054 - protein, 375 aa, Rhizobium leguminosarum
MAKADFYETLGVAKSADEKELKSAFRKLAMKYHPDKNPDDKDAERKFKEINEAYEMLKDPQKRAAYDRYGHAAFEHGGMGGGGGGFAGGGFSDIFEDIFGEMMGGGRARQRSSGGRERGADLRYNMEITLEESFSGKTAQIRVPTSITCDVCSGSGAKPGTQPKNCGTCQGTGRVRAAQGFFSIERTCPTCHGRGQIIPDPCPKCHGQGRVTEERSLSVNIPAGIEDGTRIRLQGEGEAGARGGPAGDLYIFLSVKPHEFYQRDGADLYCAVPISMTTAALGGTFDVATLDGTKSRVTVPEGTQVGKQFRLKGKGMPVLRSVQTGDLYIQIQIETPQKLTKRQRELLQEFEQLSSKENNPESTGFFARMKEFFEG

SEQ ID NO: 8055 - protein, 555 aa, Buchnera aphidicola
MKNINLIETKSWKDLKNHFKEVKNIHLKDLFLSDFNRFKKFSIFFENEILIDFSKNRITEKTLILLLNLAKEMNVKSAIKLMFSGSKINQTENRSVLHIALRNRSNFPILLNNSDIMSEVNDVLKKMKNFSELVIDGTWKGYSGKSISDVVNIGIGGSDLGPYMVTEALRPYKNHLNIHYVSNIDGTHLSEILKKINPETTIFLIASKTFTTDETITNANSAKFWFLKHSKTKETLDKHFFALSANINNAVNFGINIKNIFQFWDWVGGRFSLWSSAGLSIVLSIGFNNFEKFLQGAHVMDNHFYHTEYDKNIPILLALISIWYTNFFNSETEAIFPYDQYMHRFSAYFQQSNMESNGKSIDKNGNKVCYQTGPIIWGEPGTNGQHAFFQLIHQGTKLIPSDFIVPTVSHNNLNDHHLKLISNFLAQTQVLAFGKSKNSFLKESTSFKKEEDEFNRILPFKICEGNKPTNSILLRKITPYTLGMLIALYEHKIFVQGHILNIFSFDQWGVEIGKEVAQSIYKNINEKTKNSKSYDSSTQGLIDFYNFFKNKQNYL

SEQ ID NO: 8056 - protein, 621 aa, Phalaenopsis equestris
MGFPCGLDFSHFTPPSHDKNVTFMPIIQPPPPHPNFSHLPHPPCVDSAMIEGDLVDPLPDNFPEVIPDDEDSDEDIEVEELERRIWRYRLLVKQRKEQQNTKNRDFSDSVKHRQSQEQARRKKMSRAQDGILKYMLKMMEVCKAQGFVYGIIPEKGKPVSGASDNLRGWWKEKVRFDRNGPAAIAKYQVDNGIQSPNSELNSRFISPHSLQELQDTTLGSLLSALMQHCDPPQRRFPLEKGIPPPWWPTGKEDWWPQVGFSNDQPPPPYKKPHDLKKAWKVGVLTSVIKHLSPDIDKIRRLVRQSKCLQDKMTAKESATWLAVVKQEEDMFRDLHPDACPPPSSASNGTISFSSSCNEYDVEGVDDDDDDKCGEVMKNQDPIDMNNVFSMNNEEFIRKRAANCEPEMILNQGSVFNGETTKFRRNDYQSMKSNQLYQNSCYSTNPPPFITSSAFQPNENKPQIFSMSPMVVQQPKMASVNLQPAAAIATTPFSISGLGLPDDGQKLIAELLNQYDSNMNHGKVSGEVRAGNEVQKTDTFRLPNEAMSSFFGSKNGGGGSGIFEEANCSQLCSIHEELEQMDQVYQNQATDMSNDFRFGSSFSSPAMDFADSMSRGVGSWFF

SEQ ID NO: 8057 - protein, 377 aa, Limnanthes douglasii
MAIPAAAFIVPISLLFFMSGLVVNFIQAVFYVLVRPISKDTYRRINTLVAELLWLELVWVIDWWAGVKVQLYTDTESFRLMGKEHALLICNHRSDIDWLIGWVLAQRCGCLSSSIAVMKKSSKFLPVIGWSMWFSEYLFLERNWAKDENTLKSGLQRLNDFPKPFWLALFVEGTRFTKAKLLAAQEYAASAGLPVPRNVLIPRTKGFVSAVSNMRSFVPAIYDLTVAIPKTTEQPTMLRLFRGKSSVVHVHLKRHLMKDLPKTDDGVAQWCKDQFISKDALLDKHVAEDTFSGLEVQDIGRPMKSLVVVVSWMCLLCLGLVKFLQWSALLSSWKGMMITTFVLGIVTVLMHILIRSSQSEHSTPAKTRARQTAENPK

SEQ ID NO: 8058 - protein, 258 aa, Methanococcus maripaludis
MGKKDKRWVLQRKNDHYYNLAKRRNYRSRATYKLFQLNEKFNLIKERNVVVDLGCAPGGWLQAARDIVGEDGFIVGIDLQTVKPLPHDNIIAIKGDMTKEEILKQAKDLLPEKPDVIICDASPNISGVWDVDHVRSLELTTMALMTATKMLKKGGNFVVKVFQGDLFEKYVQLVSEYFDKAFTTKPRASRDESAEVYVIGKRFNGKKFDMNSKSPIVKLLDTKPVEEEITSPSLRKEISKEDSGLMIKRIKEMRSKKE

SEQ ID NO: 8059 - protein, 267 aa, Clostridium acetobutylicum
MNTREKYLSNVNRLVIKVGSSTLTHPSGLLNFYKIEHIVRQIADLHNQGIKVILVSSGAIGAGIGKLRLKERPKTIPEKQAAAAVGQGVLMHTYEKLFAEYGQIVGQILITREDLSSKKRVVNVQNTFSALLDHGIIPIVNENDATVVEEIKFGDNDTLSARVASLIKADLLILLSDIDGLYDSNPAVNKNAVLIDTVNEVNEEVKASAGGAGSKLGTGGMATKIRAAEIATENGISMVIANGEKQEAIRNILNFENEGTLFIPKNK

SEQ ID NO: 8060 - protein, 418 aa, Clostridium acetobutylicum [sequence omitted]

SEQ ID NO: 8061 - protein, 251 aa, Prochlorococcus marinus
MSRISIVGAGPGATDLLTLRAAEHLKQAEVLVWTDSLVSPDIAALAPESCERIRTSSMTLEEVLPLLVNRAQAGKRVVRLHDGDPCLYGALSEQICGLADAGIEVEVVPGLSAYQATAAALNAELTIPGLVQTIVLSRAGGRTGVPERENLQHLASLGASLCLYLSARHVEEVQATLLQHYSAETPVAIGYRVSWPDQWLSVVPLKQMATTSREHELIRTTLYVVSPALAAGRQRSKLYSPSHKHLFRQKG

SEQ ID NO: 8062 - protein, 310 aa, Streptomyces coelicolor
MAVVTMRELLESGVHFGHQTRRWNPKMKRFIFTERNGIYIIDLLQSLSYIDRAYEFVKETVAHGGTVMFVGTKKQAQEAIAEQATRVGMPYVNQRWLGGMLTNFSTVYKRLQRLKELEQIDFEDVAASGLTKKELLVLSREKAKLEKTLGGIREMSKVPSAVWIVDTKKEHIAVGEARKLNIPVVAILDTNCDPDEVDYKIPGNDDAIRSVTLLTRVIADAVAEGLIARSGAAGGAKGDKAAGEPLAAWERDLLEGEKAEKKDDAEAAEKPAEAPAAEAPAAEAAEAPAAEAAPAEEPAAEAPAADAEQA

SEQ ID NO: 8063 - protein, 536 aa, Blastopirellula marina
MSVDPNQDPQAQPETPADAANPTTPENTASSPEGSAQAAASDDVDSPKRKLLIGSQRDEEKPTPAAPPAPSTMGRPQRPEKPKPPKSEQDEDPTAIPDDLSSLETESEMERLPVSSDGRVAVPNRRQKLDDIEREVEAALGGLSLDEMITSESAMQGISGKTLEVDSRLNATVARVHREEVFIDLPGQNQGFVSLRSFVAPPEIGAKLEVVIIKYDREQGLYEALVPGSSVSVVDWGDLTEGILVDAVVDGVNKGGLECAVGQARGFIPASQIAPHHVTNMEDYLGQKLQCLVTEANPERRNLVLSARAVAEKAKEDSRKETMVTLQVGQMRDGTVTRLQDFGAFVDIGGVDGLVHVSQISWDRVKHPSDALSEGQAVRVKVTKIDPETGKIGLSIRDTLENPWQKVAEEFSVGAIINGKVTKIMDFGAFVEIAPGIEGLVHVSEVSHTRVSRIESVLKAGEKVEVKVVNIDKEKRRIGLSIKALSPAPASKSGGKKKDEEPEDLDRALKVKPTASELKGGIVNEQSQGSKFGLKW

SEQ ID NO: 8064 - protein, 488 aa, Bacillus cereus
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 8065 - protein, 186 aa, Pyrobaculum aerophilum
MPYVRKTLETEVAVELRRGGDLAVETPIPFLTHMLETLLKYAGLGGVVKAVELRKLDDGHHVIEDVAIAVGRALDALLEDRRGIARFGHAVVPMDESIVMAAVDLGGRAYWVVRAKLPDVTIGGYPLRMFPHFVRTLAVEAKATIHIYARGTDPHHKVEAAHKALGLALRQALSPGEGLSTKGVLG

SEQ ID NO: 8066 - protein, 589 aa, Blastopirellula marina
MAFSARYAAKFSIGRVCEKNVQFSQTEQGTSQRKASMADSNRSTAGLSIGEYLIRRLQDYGLQDIFGIPGDYILSFYSMLEQSPINMVGCTREDNAGFAADAYARVHGLGAVCVTYCVGGLSICNSIAGAYAEKSPVVVLTGSPGLRERINNPLLHHMVREYSTQKDVFEKLCVATAELADPVTAFREIDRVLDAAARFKRPVYLELPRDMVNVVPHISHTFQEPTTTSDPHALVEAAAEAARLMASAERPMIIAGVELHRFELQDELVQLAEATGIPVAATILGKSVIRETHPLYVGLYEGAMGREEVTEFVEESDLILLLGTFMTDINLGIFTANLDPSKCIYATSEQLRVRHHHYHGVTLPDFMQALAAQKPHPPKRLIPPGLAMQQAPVGVTTDEPLTIRRMVPMINELLDDDVIVIADIGDSLFSATELVTRGRSEFLSPAYYTSMGFAVPATLGVQTAKPKARVISIIGDGAFQMTGMELSTIVRHGYDPVIIVLDNHGYGTERWLHAGKWEYNEIHPWKYSKLPDILGGGTGYEVRTEKEFYNALQSAWNDRDGMSVIHAHLSDQDASETLNRLASRMGRNI

SEQ ID NO: 8067 - protein, 458 aa, Listeria innocua
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALGCVLILLLFNLATVKAFGEIEFWFAIIKVVVIIALIVIGFVLVFIGYKHGTSTASFSNLIDYGGFFPNGVAGFLLAFQMATFSFVGIELVGVTAGEADDPERTLPKAINNIPIRILIFYIGALLVLMSIYPWSNIDPDTSPFVSVFTMIGIPAAAGIINFVVLTAAMSSCNSGIFSTSRMLYTLSAEGKAPKKMHHLSSNGVPATALITSTACLLIGVFLNYILPEQVFILVTSIATICFIWVWGIILVAHLRFRHKHPEISAKSKFKMPLSPFMNWVSLIFFAGLLIILGFAADTRIALFVTPVWFLILAIAYQILKASNRKTKIRHN

SEQ ID NO: 8068 - protein, 328 aa, Schizosaccharomyces pombe
MAPATAVVTPQTAFKTDLPVEKTAHNTVVKSEMGALSKAYPTYSLDESFSFAPIRESTVSRAMTRRYFSDLDKYAESDIVIVGAGSAGLTAAYYIGTRRPDLKIAIIEASVAPGGGAWLGGQLFSAMVVRKPADLFLNEIGVPYEDEGDYVVVKHAALFTSTVMARTLALPNVKLFNATAVEDLIVKEGKDGKQRIAGVVTNWTLVSLNHGLQSCMDPNTINAHLVVSATGHDGPFGAFCVKRLASAQLVSNLHDMRPLDMNRAEDLIVKGTREVFPGMIVGGMELSEFDGANRMGPTFGGMMFSGIKAAQEALAIFDERKAVNEKYL

SEQ ID NO: 8069 - protein, 280 aa, Brassica napus
  misc_feature (131)..(131): Xaa can be any naturally occurring amino acid
MATSASALLAPTTFSTVISQKNPNSISFHGLRPLRLGGSSSALPKLSTTSGRRSSSSAVVRAELSPSVVISLSTGLSLFLGRFVFFNFQRENVAKQVPEQNGKTHFEAGLSVGSSLVEEDKLELATSLLAXAKAKGVSLLLPTDVVVADKFAPDANSKVVPASGIEDGWMGLDIGPDSIKTFNEALDTTQTVIWNGPMGVFEMEKFAAGTEAVANKLAELSEKGVTTIIGGGDSVAAVEKVGVAGVMSHISTGGGASLELLEGKVLPGVIALDEAITVTV

SEQ ID NO: 8070 - protein, 296 aa, Listeria innocua
MVTLKVALVQQQAVPNDKEANLNLSIKYIKEAHRKGADLVLFPEMWSNGYAPPFETAFDEPMDAGFEEERTRWLADAVARDSAYVTTLRKLAKELNIGVCATYLSKTKQKPQNTAIIIDRNGEIILDYAKVHTCDFSLEALLQSGDEFNVCEFDGIKLGVMICYDREFPESARVLMLKGAEIILVPNACDMNPARLNQLNSRAFENMVGVAMANYPGEKWGRSTAFSPIVFDENEDYRDNTIIETDDVSEGIFIAEFNLDEIRSYRENETWGNAYRKPQTYTDLISLDVKEPFKRN

SEQ ID NO: 8071 - protein, 417 aa, Unknown
  Shewanella sp. MR-7
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEELYKKLNSAVFPGGQGGPLMHVIAGKAVAFKEALEPEFKAYQQQVVKNAKAMVEVFLERGYKIVSGGTDNHLMLVDLIGRDLTGKEADAALGSANITVNKNSVPNDPRSPFVTSGVRIGTPAITRRGFKEAEAKELTGWICDILDDAHNPAVIERVKGQVLALCARFPVYG

SEQ ID NO: 8072 - protein, 480 aa, Triticum aestivum
  misc_feature (237)..(237): Xaa can be any naturally occurring amino acid
MPAKLLRTPTAGRRHHLPVLHLVAGLLLVPLSCTCSASASASTVVTHLPGFDGPLPFYLETGYVGVEEETGAELFYYFAESERSPGTDPVILWLTGGPRCSGFSGFAFEVGPVKYVRAPYTGVLPRLVQNPLSWTKMASIIFLDSPVCSGFSYARDPKGCDVGDYSSSLQVQRFLNKWFTHHPQYLCNPFYLRGDSYAGKVIPLIATYMSQGTEKRDQPLINLKGYLIGNPITEPKXDKNFRVQGAHGFGIISDQIYEAAMKNCKGNYVNPTNQLCAEVLETVDSLISEIADAHVLYKKCVVAIPEPIDDAIRRKFLLEESIEPNEAPGRPTVDCFTYGYYLAYLWMNNKMTRDALRIKEGTVGEWVRCKKEVPYTQDMPSSIPYHRNLTTRGYRALVYSGDHDLQVPQLSTQAWIRSLNFSIVDDWRAWHLDGQAAGFTITYANKLTFATVKGGGHTAPEYQPEECFAMAQRWLDNKPL

SEQ ID NO: 8073 - protein, 208 aa, Chlamydomonas reinhardtii
MNVYVTLKTKLVAELRQIKQTLQTERNIIRVLRRKLKQIAAQKRFIKFLPKLRYLPTPVTKIEQTARFLVKKFVDPKMKYPMDSIYDKKLSRQSKKVAASRKKKWQRLEKYLGGISNMTKIKEKQIANNVAIIIGQQEEMNAVRECQKLGIKMFHIVDTNCNPGLADHFIPANDDARNSIKFILGKFLTRIRLAHKIKVKFKKTSLKK

SEQ ID NO: 8074 - protein, 489 aa, Magnaporthe grisea
MASHFKPPAYSQKFPDLPQFSGFMKPCRFQGEASNLEVQGSIPPEIDDTFYRVMPDPHLPQWFNGDGNISAFRIKDGRCDFKQRYVQTEKFVRKYRNKYTDAVEFKVRSTANTNIIYFNGRLLACKEDSPPYCLDPETLETMWLETFDGQLPSLTFTAHPKVDAHTGELICFGYEARGDGTPDVCYFTFDKKAAILETVWLVAPVVAMIHDFAVTENWTCDLERMEKGGEHWQWNPDIPFYLGVLPRRGAKGSDIKPADQLNPRRPFPPRQWFKAPNSFPGHTVNAYEDESGNIVFDLPLTNTNVFFWWPDAQGNSPDPKEIAARLVRFTFDPRSAERDLPEPEVLCRLDCEFPRVDDRVSMARHARAFFDMTDPALPTDMAAIMRLGGGGHPMYNCIGHLDYATGRLDRYFPGSTHLVQEPVVVPRSRDVPEGDGWVVVLVNNYANMSSELHIVDTRDLSKAQAIVYLPVRLRAGLHGNWVDAGDIKG

SEQ ID NO: 8075 - protein, 570 aa, Chlamydomonas reinhardtii
MLNKKPPYLILSLIMIKTQKSKQTAVRKLIPGNVISLKITAMGANNVGINEFTFGIPVLVPNAKLGETVQAKVLKILASKKIAIAKLIKVVTKTNATETNNLAALTPGATLDVTITKLGPNSTGIADLGNNYNNVNKLIVKKSAITIGEKVTVLVTRVKNGYAFGVATVSTQRLNQVSTSLTQNSFKGTKFTVVLPKNAKRYLKHLVFKVTTATAQNLSVNGFEQTLFKKGAVGLDTRINNQNGSAGNLTTVPTNTILFVKPNLGAKLGDKVQIQIIKFASIENGTLTYNVAIAKIIKLNPLSTPQKKAFVRSSLRQMLKSGMHYGEKAIKCNARMKNYVWTRKKGTDTKVEARPLIKKGRNLINLLKTRRCLTKALAQLTKYAAKGKTFLFVGTKKAASGLVARAALFSKKAFFVNTRWLGGMLTNWKTILKSISKIRPILKEKQMIIKDILEKRQTIKARLIQKALLLRKKSKLMLKKGRLLIQMLKQNNSNSTSGKQAVRFLFTEKTNLLNTKRKEFVSKGILLLEKRQQLVVKRQELITQSQTLKSKAIQLTNTISQFIKQFNLFT

SEQ ID NO: 8076 - protein, 356 aa, Nicotiana attenuata
MAHLSDLVNLNLSDSTQKIIAEYIWIGGSGMDVRSKARTISGPVDDPSKLPKWNYDGSSTGQAPGEDSEVILYPQAIFKDPFRRGNNILVICDCYTPAGEPIPTNKRHNAAKIFSHPDVVVEEPWYGLEQEYTLLQKDINWPLGWPLGGFPGPQGPYYCGIGAGKAFGRDIVDSHYKACLYAGINISGINGEVMPGQWEFQVGPSVGISAADELWAARYILERITEIAGVVVSFDPKPIPGDWNGAGAHTNYSTKSMRNEGGYEVIKKAIDKLGLRHKEHIAAYGEGNERRLTGRHETADINTFKWGVANRGASIRVGRDTEKEGKGYFEDRRPASNMDPYVVTSMIAETTILFKP

SEQ ID NO: 8077 - protein, 462 aa, Arabidopsis thaliana
MASNGVDEQIKLVEGPAGYVLEDVPHLSDYILDLPTYPNPLQSNAAYSVVRQYFVDEDDTVQEKIVVHKDSPRGTHFRRAGPRQKVYFKPSDVRACIVTCGGLCPGLNTVIREIVCGLHFMYGVTEVIGVDCGFRGFYSKNTVALTPKTVSDIHKRGGTILGTSRGGHDTSKIVDNIQDREINQVYIIGGDGTQKGANAIYKEIRRRGLKVAVAGIPKTIDNDIPVIDKSFGFDTAVEEAQRAINAAHVEATSVENGIGIVKLMGRYSGFIAMYATLASRDVDCCLIPESPFYLEGKGGLYEFIAKRLRENGHMVIVIAEGAGQDLVAESIEQQDASGNKLLKDVGLWMSLKIKEYFAKHNVMDITLKYIDPTYMIRAIPANASDNVYSTLLAQSAVHGAMAGYTGFVSGLVNGRHTYIPFNRITERQNKVVITDRMWARMLSSTNQPSFMNPPKGTTEFTD

SEQ ID NO: 8078 - protein, 303 aa, Crocosphaera watsonii
MTKRALLLVNRHSRKGQRNFAQAVDILNDLGFELIVVPIKSSEHLPQLIQKHGRKVDLVIVGGGDGTLNGVVDSLMDMNLPLGILPLGTANDLARTLNIPVNIPQACQVIAEGHIKYIDLGWVNGKHFFNVASLGLSVRITEKLSKGAKRRWGILAYAFTALQVISQTRSFRAHIMINGEKIKVKTVQIAVGNGRFYGGGMAVAEDATIDDQRLDLYSLELKSWWQLFPLLWRLPQGQHGNLAWVRTLEGEHIEIRTRKKQEINTDGEIITATPAIFRVIPQSLGVFVPRNSLFQLEEKKRPK

SEQ ID NO: 8079 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 8080 - protein, 432 aa, Nicotiana attenuata
MAQILAPSAQWQMRMTKSSTDANPLTSKMWSSVVLKQNKRLAVKSSAKFRVFALQSDSGTVNRVEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPTNKRHKAAQIFSDSKVVSEVPWFGIEQEYTLLQQNVKWPLGWPVGGYPGPQGPYYCGAGADKSFGRDISDAHYKACLYAGINISGTNGEVMPGQWEFQVGPSVGIEAGDHIWCARYILERITEQAGVVLSLDPKPIEGDWNGAGCHTNYSTLSMREEGGFEVIKKAILNLSLRHKEHISAYGEGNERRLTGKHETASIDKFSWGVANRGASIRVGRDTEKQGKGYLEDRRPASNMDPYVVTGLLAETTILWEPTLEAEALAAQKLALNV

SEQ ID NO: 8081 - protein, 567 aa, Oryza sativa
  misc_feature (484)..(484): Xaa can be any naturally occurring amino acid
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGCRPDPXSQTPRKIIVSGSRARSVDLDAMDEKELLKLNLQKMQNRVVELERACKEMRGQMSKMAKGGRPSSSFGAAACHQTGGRGLPRLC

SEQ ID NO: 8082 - protein, 219 aa, Triticum aestivum
  misc_feature (15)..(15): Xaa can be any naturally occurring amino acid
  misc_feature (35)..(35): Xaa can be any naturally occurring amino acid
  misc_feature (51)..(51): Xaa can be any naturally occurring amino acid
  misc_feature (62)..(62): Xaa can be any naturally occurring amino acid
  misc_feature (78)..(78): Xaa can be any naturally occurring amino acid
  misc_feature (90)..(90): Xaa can be any naturally occurring amino acid
ESPQNSLRKALPGGXAWGDPNFGGRATTVTAQGKXAPKNHVMSERKRREKXLNEMFLVLQSXLVPPFHKVDKGSMLAXTIAYLKELQRRXVQELESRRQGGSGCVSKKVCVGSNSKRKSPEFAGGAKEHPWVLPMDGTSNVTVTVSDTNVLLEVQCRWEKLLMTRVFDAIKSLHLDALSVQASAPDGFMRLKIGAQFAGSGAVVPGMISQSLRKAIGKR

SEQ ID NO: 8083 - protein, 229 aa, Emiliania huxleyi
MTVVTLGELLDAGVHFGHQASRWNPKMFPYIYAERNGIHVIDLVQTARLLTHAYEFVQKASQEKKSFLFVGTKRQAASIIAEEAQRCGGHYVNNRWLGGILTNWSTVQKRVEYLKELDAKEEDGTLDRLPKKEAAFLRREQEKLSHNLRGLINMTQIPDIVILVDPKRETTALLECRKLGIPIISILDTNCDPNLVDIPIPANDDAVRSVKLIISTLADGILEGKQSYQ

SEQ ID NO: 8084 - protein, 458 aa, Medicago truncatula
MDTTFDDEEGGPSVTLGEYLEEVEERELVRPFHQGIFTLVGLLDLILRDSHPWAWLPGPGFHSQSTDAEEADLVLGGDEGRECTYNKGYMKRQAIFSCITCTPDGNAGVCTACSLSCHDGHQIVELWTKRNFRCDCGNSKFGEFYCKIFPSKDIENVENSYNHNFKGLYCTCARPYPDPDAEEQIEMIQCCLCEDWFHEEHLGLESSDEIPRDEEGEPLYEDFMCKACSEVCFFLKLYPEVILVAGKQPNATAQVSKDKGILEDTPSTCGFEKPLGDTSYNSPKIDVAQASVGSESISNRAGLPPGGSCNSSTCTEGASLHVNCLLGVNIVAASPVIHGKAMFLSKNWRDALCKCKNCLEYYHQKRIAFLLDKEDSIVEYEKMAKQKREEKLQQQEGAELSLFNKLGHVEKVEILKGIEDMKDGLRTFLESADSSKPISAADIHQFFDDIKNKRRRVG

SEQ ID NO: 8085 - protein, 249 aa, Saccharomyces cerevisiae
MSEYQPSLFALNPMGFSPLDGSKSTNENVSASTSTAKPMVGQLIFDKFIKTEEDPIIKQDTPSNLDFDFALPQTATAPDAKTVLPIPELDDAVVESFFSSSTDSTPMFEYENLEDNSKEWTSLFDNDIPVTTDDVSLADKAIESTEEVSLVPSNLEVSTTSFLPTPVLEDAKLTQTRKVKKPNSVVKKSHHVGKDDESRLDHLGVVAYNRKQRSIPLSPIVPESSDPAALKRARNTEAPGVLVRESCKE

SEQ ID NO: 8086 - protein, 240 aa, Euglena gracilis
MITVEKMLNSSVHLGHKVKQWNPRMRIYIYGERKGLHIIDLLQTIVCLKKACNFLIRSVRKGKRALFVCTKRFFSILTQKIALKCNSFFVTKRWLGGILTNWITIKNCINKLKQLSKQKEKHHNLLTKKERLVLKKKKLKLKKYFSGMRDMTERPEIVIIIGQNKEINAVRECKKLGIASITILDTNCDPTLTKYPIPSNDDSILSVSLILSVLCNSINRGVNNKVRQKFDKYKKFKKLS

SEQ ID NO: 8087 - protein, 115 aa, Blastopirellula marina
MKLVIAIIQPSRLEAVKEALTEVEVFRLTVMDCQGFGRQKGQTEVYRGHEFTINLLRKVQLQIAVNEEFVEPTVDAIVKGARSGEKGEIGDGKIFVLPMDECVRIRTGERGPDAI

SEQ ID NO: 8088 - protein, 498 aa, Datisca glomerata
MVIPEADRHRARARPPVQARVSLRKLLRVSSVACGIQFGWALQLSLLTPYVQELGIPHAWASVIWLCGPLSGLFVQPLVGHMSDRCTSRFGRRRPFIVVGALSITVAVLIIGYSADIGSLIGDRGTVKPGAIATFVVGFWILDVANNMTQGPCRALLADLTGKDHRRTRVANAYFSLFMAVGNVLGYATGSYSGWFKIFPLTLTSACNVNCANLKSAFLLDIVFIAITTYLSISAAQESPLDPTDRSANITEEGPGPSSHTEEAFLWELFGAFRYFSASIWVIFFVTALTWIGWFPFLLFDTDWMGREIYGGKPNEGQNYSTGVRMGALGLMLNSVVLGITSVLMEKLCRYWGAGFVWGVSNILMSLCFLAMLVVTFVAKRIDYIGHKLPPDVIVVAALVIFAILGIPLAITYSVPYALISTRIESLGLGQGLSMGVLNLAIVIPQVVVSLGSGPWDQLFGGGNSPAFAVAAVAAFASGLVAILAIPRSRAQKPRALT

SEQ ID NO: 8089 - protein, 108 aa, Buchnera aphidicola
MNKIIELTDQNFEKEVLEHKSFVLVDFWAEWCNPCKILAPILEEIAQEYFNKIKVGKLNIEKNPNTAPIYSIRGIPALLLFHGREVLATKVGAISKLQLKDFLDENIK

SEQ ID NO: 8090 - protein, 318 aa, Chlorella vulgaris
RPPVTEVESQNYYHFHDNRVLPSHVDEALANSEGWWYKPDFIINDLNVQSAIGYPAHEEVVPLVAGTYAVRGYARGHGNKIIRCEVSLDDGKSWRLGSVTHEGQPTEYGKHWGWVWWSLEVPIAELLTTPEIICRAWDSSMNTQPNTFTWNVMGMMNNCCYRVKIHPRQTTDGRFALQFEHPTIAGPTVGGWMNRAEDVAAAAAVTVAPPPAPAGAKSFTMAEVETHTTMESAWFVVDGKVYDATPFLKDHPGGADSILLVAGIDATDEFNAIHSLKAKKQLLEYYIGELAEEGQEAAASDRATPGPAAAIGTAVPVA

SEQ ID NO: 8091 - protein, 532 aa, Unknown
  Synechococcus sp. RS9916
MSFPDFCANDPQVQWQRFCELLWFHDGLGMWLDISRMHVNQADLDELKPRFDQAFKAMAALEGGAIANGDEQRQVGHYWLRHPQLAPDPEVQAHIATEVDQIEAFGRSIVRGEIKAPNGQAFTDVLWIGIGGSGLGPLLMIRALQEEGAGLPFHFFDNVDPNGMSRVLAGLGDALPTTLVITVSKSGGTPEPHLGMEQARHRVEASGGSWAGQAVAITMANSKLDQKASQEGWLQRFDMFDWVGGRTSITSAVGLVPGALIGADIREFLDGAAQMDAATRLDDLERNPAALMAASWFVAGEGCGKRDMVVLPYRDRLEVFSRYLQQLVMESLGKRLDRAGNVVHQGIAVYGNKGSTDQHAYVQQLRDGVDNFFVTFIEALKDSQDIPDINGERPGDFLDGFLQGTRSALTEGGRQSISISMRQFDARRLGALIALFERAVGLYGELVNINAYHQPGVEAGKKAAAAILNLQGQVEAVLADGQSRSVSEVHAAIGEGSVEAVFWILRHLTGNERGYSAQGSWDAPATLRFSKS

SEQ ID NO: 8092 - protein, 132 aa, Silicibacter pomeroyi
MTTHTVTIANREGASFQVNARRPLLEQLRDQGVDLPYGCEYGGCITCAAKLTAGEVDQRRQVALNNRQIANGYVILCVARATSDITLEIGVESHDTLYRNPFLDPLQPHELKADIATPRPSIGDALEQTKES

SEQ ID NO: 8093 - protein, 353 aa, Burkholderia xenovorans
MEFLRNTWYAAGWSQDLAAGAMLGRTMLNEQLVLFRADDGTVSALSDICPHRFAPLHLGKIVDGCRIQCAYHALEFDGTGACVKNPHGKQKIPAAAKLQAYPVVEKHSLIWVWMGEQAAADPSVIPDFSMLDPDSGFQVSRRDWLHMDASYDLVVDNLMDLSHTAFLHDGILGSKYTIKADTSLEQTGETVKVTRLMPNVPVPGFFDLMFNRDGGIVDYWTEIRWNLPGCLMNNTGVTLPGAPRSEGTGVYGMHFLTPETDVSCWYHFAAVRQNPRTWGEPIDTEIKEKISDLRRYAFEEQDQWIIKAQQQTILRAKGNLQPVSLETDIGIERYKRILKAALVAERSGSTMAA

SEQ ID NO: 8094 - protein, 142 aa, Zea mays
  misc_feature (62)..(62): Xaa can be any naturally occurring amino acid
  misc_feature (73)..(73): Xaa can be any naturally occurring amino acid
  misc_feature (77)..(77): Xaa can be any naturally occurring amino acid
  misc_feature (86)..(86): Xaa can be any naturally occurring amino acid
  misc_feature (111)..(111): Xaa can be any naturally occurring amino acid
PTSCYCRVVSDSKMTIYHPGMHIKQVDELPYRVLLDSWNNNNRLTVRLLTMPVYACNKYITXSAVNDAFHLRXRLHXPFHELRINXMLSRARTDTLQTGMMGDFGIPHLIXDNQQIAQDLVSDRCKDNHDAHAPDALRHANI

SEQ ID NO: 8095 - protein, 298 aa, Oceanicola granulosus
MALPEFTMRQLLEAGVHFGHQTQRWNPKMAEYIYGARNGIHIMDLTQTVPMLDAALQAIRDTVAKGGRVLFVGTKRQAQKPIAEAAEKCAQYYMNHRWLGGTLTNWQTVSQSINRLRAIDEAADVGFEGLTKKERLGMEREQAKLTASLGGIREMGGVPDMLFVIDVNKEDLAIAEAKKLGIPVVAVVDTNCSPAGVDYVIPGNDDAARAIALYCDLVSRAALDGMSAQLGAAGVDLGEMEALAEEALAEERGQSAAAADAEAAPAESTGVETGHNTPDVPEEAPLDLDNKEKGEKVS

SEQ ID NO: 8096 - protein, 438 aa, Helicobacter pylori
MNLKKTENALSLTLKNFIKSESFGGIFLFLNAVLAMVVANSFLKESYFALWHTPFGFQIGDFFIGFSLHNWIDDVLMALFFLMIGLEIKRELLFGELSSFKKASFPVIAAIGGMIAPGLIYFFLNANTPSQHGFGIPMATDIAFALGVIMLLGKRVPTALKVFLITLAVADDLGAIVVIALFYTTNLKFAWLLGALGVVLVLAVLNRLNMRSLIPYLLLGVLLWFCVHQSGIHATIAAVILAFMIPVKIPKDSKNVELLELGKRYAETSSGALLSKEQQEILHSIEEKASALQSPLERLEHFLAPISGYFIMPLFAFANAGVSVDSSINLEVDKVLLGVILGLCLGKPLGIFLITFISEKLKITARPKGISWWHILGAGLLAGIGFTMSMFISNLAFTSEHKDAMEVAKIAILLGSLISGIIGALYLFALDKRAALKK

SEQ ID NO: 8097 - protein, 195 aa, Solibacter usitatus
MRSATIQRDTKETRIGGTLKLEGRGRYEIATGIRFLDHMLELFAKHGGFDLKFQADGDLDVDQHHTVEDAGIVLGQLFAKALGDRKGINRAGYFVLPMDETLAVVAVDLGGRPALVYKDRVKVRLVGDLQTELVHDFFDGFVVHAGANLHAKVLYGRSNHHKLEAIFKCFARAMKYACSKDARLKDQLPSTKGLL

SEQ ID NO: 8098 - protein, 555 aa, Kluyveromyces lactis
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATSAKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGAIWNINSFDQWGVELGKVLAKVIGSELATDNKISSHDSSTNGLINQFKEWI

SEQ ID NO: 8099 - protein, 321 aa, Gossypium hirsutum
ALVLLGLHKLLPFTQTTACDVYCANLKTCFIIDIVFLLSITITAITTVKETPITRKEAGDEEDNEGRSSGRAFFAELVMAFKTLKKPMWFLLLVTCLNWMAWFPFLLYDTDWMGAEVYGGKVKGSASQQKLYDEGVRAGALGLMINSIVLAFASLGLEPVSRLIGGVKNMWGVVNLILAACLAATVWVTKVAEAWRGEHGPQILTPPPTSIKTSALALFGLLGIPLAVTFSIPFALASIYCSEEGGGQGLSLGVLNLSIVIPQMIISVISGPIDAAFGGGNLPAFVLGSILAAISALLAIFALPNPKTQLPLNSTGMAGAH

SEQ ID NO: 8100 - protein, 646 aa, Unknown
  Petunia x hybrida
MSVMRRLSQKNWRDGCGRTVSSLSGSRKDRNLQPCKLLRSRTISKLVIRLGGKKMSRAQDGILKYMLKMMEVCNARGFVYGIIPDKGKPVSGASDNIRAWWKEKVKFDKNGPAAIAKYEAECLAREERVGSQNGNPQSVLQDLQDATLGSLLSSLMQHCDPPQRKYPLEKGVSPPWWPTGNEEWWAKTGLPKGQKPPYKKPHDLKKMWKVGVLTAVIKHMSPDIAKIRRLVRQSKCLQDKMTAKESSIWLAVLSREESILQQPGSENRSSSLEPPPRSRGEKKKPSSSSDSDYDVDGFDDGIGSVSSRDERRNQPLDVRPLNVVPPSHQSKEQGDGRYRRRKRARSNPTEQQIQPSLIHGDEHSNTILDINSSQTLFVGCITNESLLLNDKSEAPKRAENESESQPELPLQDSNLSFVPSANVVSIEDAYIGAGPSLNIMSQNSAVVPYESGMHLGSQDSAIQHQFQDTQFHGCHKVSGMNNGPQSSSLHYGTPNNGLHYGPHNSVVRTELQDSAFVHGSEYSNINQPPMYHSYSSAEFGSAHEETQSHLACNELQIRPINSGVGSSVLNGTGNDIIGDNHHYGKDIYQNNHDRQIEMPFPSPLTIGSPDYALGSPFNLGLDIQSHLDSPDYDLDFDKEFMSFFAS

SEQ ID NO: 8101 - protein, 486 aa, Listeria innocua
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 8102 - protein, 682 aa, Listeria innocua
MEIFLYVLALLVAIFISNLLNRFVPFVSVPLIQIGLGVIIAIMPITFDLQLNPELFLVMFIAPLLFNDGRQTDKAALWGMRMPILVLALGLVFATVVVIGYFVHWMIPTVPLAAAFALAAALAPTDAVAVSSLSGRINLPKRIMNLLEGEALINDASGLVAFQFAIAAMVTGVFSLMDASISFFIIAIGGILVGLVLSWLKFRLLKWVRGLGMEDVTFHMLIQILTPFIIYLAAEELHVSGILAVVAAGIMHSMEQKKMDPQLVKLNVVSQSTWSVIIFVLNGLVFLLLGTQLPAITEVVWNDSGSSNLQVIAYILSITAALILLRFLWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRRRIYDLQQNNISNRGMDERERAKRLEIIQWERENTQKMTDEGRIVATDSYRYQHYLNMMEQAIKQRFRTKIKTAWMFLYRLIMLIIHPKKWRRITHKVKKGISKDSERFQAIRQLREENEILIISKLKEQLTKENADIIGPLITEHTIFLERVRKEHSPRGKRAKFEQKKREVQVVAFQLERDIIQNMFEKGGISRELARDLRQNLNMIETYLYDDFLE

SEQ ID NO: 8103 - protein, 323 aa, Oryza sativa
MTAYARGGEERGSGPARMREEEARRRACAAAGEADNEARAARGVSFLPGIKQRLLSFIFRKTWNEESDQTLRVQHLKKKFYFHFQDYVDLIIWKVQFLDRHHLFIKFGSVDGGVNPFFQTSYQSVVHNLMSFNSLNRIPAFFAVYNMETTDIVSLYQNSSEELYSLFEYFYDHFHTNPQNSSHGNFISSHSNNVHALDQLRTIKNKANSTSQQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 8104 - protein, 302 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQVPTDPYGKIAGSIFSLHHSWYWSCITCLIKLVLIALEPWAFIVQIIVTRKKHALRCV

SEQ ID NO: 8105 - protein, 130 aa, Bacillus halodurans
MVELNRTVYERIGGDKTVSALVDAFYTNVAGDPILAPIFPNDLTETKRKQQQFLTQFLGGPSLYTEEHGHPMLRARHLPFPITPRRAKAWLTCMERAMDEINLPSPEREEMMARLTMTAHHMVNQPEEHR

SEQ ID NO: 8106 - protein, 458 aa, Mycobacterium leprae
MNTTPSAHETIHEVIVIGSGPAGYTAALYAARAQLTPLVFEGTSFGGALMTTTEVENYPGFRNGITGPELMDDMREQALRFGAELRTEDVESVSLRGPIKSVVTAEGQTYQARAVILAMGTSVRYLQIPGEQELLGRGVSACATCDGSFFRGQDIAVIGGGDSAMEEALFLTRFARSVTLVHRRDEFRASKIMLGRARNNDKIKFITNHTVVAVNGYTTVTGLRLRNTTTGEETTLVVTGVFVAIGHEPRSSLVSDVVDIDPDGYVLVKGRTTSTSMDGVFAAGDLVDRTYRQAITAAGSGCAAAIDAERWLAEHAGSKANETTEETGDVDSTDTTDWSTAMTDAKNAGVTIEVTDASFFADVLSSNKPVLVDFWATWCGPCKMVAPVLEEIASEQRNQLTVAKLDVDTNPEMAREFQVVSIPTMILFQGGQPVKRIVGAKGKAALLRDLSDVVPNLN

SEQ ID NO: 8107 - protein, 291 aa, Hordeum vulgare
PPSVESIGVCYGMSANNLPAASTVVSMFKFNGIKSMRLYAPNQAALQAVGGTGINVVVGAPNDVLSNLAASPAAAASWVKSNIQAYPKVSFRYVCVGNEVAGGATRNLVPAMKNVHGALVAAGLGHIKVTTSVSQAILGVFSPPSAGSFTGEAAAFMGPVVQFLARTNAPLMANIYPYLAWAYNPSAMDMGYALFNASGTVVRDGAYGYQNLFDTTVDAFYTAMGKHGGSSVKLVVSESGWPSGGGTAATPANARFYNQHLINHVGRGTPRHPGAIETYIFAMFNENQKDS

SEQ ID NO: 8108 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSGNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLLYYTQAMIDYATNGKESFEGKRVTISGSGNVAQYAALKVIELGGTVVSLSDSKGCIILETGITSEQVAVISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 8109 - protein, 293 aa, Zea mays
  misc_feature (88)..(88): Xaa can be any naturally occurring amino acid
  misc_feature (170)..(170): Xaa can be any naturally occurring amino acid
MASSVAAAASTFLGTRLADPAPQNGRIVARFGFGLGGKAKPAPKKVAKTSTSSDRPLWFPGAVAPDYLDGSLVGDYGFDPFGLGKPVXEYLQFELDSLDQNLAKNEAGGIIGTRFESSEVKSTPLQPYSEVFGLQRFRECELIHGRWAMLATLGALSVEWLTGVTWQDAXGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGGSS

SEQ ID NO: 8110 - protein, 217 aa, Mangifera indica
MAGFRAEDDYDYLFKVGLIGDSGVGKSNLALRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGNLLAERESLSFMETSALEATNVDNAFAEVLSKSTALLARRLWKLVIIDQDAVPSKSEKIDVSKDVSAVKKVGCCSG

SEQ ID NO: 8111 - protein, 453 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTPLDQATVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 8112 - protein, 847 aa, Escherichia coli
MSKVRLAIIGNGMVGHRFIEDLLDKSDAANFDITVFCEEPRIAYDRVHLSSYFSHHTAEELSLVREGFYEKHGIKVLVGERAITINRQEKVIHSSAGRTVFYDKLIMATGSYPWIPPIKGSDTQDCFVYRTIEDLNAIESCARRSKRGAVVGGGLLGLEAAGALKNLGIETHVIEFAPMLMAEQLDQMGGEQLRRKIESMGVRVHTSKNTLEIVQEGVEARKTMRFADGSELEVDFIVFSTGIRPRDKLATQCGLDVAPRGGIVINDSCQTSDPDIYAIGECASWNNRVFGLVAPGYKMAQVAVDHILGSENAFEGADLSAKLKLLGVDVGGIGDAHGRTPGARSYVYLDESKEIYKRLIVSEDNKTLLGAVLVGDTSDYGNLLQLVLNAIELPENPDSLILPAHSGSGKPSIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPEHTPLQDSNDNFLANIQKDGTYSVIPRSPGGEITPEGLMAVGRIAREFNLYTKITGSQRLAMFGAQKDDLPEIWRQLIEAGFETGHAYAKALRMAKTCVGSTWCRYGVGDSVGLGVELENRYKGIRTPHKMKFGVSGCTRECSEAQGKDVGIIATEKGWNLYVCGNGGMKPRHADLLAADIDRETLIKYLDRFMMFYIRTADKLTRTAPWLENLEGGIDYLKAVIIDDKLGLNAHLEEEMARLREAVVCEWTETVNTPSAQTRFKHFINSDKRDPNVQMVPEREQHRPATPYERIPVTLVEDNA

SEQ ID NO: 8113 - protein, 346 aa, Saccharomyces cerevisiae
MAEASIEKTQILQKYLELDQRGRIIAEYVWIDGTGNLRSKGRTLGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHTNVSTKEMRQPGGMKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 8114 - protein, 264 aa, Helicobacter pylori
MVTMKDLLECGVHFGHQTRRWNPKTKKFIFGVRKNIHIIDLQKTLRYFRYTYNIVRDASAQGKSIMFVGTKKQANETLKEFAESIQVPYVNYRWLGGMLTNFSTIRKSVRKLEIIEEMENSGQIDLLTKKEKLMILRKKEKLDKYLGGVRHMKKIPDMIFVIDVAKEKIAVAEARKLHIPIVAPLDTNCDPDLVDYPIPGNDDAIRSIRLFCKEMSEAILEGRELMQEEIVHANENSEEIEYVSHEEKEEMLAEIQKEITQGAE

SEQ ID NO: 8115 - protein, 457 aa, Escherichia coli
MDHLPIFCQLRDRDCLIVGGGDVAERKARLLLDAGARLTVNALAFIPQFTAWADAGMLTLVEGPFDESLLDTCWLAIAATDDDALNQRVSEAAEARRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEYGMPGEMPVAIVENGTAVTQRVIDGTLTQLGELAQQMNSPSLIIIGRVVGLRDKLNWFSNH

SEQ ID NO: 8116 - protein, 776 aa, Fagopyrum esculentum
MEVLHENQDLQSMGSFGNCLPADVTRNPNFGEKRENREIWLGQGDVSNDGDPSSLFYAGDEFPALPDFPCMSSSSSNSSTPAPSTATPATAGGFSSSTGATSVCSSSSSSSSSAASWAVLKSDGEEDYHRHQNIVGREQQHEQGEYDDRMESVDCMNVMDDFDCMGITQLIEDSNEIWDPTPLFEAANTGQDQTPTTITQNHSQLNPFEEFQQQGHHLGELSQSDLQHDDQFLLLDDQADNKELDKMEPVSGLSEDLAVVFFEWLKSNKESITAEELRSIKIKKSTIESAAKRLGGGKEGMKQLLKLILQWVQNHRLHTKRSQDESVLDLTQSDLPGSIAPPQMLPNPELPNLNPNSTQVLNPISPCFNPPPQQPHWISPYGIDPAGIPIAPPPPGPSNFTSMVSYIGGHDPYTQAHQPYHAPPDQYHMLDGSMNSWAGQLATPLSLASSPLAPMHYNSGPDGSLLQAMTPQGFAGHGNGYNPYQFFPGPGDGLARMGSSATKEARKKRMARQRKMFTHHHHRNNHNTINHGNGTQQQMIQGGCIDPNTRIMIGDHDSTGSISHGGWVYWPQTAGSSGAGMAGPPMMGSMQSHQQLQPALAERPGVALPQASQKQAAADKKQGFKPEKNLKFLLQKVLKQSDVGNLGRIVLPKKEAETHLPELEARDGIPIAMEDIGTSRVWNMRYRFWPNNKSRMYLLENTGDFVRSNGLQEGDFIVIYSDVKCGKYMIRGVKVRPHQQGSKPEVAKKPSKAQKTHNSASPAAGTALSPPHAQRQ

SEQ ID NO: 8117 - protein, 429 aa, Unknown
  Synechococcus sp. WH 7805
MVDFATAPINAPLADSDPAIARLIDQERERQETHLELIASENFASSAVMAAQGSVLTNKYAEGLPNKRYYGGCEHVDAIEELAIERAKELFGAAWANVQPHSGAQANFAVFLALLQPGDTIMGLDLSHGGHLTHGSPVNVSGKWFNVVQYGVDQETQRLDMEAIRQLALEHKPKLIICGYSAYPRTIDFAAFRSIADEVGAYLLADMAHIAGLVAAGVHPSPVPYCDVVTTTTHKTLRGPRGGLILCRDADFAKKFDKAVFPGTQGGPLEHVIAAKAVAFGEALRPSFKVYSQQVVANAQALADRLMARGIDVVSGGTDNHVVLLDLRSIGMTGKVADLLVSDVHITANKNTVPFDPESPFVTSGLRLGTAALTTRGFDTDAFAEVAEVIADRLLNPADDAVQSRCLERVANLCRRFPLYAQATEPALV

SEQ ID NO: 8118 - protein, 429 aa, Rhodopirellula baltica
MIMDLNNTIALILGGGRGTRLFPLTKIRAKPAVPLAAKYRLIDIPISNCINSGLNRAYVLTQFLSESLHRHLRQTYTFDHFSGGFVELLAAQQTVNSGTDWYQGTADAVRKNLVHLRESWIKHVLILSGDQLYRMDFRDMMKTHIESGAAATIAGIPVTRKDASALGIMQVDDTGRVTGFVEKPQTEEEIAKVRMEPSWIDARGIESQGRDLLASMGLYIFDKDLMVDMLENSLHSDFGKEVFPEAINTHKVQLHLFDGYWEDIGTIRSFYEANLSLASKNPPFDIRNRHSPIYSRPRFLPPTIMGDAKITGSLIADGCRIGDNVTIENSVIGLRTVIGDNVTIKDSVVMGADFIEMRGAERDGKLPVGVGAGSVIQGAILDKNCRVGENVRILNEAKVDHQGEDDDLQIRDGISIVIKDGQIPDGFSC

SEQ ID NO: 8119 - protein, 198 aa, Unknown
  Bradyrhizobium genosp. alpha bv. genistearum
PTPNLRGKTQIKEFASFPTLEQLPLWGFDGSSTQQAEGHSSDCVLKPVAVFPDGARTNGVLVMCEVMMPDGKTPHASNKRATILDDSGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8120 - protein, 213 aa, Unknown
  Photobacterium sp. SKA34
MSKIYEDNSLTIGNTPLVRLNRVSNGKVLAKVEARNPSFSVKCRIGANMIWDAEKKGTLKEGVELVEPTSGNTGVALAFVAAARGYKLTLTMPESMSLERRKLLKALGANLVLTEAPKGMKGAIDKAEEIVNSDPSKYLLLQQFNNPANPEIHEKTTGPEIWDATDGEIDVFVSGVGTGGTLTGVSRFIKQQKGKAITTIAVEPLESPVITQT

SEQ ID NO: 8121 - protein, 202 aa, Oryza sativa
  misc_feature (50)..(50): Xaa can be any naturally occurring amino acid
RGFDTVKVKVADANAIAQEACKNEMNLRVVDATTITVAFDETTTLEDVYXLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHARGDYHRDVCIIPVSAHGTNPASAAMCGMKIVAVGTDSKGNIN

SEQ ID NO: 8122 - protein, 384 aa, Mesorhizobium loti
MPYLQRRELIQGSVAVAAIAALHASRVYAFPARPGEEVVKWLDQLPPNPVPEVVKNQLVWEDLDSWVTPNDKFFSIAHFNRPVIDESKWKLEVGGLVKKPMALTLADIKARPREEVAFTIECSGNTGLPFFNGGIGNARWAGTPLAPILKEAGVLDSGIEVVFWGADEGEIKRADEITFKQNFARSMSLADAMDPKNILCYEMNGTSLPPDNGFPLRLIAPGWYGIANAKWLKRIEVRDQRFESRFMGRDYVTVREEDHNGETVWAETSVGRARLKSAPARVTHIGNEYRIVGAAWGAPVDRVEGKIDEGPWMPATIDDADKAEFAWRMWSLDWPKPSAGEHTVTSRAIDTSGNIQPAMSDPWIAKKHTYWESNGQVTRRIQVG

SEQ ID NO: 8123 - protein, 334 aa, Prochlorococcus marinus
MGNSTKGLVLITGTTSGVGLNTLKPLLRFGWEVIAVNRSNKRAIEIAHQSLTDSEMKNMHFIEIDLSDLDDVRNGCDEILKKFKKPINSMICNAAVYKPRLRKPERSAQGFENSMAVNHFGHFLMINLLIDKILSSENEIYLNGKVTKFKPRITVLGTVTANYSELGGRIPIPAPANLGNLSGFKNGFLAPISMANGKKFKPGKAYKDSKLCNMITVQELSKKYSNERIIINSLYPGCVADTKLFRNTPWIFRFLFPIFQKFITKGYVSQRLAGERVAQVATFKKYAKPAVHWSWGNRQKSGRKAFSQKLSKRIIDSDISKQTYELTRKLVGLN

SEQ ID NO: 8124 - protein, 198 aa, Bradyrhizobium canariense
PTPNLRGKTQIKEFASFPTLEQLPLWGFDGSSTQQAEGHSSDCVLKPVAVFPDGARTNGVLVMCEVMMPDGKTPHPTNKRATILDDSGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8125 - protein, 73 aa, Rhodopirellula baltica
MGKKEEAFEVEGTVTQALANTRFRVQLETGNEVMAHVAGRMRKHFIRIVPGDKVRVELSPYDLTKGRIVYRER

SEQ ID NO: 8126 - protein, 198 aa, Bradyrhizobium canariense
PTPNLRGKTQIKEFASFPTLEQLPLWGFDGSSTQQAEGHSSDCVLKPVAVFPDGARTNGVLVMCEVMMPDGKTPHSTNKRATILDDSGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8127 - protein, 223 aa, Oryza sativa
MARFEVYENNGGTCVAVAGADYCVVAADTRLSVGYSILSRDSSKIAHLADKCVLASSGFQGDVKALQRNLTAKELLYEHNHNKKMSCPAMAQLLSNTLYYKRFFPYYAFNVLGGLDSEVAAHQYERMITTCENIFSSFAGYSAQGTGAALMMPVLDNQLKSPSPLLLPARDAVTPLSQSDAVDLVKDVFASATERDIYTGDKLEIVVINSAGSHREFIELRKD

SEQ ID NO: 8128 - protein, 324 aa, Brucella suis
MTSQDNPYGGAYGGPVSQMTANVSFGQPSAPANGGDLIKDTTTAGFQADVITESRKQPVLVDFWAPWCGPCKQLTPIIEKAVREARGAVKLVKMNIDEHPAIAGQLGIQSIPAVIAFVNGQPVDGFMGAQPETKVKEFIAKVGGPSDQEAALAEAIATAKELAQAGDFVQAAEIFSSILQVAPDNVDAVVGLATCMLEAGDAEQARSLLGTLAAEKQNEAPVRALEARLALADQVKLIGDPVELERRLAADPGDYQARFDLAQVRNAQGRRDDAANELLAIMRADRAWNDDGARKQLLQFFEAWGHMDPATLTARRKLSSLLFS

SEQ ID NO: 8129 - protein, 657 aa, Escherichia coli
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 8130 - protein, 410 aa, Mycobacterium avium
MASATGFVIIGGGLAAAKAVEALRDNNFDGRIIVFADEEHLPYERPPLSKEFLAGKKSLTDFTVQNSDWYRDNDVDLRLNTRVCALDAAGHTVGLPDGTTVAYDKLLLATGSAARRPPIPGSDCAGVHYLRTYEVAVALNSFLGEGKSLAVVGAGWIGLEVAAAARQRGVEVTVVEAARQPLTAALGETVGEVFATLHREHGVDLRLETQVREITRADGSATGLRTTDGSAIPADAVLVAVGARPNIELAEAAGLSLADGGVLVDASLRTSDPDIYAVGDIAAAEHPLLRTRIRTEHWANALKQPAIAVAGMLGRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 8131 - protein, 293 aa, Erwinia carotovora
MTTLEQCIGNTPLVKLQRMTQGLKSEIWLKLEGNNPAGSVKDRAAFSMILQAENRGDITPGDRLIEATSGNTGIALAMIAALKGYRLRLLMPDNMSYERQTAMRAYGAELVLVNRKLGMEGARDRAKQMVLAGEGKTLDQFNNPDNSLAHFLTTGPEIWQQTAGKLTHFISSMGTTGTISGVSRYLKQQNPAICTVGLQPAEGSHIPGIRRWTPDYMPGIFRADLVDRILDMTQVDAENTLRQLARQEGIFCGVSTGGAVAGALRIAAENPGSVIVAIACDRGDRYLSTGVFD

SEQ ID NO: 8132 - protein, 188 aa, Arabidopsis thaliana
MFQATSTGAQIMHAAFPRSWRRGHVLPLRSAKIFKPLACLELRGSTGIGGFHEIELKVRDYELDQFGVVNNAVYANYCQHGRHEFMDSIGINCNEVSRSGGALAIPELTIKFLAPLRSGCRFVVKTRISGISLVRIYFEQFIFKLPNQEPILEAKGTAVWLDNKYRPTRVPSHVRSYFGHFQCQHLVD

SEQ ID NO: 8133 - protein, 269 aa, Pisum sativum
MASACASSAIAAVAISTPSSQKNGSPSGTSKAFLGRKLKVNSSTASPSRVRSTSTVCTVAEPDRPLWFPGSTPPPWLDGSLPGDFGFDPLGLGSDPESLRWNVQAELVHSRWAMLGAAGIFIPEFLTKLGILNTPSWYTAGEQEYFTDTTTLFIVELVFIGWAEGRRWADILNPGCVNTDPIFPNNKLTGTDVGYPGGLWFDPLGWGSASPQKLKELRTKEIKNGRLAMLAVMGAWFQHIYTGTGPIDNLFAHLADPGHATIFAAFTPK

SEQ ID NO: 8134 - protein, 715 aa, Unknown
  delta proteobacterium MLMS-1
MSKEQSRSMLDRVSQWLGRKGNHSEQDQSEDNGIMPEPQEVQDSQDEPTTPAATGQPVNTAATTDNPGDDGAQQEADKKAKAKRSASARRREQRARAKERAAQEAAAAGGEAPAAENVAGDAPAEAADSPAPPKKSASRGKGGGRGGGAKTGGVAKGGGGRKGGGAKATGKAKEEDGKSGAATAKDADPADPGEEQPSAAAGKGKSGGRKAAAPAAKSGAGFKLLINTDEPEECRLALLENSKVEGFYIESVSRARIKGNIYKGRVTSVEANLQAAFVDIGLEKNGFLSFNEIHPEYYQQEVDPETSWKNLKIQDMVKKGQEVLVEVVKEGSGNKGPSLTTYLSLPGRFLVLMPGSDSAGISRKIDDEEHRNKLREMVEGLNIPEGVGYIVRTASQEITKTALSQDLRFLLNLWSEIRKGGQSLPAPSLLYKEQNIISRFLRDHYTSDIREILVDEEDAAEQVRNFLQLLPASQRKKTTVKLHQGSQPIFHQYHVEKQIEEMFQPTVPLPSGGSIVINPTEALVAIDVNSGRTSSKDRDFEESIFIANMEAAEELARQLRMRDLGGLIVVDFIDMRSAAHTREVEKKVRECMKRDKAKVDFSKISKFGLMQISRQKMAAPLQTTSYKTCPYCEGRGLIRSVENLALSHLRQIQTGMSRRRAKKVVCQLPMEVAQYILNKKREELLELEKEYGAEIVIEVDAAMLPADNRLDFIRD

SEQ ID NO: 8135 - protein, 138 aa, Neisseria meningitidis
MRLLHTMLRVGNLEKSLDFYQNVLGMKLLRRKDYPEGRFTLAFVGYGDETDSTVLELTHNWDTERYDLGNAYGHIAVEVDDAYEACERVKRQGGNVVREAGPMKHGTTVIAFVEDPDGYKIEFIQKKSGDDSVAYQTA

SEQ ID NO: 8136 - protein, 511 aa, Flavobacteria bacterium
MSDINMSKIDNLNLEFLQLKDYEELKHAMIDSYSNLPDSYWREEQIKTLIDKFPEGQVVLKVNEEIVACALSIVVKYDDFSGQYTYEQVTGNYQFTTHDDEGDVLYGIEVFIKPQYRGMRLGRRLYDYRKELCENLNLRGIAFGGRIPNYHNHASDMTPKEYIEKVRNKEITDSVLNFQLSNDFHVSRVLKNYLDGDKASMEFAVLLEWDNIYYTKPVTETTALKSTVRLGLIQWQMRPYSGFDELMQQVEYFVDAVAAYRSDFALFPEYFNAPLMAAYNKLSVSDSIRELAKYTEMIRNKFSELSIKYNINIITGSMPEIIDGQLYNVGNLCRRDGTIERYEKIHVTPDEQKVWGLQGGNKIQTFNTDCGKIGILICYDSEFPELSRIMAQEGMQILFVPFLTDTQNAYARVRLCSQARAVENECYVAIAGSVGNLPAVENMDISYAQSAVFTPCDFAFPSNGVKAEATANTEMILVADVDLDLLKELHNYGAVKNLKDRRTDLYEVSKK

SEQ ID NO: 8137 - protein, 452 aa, Desulfitobacterium hafniense
MSNQENGMHRGLKNRHIQMIALGGAIGTGLFYGSAATIELAGPAITFSYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 8138 - protein, 286 aa, Clostridium acetobutylicum
MLDLWYSESHADDTKFSIRVKEHLYSEKTPFQQIDFFKSETFGTFFTLDGYIMMTEKDEFIYHEMITHVPMAVNPKIKKVLIVGGGDGGTSREILRYNTIEKVDMVEIDERVVRLCQKYLTQTSCKLDNDSRLTMHFEDGKEFVKRAETGFYDLILVDSTDPIGPGEGLFTNEFYRDCERILSDDGILINQHESPYYKDYCHEMKRAHSKIKDKFPISMVYQFHMPTYASGHWLFGFASKKYHPLNNLNADSWNSLGLKTKYYNTNLHKGAFALPNYVIDELEKTE

SEQ ID NO: 8139 - protein, 516 aa, Oryza sativa
MEAKPVAMEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 8140 - protein, 466 aa, Zea mays
MDPCPFVRVLVGNLALKMPASASPATPRASGSGVHPTAARCHCRIRLNKMPYQTASAPLLPATEDGPASCTAAFAAAFHVSKADLDRAAARPAAALLLAARRRRTARLKVAVYAGRGGGVSASCGGGGATSGRLLGKVVLPLDLRAAMAKPVVFHSGWVAVGSRRGKAAAAASSSARAQLSITVRAEPDPRFVFQFDGEPECSPQVLQVKGSMKQPMFTCRFSCRSSSDLRSRSVQSDPGARNWLAKLWSERERERAGKERKGWSVTVHDLSGSPVALASMVTPFVASPGTDRVGRSNPGGWLILRRRVDGTWTPWGRLECWRDRGGSAGDAQLGYRFELVPDHNSNVTGSGVCVAESGVPAARGGRFAIDLTAAAQPFWCSSSGELSRHALWPPGGFVMSAAVQGEGRCSRPTVEVGVAHVGCAEDAAAFVALAAAVDLSMDACRLFSCKLRRELSAASRAEFLR

SEQ ID NO: 8141 - protein, 400 aa, Haemophilus influenzae
MNFLLCIFKGVYVIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFRVSALCAYMVVGAILWASVLKSGVHATLAGVIIGFSIPLKGKKGERPLDDFEHILASWSSFVILPLFAFANAGVSFAGIDVNMISSPLLLAIASGLIIGKPVGIFGFSYISVKLGLAKLPDGINFKQIFAVAVLCGIGFTMSMFLASLAFDANAGESVNTLSRLGILLGSTVSAILGYLFLKQTTKLN

SEQ ID NO: 8142 - protein, 487 aa, Crocosphaera watsonii
MKRRQFLIQSSLAAMTAIASHQLPSQSTPIYKQYKSYKSWKSNNIFLQGINAPVFEEVEITNFKISGNIPKELEGMYVRNGPNPMFKPESYSYPIEGDGMLHGVYFNKGEVIYKNRWIQTSGLAYEMFEGQQLTELKFKNYANTNIISHGNKLLALYEIGLPYEVNKNLETIGEWDFNHELEQAMTAHPKIDPNTGELHFYRYSFFNTPYLHYYVADRNHNIIRELAIDIPQPTMIHDMAITENYIIFVNCPLVFSMTNARNNSIPFVWQEEEGTTIILVDRHNFAKKPIYLKTDAFWTWHFLNSFETDNQIFIDFIAYPKIQAENNWETMLTHKSNLRRLTINLQTHGMEFEDLDDRFVELPAINQNYLGKNYQFGYTSYYDIELSSRKKIPNLSPSLVQYDLVKKTNKIHQFKPGCYGGEAAFIPSTKGQSELDGYVVTFVYNENTNTSDFVIIDPKNFESDPIATVHLPVRVPGGFHGNWIANL

SEQ ID NO: 8143 - protein, 857 aa, Xanthomonas oryzae
MNAVASLQADAEPSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARTAPAGSPGRDFYVWSDTDQEYEGTRIIFCDTEKSNWTWDPVAGQYFWHRFYSHQPDLNFDNPAVLEAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFELVSEGTLPDWHVPSPVPLPDYRTLVLRSDADGSAALLPHLPTLEGEILPAWLSARRWFSAKDQALRSVRIARRTPLPGDQPMTLLELEVELEDGRRERYMLPVGIVWEREQPSTLAEQLALARVRQGREVGYLTDAFALKPMVRGVIDALCSNAALKFCDGEEASQQGQVRFEATPALAMLDIPHDPEIRWLSAEQSNSSLVIADKAVFKLLRHVAVGANPEIEIGRRLTEMGYANAAPLLGSISRVDGQGTVTTIALLQGFIRNQGDAWRWTLDHLARSFDEYVDRADRRSARRSRRWL

SEQ ID NO: 8144 - protein, 72 aa, Rhodobacter sphaeroides
MAKEDTLEFPGVVKELLPNATFRVELDNGHELIAVMAGKMRKNRIRVLAGDKVQVEMTPYDLSKGRINYRFK

SEQ ID NO: 8145 - protein, 388 aa, Triticum aestivum
MAVSAIGFEGYEKRLEITFSEAPVFTDPNGRGLRALSRAQIDSVLDLAKCTIVSELSNEKFDSYVLSESSLFVYPYKVVIKTCGTTKLLLAIPRVLELAEELSLPLAAVKYSRGTFIFPEAQPSPHKNFSAEVAFLNGFFGGLKSGGNAYVIGDPAKPGQKWHVYYATQQPEQPVVNLEMCMTGLDKKKASIFFKTSDDGHTSCAKEMTKLSGISEIIPEMEICDFDFEPCGYSMNAIHGSAFSTIHVTPEDGFSYASYEVMGLDPASMAYGDLVKRVLRSFGPSEFSVAVTIFGGHSLAGTWGERLNVGIYDSTNMVVQELPDGGALIYQSFTAVGEDFTGSPRSVLNCNVDGNLVTGCKMDAFLCWEDDAAQEKDERGAGKKMKSS

SEQ ID NO: 8146 - protein, 112 aa, Streptomyces coelicolor
SHMAGTLKHVTDDSFEQDVLKNDKPVLVDFWAAWCGPCRQIAPSLEAIAAEYGDKIEIVKLNIDENPGTAAKYGVMSIPTLNVYQGGEVAKTIVGAKPKAAIVRDLEDFIAD

SEQ ID NO: 8147 - protein, 132 aa, Kluyveromyces lactis
  misc_feature (78)..(78): Xaa can be any naturally occurring amino acid
LEQIVGEASAFSGSSVKYIAGARPWVHVGKVDVALPCATQNEVSGAEAEHLVSNGVKFVAEGSNMGSTQEAIDVFEGXRLQTASTSAPAVWYAPGKASNMGGVAVSGLEMAQNSARVSWTRETVDAELKKIM

SEQ ID NO: 8148 - protein, 311 aa, Acidobacteria bacterium
MTDNVRNTVILGSGCSGLTAAIYAARANLKPLLIQGHEPGGQLSMTTLVENFPGWPEGIQGPELIENMHKQAERFGTEFHTGHLHSADLSKRPFELHMGKETILTKTLIIASGASARWLNLKSEQELIGHGVSSCATCDGFFFSGKEISVIGGGDSAMEEALFLTRFATKVHLIHRRDAFRASKIMLDRARKHEKISMITDTVVEEVHDPAQKEVTGLTLRNLKTDKVWDLPVSAMFLGIGHHPNATAFGDQLDKDADGYLITKDYVFTKVPGVFASGDVQDRRYRQAITAAGSGCMAAIEAERFLEEHGG

SEQ ID NO: 8149 - protein, 302 aa, Schizosaccharomyces pombe
MASTTDMSTYKLNHTMIRVKDLDKSLKFYTEVFGMKLIDQWVFEENEFSLSFLAFDGPGALNHGVERSKREGILELTYNFGTEKKEGPVYINGNTEPKRGFGHICFTVDNIESACAYLESKGVSFKKKLSDGKMKHIAFALDPDNYWIELVSQSETKPKANISNFRFNHTMVRVKDPEPSIAFYEKLGMKVIDKADHPNGKFTNYFLAYPSDLPRHDREGLLELTHNWGTEKESGPVYHNGNDGDEKGYGHVCISVDNINAACSKFEAEGLPFKKKLTDGRMKDIAFLLDPDNYWVEVIEQK

SEQ ID NO: 8150 - protein, 345 aa, Mesorhizobium loti
MLQSTAPLAPPAGAGFNAGKRSSVHARRRGGCVLKVGVVLNPIAGGGRLKRHWPEVAASLKKHFGDFELRETQAEGDAERLAIDLAATGFDLVIAAGGDGTASEVADGLLQAFEESGRTTELGLLPCGTGIDFARGLGLPKAVDATLKRIAGAEGRKVDAGRICYIDDHGALASRHFINIASLGLSGATDRAVNADKRKGKMSAKALFLWRTVVEFIRYRFQHVRITVDDGAPVEARMALVAVANGKFFGGGMMIAPDAELTDGQFDIVILRAAGKLKLIWDIRLLYGGRHRNHPAITILRGKKVVVEPLDDVEKNGALVDIDGESPGRIPATFEILPGALTLRY

SEQ ID NO: 8151 - protein, 465 aa, Solanum berthaultii
MSTKPTPLELPEMSTMSLEETFHPSKVSESTESSSSSTTPLSPHTGGDVRWDAINSATGRGGPPLNLSNFRLLKRLGYGDIGSVYLVELRGTNAFFAMKVMDKGSLASRNKLLRAQTEREILSLLDHPFLPTLYSHFETDKFYCLVMEFCSGGNLHQLRQKQPNKHFTEEASRFYASEVLLALEYLHMLGIVYRDLKPENVLVRDEGHIMLSDFDLSLRCSVNPTLVKSSSVHGGGGNPSSGSGILDNDNAVQGCIQPSTFFPRNILPTKKNRKSKSDFGLFVGGSLPELMAEPTNVRSMSFVGTHEYLAPEIIRGEGHGSAVDWWTFGIFLYELLHGTTPFKGAGNRATLFNVVGQPLRFPETPQVSAIARDLIRGLLVKEPHKRIAYKRGATEIKQHPFFEGVNWALVRSAVPPSIPEPVDFAQYASKEASAPCSDKKMPDTESHDKSKNTSNDSSYMDFEYF

SEQ ID NO: 8152 - protein, 510 aa, Asarina barclaiana
MENGDHRTAPAFQLQQASPPEAAPVRNIILVAAIAAGVQFGWALQLSLLTPYVQLLGIPHTWTAFIWLCGPVSGMLVQPIVGYYSDNCTLRFGRRKPFIAGGAGLVVVAVFLIGFAADIGYAAGDTLGKGTKPRATAVFVVGFWILDVANNMLQGPCRALLADLSGGNARKMSNANALYSFFMAVGNVSGYAAGSYTHLFKIFPFSKTKACDVYCANLKSCFFISVALLLCVSALALTIVRETPPPETAEAPEATKKKKIPVFGELFSALKNLPRPMWFLLLVACLNWIAWFPFLLFDTDWMGKEVYGGTVAEGKMYDRGVRAGALGLMLNPVVLGFSSLGIQAIARGVGGPKRLWGGVNFLLAVCLALTVVITKQAEHSRLYTVGADGVQILLPPVPGVKISALALSGVLGIPLAVTFSIPFALASIYSSNYGAGQGLSLGVLNLAIVIPQMVVSVASGPLDALFGGGNIPAFVMGAVAAAVSGIFAVTMLPALPADASTKNLSVGSFH

SEQ ID NO: 8153 - protein, 364 aa, Brassica napus
MALSAIGFEGYEKRLEVSFLEPSIFQDSKGLGLRALTRSQLDQILTPAACEIVSSLSNDHLDSYVLSESSFFVYPYKVIIKTCGTTKLLLSIPPLLELAGELSLSVKSVKYTRGSFLCPGGQPFPHRSFSEEVSVLDGHFTKLGLNSVAYLMGNDDETKKWHVYAASSPQSSGDNNNVYTLEMCMTGLDREKASVFYKNGETGTMTDNSGIRKILPKSQICDFEFEPCGYSMNSIEGDAISTIHVTPEDGFSYASFEAVGYDLNTMDLSQLVTRVLSCFEPKQLSVAVHSSVGVNAYKPEISVDLEDYGCRERTFETLGEESGTVMYQTFEKLGKYCGSPRSTLKCEWSSNNSCSSEDEKDEGI

SEQ ID NO: 8154 - protein, 219 aa, Unknown
  delta proteobacterium MLMS-1
MLKDGEKGAVLQRDKESYAIVPHLPLGLITPEQLRKVAEVAEKYQCAAIKITSAARIAIVGLKEDDIDAAWRDLGMSPGAAVGMCVRSIKTCPGNTLCRLGQQDAMGLARELDSRYHGLELPGKAKLGVSGCPNQCGESSVKDIGYIGKAKGWSIVVGGNAASRPQLAQPLLDGLDDEQALAVTSNIFEFFKTEAKKGERLGRLIDRVGMEAFKEKVCS

SEQ ID NO: 8155 - protein, 614 aa, Kluyveromyces lactis
MKGTLVSIVLLAIKAQLARAGEDGGPLDEGEPGDETPIPDDPEDVNPITEEMFSSWALFILLFLLIAALWSSYMLTRKRVRAVHETVLSIFYGMLVGLIIRLTPGHYIQDTVTFNSSYFFNVLLPPIILNSGYELNQVNFFNNIVSILTFAIPGTLISAVVLGTILFIWTSLGLEGINISFVDALSVGATLSATDPVTILSIFNAYKVDPKLYTIIFGESLLNDAISIVMFETCQKFHGKKLQFSSFFEGIGMFMMTFTVSLLIGCMIGMLVALFLKHTYIRRYPQIESCIILLVAYQSYFFSNGCHMSGIVSLLFCGITLKHYAYYNMSRRTQVTLKYIFQLLARLSENFIFIYLGLALFTEVELVYKPMLIIITAISICVARWSAVLPLSNFVNWFYRMKTLRSMGLNANSESEYSIPDEIPYQYQMMVFWAGLRGAVGVALAMGIQGEFKFTLLATVLVVVVLTVIIFGGTTASMLEILNIKTGCVDENDISDDEFDIEAPRPISLANSSLNLSTDFRSDFPPLATSVNAAAGIISPEDTPSQQLNGPRFSFDGAQIRSSVDKIFQQDQWFANFDEQVLKPVFLDNNSAIPSQTNTKSSNSPNDMSVRRTL

SEQ ID NO: 8156 - protein, 247 aa, Streptococcus gordonii
QVAQTLDHKVKVMHASKGLEPDSHERISTILEEEIPSELRSEIVVVSGPSHAEETIVRDITLITAASKDLEAAKYVQKLFSNHYFRLYTNTDVVGVETAGALKNIIAVGAGALHGLGYGDNAKAAIITRGLAEITRLGVKLGASPLTYSGLSGVGDLIVTGTSIHSRNWRAGDALGRGEKLADIEANMGMVIEGISTTKAAYELAQELDVYMPITQAIYKVIYQDHDIKEAIFEIMNNEFKAENEWS

SEQ ID NO: 8157 - protein, 389 aa, Campylobacter jejuni
MNNIVHKLKTLVLNEAFGGVLLIVCTLLALLVQNGSFSEHYREFLNLKVGFSVGEFELNKPFLLWINDGLISIFFFAIGLELKKEFLHGDFKNPKNIVLPFMAALGGILIPAMLFALVNIGDAYTLKGWAIPTATDTAFALAILMMCGKHIPSSLKIFLLSLAIFDDVGAILIIAIFYTTKLSIAAFVIAGLAILVMLILNLLGITRKSFYFICSVILWISVLKSGVHATLAGIVTAFFIPMQTKNGEAFLEEIYESLKFWIAFIILPLFAFANAGVNLSNIDIGAIFSGVSIGIFLGLFVGKQVGVFLFSYLAIRFKFAALPQGSNLKQLYGVCILTGIGFTMSLFIDGLAYEVSDIFNYADNLAILIASFCSGIWGFIYLKFFTTRS

SEQ ID NO: 8158 - protein, 298 aa, Schizosaccharomyces pombe
MSVQELSHPLIKDGWFREINNMWPGQAMTLKVKKVLYAGKSKYQDVLVFESETYGHVLVLDGAIQATERDEFSYQEMIAHLALNSHPNPKKVLVIGGGDGGVLREVVKHECVEEAILCDIDEDVIKVSKQYLPEMSAGFNHPKVKVHIGDGFKFLQDYQNTFDVIITDSSDPDGPAEALFQKPYFQLLSDALRGGGVITTQAECMWIHLGVISNVLTAVKTVFPNVRYAYTTIPTYPSGSIGFVVASKDASIDLSKPLRKWSPEEENKLCKYYNSEIHAASFVLPTFARDVVDKATSS

SEQ ID NO: 8159 - protein, 198 aa, Bradyrhizobium canariense
PTPNLRGKTQIKEFASFPTLEQLPLWGFDGSSTQQAEGHSSDCVLKPIAVFPDGARTNGVLVMCEVMMPDGKTPHSTNKRATILDDSGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8160 - protein, 322 aa, Erwinia carotovora
MSKIYEDNSFTIGHTPLVRLNRIGNGRILAKVESRNPSFSVKCRIGSNLIWDAEKRGVLKPGIELVEPTSGNTGIALAYVAAARGYKLTLTMPETMSIERRKLLKALGANLVLTEGAKGMKGAIAKAEEIVASDPSRYLLLQQFSNPANPEIHEKTTGPEIWEDTDGEVDVFISGVGTGGTLTGVSRYLKNTKGKAIISVAVEPTDSPVISQALAGEELKPGPHKIQGIGAGFIPGNLDLELIDRVEKVTNEEAISTARRLMEEEGILAGISSGAAVAAALNLLKEKEFDGKTIVVILPSSGERYLSTALFADLFTEQELQQ

SEQ ID NO: 8161 - protein, 234 aa, Ficus carica
CWERPEDMDTSRALYKITSNSPGSEVAAEAAAALAAASIVFKGVDSKYSSKLLSQSQSLFDCANKYRGSYQGSCPFYCSYSGYQDELLWAAGWLYKASGNKNYLTYVTSNKGWSQVVSEFSWDNKFVGVQTLLAKEFYGGNKDLEKYKNDIESFVCAVMPGSSSVQIRTTPGGLLYTRDGSDLQYVTTVTMALLITSKTFSAAQSGGVQCGSAKFSASQIRAFAKTTGRLHPPV

SEQ ID NO: 8162 - protein, 378 aa, Streptococcus pyogenes
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 8163 - protein, 405 aa, Xanthobacter autotrophicus
MLNRRQMLKSAGGTALGIGAGLAVGARLTAFAAETVTLPFANGDRELVAYPGKRPLIRLTTRPPQLETPFSVYNDGLITPNDAFFVRYHLADIPTEIDPESFRVEVKGKVDKPLSLSLMDLKSRFDAVELVAVHQCSGNSRGFFEPRVGGGQAGNGLMGNARWKGVPLKAVLDKAGVQAGAVQVSFGGLDGPVVPDTPDFAKALDIDHARDGEVMLAYEMNGAELPWLNGYPLRLVVPGFYGTYWVKHLNEITVLDKPFQSFWMDTAYRIPANACACTEPGKAPTATVPINRFDVRSFITSVQDGAKLKAGELALRGIAFDGGYGVSDVEVSADGGKSWQAASLGEDLGKYSFREWKMTIPLQKGAHTLMVRAVNRIGQSQPMEPLWNPAGYMRNVVEHTRIVAA

SEQ ID NO: 8164 - protein, 208 aa, Azospirillum brasilense
MKLAEALLRALKDRGAQAMFGIPGDSACPSLGGGGNADPAAPHAEHEPPVGFAADAAARYSSTLGVAAVTYGSGAFNMVNAVAGAYAEKSPVVVISGAPGTTEGNPGLLLHHQDRTLDTQFQVFKEITVAQARLDDPAKAPAEIARVLGAARALSRPVYLEIPRNMVNAEVEPVGDDPAWPVDRDALAACADEVLAAMRSATSPVQMV

SEQ ID NO: 8165 - protein, 216 aa, Xylella fastidiosa
MVMTIEALKHLGRVDESRVGRTEPLPLDNRHYVNGHPLCDSFPGLALIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSEQYAAASASREVYQQQLNTAGYTAITTEILHPAPPFYYAENEHQQYLAKHPNGYCGLGGTGVTCAIRLQV

SEQ ID NO: 8166 - protein, 709 aa, Haemophilus influenzae
  misc_feature (287)..(287): Xaa can be any naturally occurring amino acid
MNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVVEAIKEFAKEAGKPRWDWVAPQPNTDLINKVKAIAEARLGDAYRITEKQLRYEQIDAIKADVIAQITAEDEEXSEGKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGVIYKGKVTRLADFGAFVAIVGNKEGLVHISQIAEERVEKVSDYLQVGQEVNVKVVEIDRQGRIRLTMKDLAPKQETEINQEDSVEEQE

SEQ ID NO: 8167 - protein, 126 aa, Rhizobium leguminosarum
MAGGKCLALIAHDQKKDDMAAFARANRDILSRWKIVATGTTGGRVLDAAPDLDVVRLKSGPLGGDQQIGALISTGEVDALIFFVDPLTPMPHDVDVKALMRLAIVYDIPMALNHATAIKLLPTLEA

SEQ ID NO: 8168 - protein, 613 aa, Haemophilus influenzae
MTDKITFNDLGLPEFILKAVSDLGFETPSPIQQSCIPHLLNGNDVLGMAQTGSGKTAAFALPLLAQIDPSEKHPQMLVMAPTRELAIQVADACELFVKYAQGTRIVTLYGGQRYDIQLRALKQGAQVVVGTPGRILDHIRRGTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQENIAAAMLMLLQGKQKLILPPDPPMEKRRRERNDRGDRRENPRSAERRGERKGYGNPQPMDLYRIEVGRADGVEVRHIVGAIANEGDINSRYIGHIKLYDDYTTVELPQGMPKELLQQFAKTRVLNKQMQMSFLGAVKSDNSRGSDDFNGKRKGRGGDFRGERGRERGNDNRGNRKFNEKSNRTFSDKPRRDRRSSF

SEQ ID NO: 8169 - protein, 225 aa, Triticum aestivum
  misc_feature (119)..(119): Xaa can be any naturally occurring amino acid
MLQCLEGVRHLGGLLLKCCGIDLKQPKGLEDPEVLARETVFSVSEVEALYELFKKISSAVIDDGLINKEEFQLALFKTSKKESLFADRVFDLFDTKHNGILGFEEFARALSVFHPSAPXDEKTDFSFQLYDLKQQGFIERQEVKQMVVATLAESGMNLSDEVIESIIDKTFEEADTKHDGKIDKEEWRNLVLRHPSLLKNMTLQYLKDITTTFPSFVFHSQVDDT

SEQ ID NO: 8170 - protein, 273 aa, Carboxydothermus hydrogenoformans
MWYIEKHNENYQVGWRVSDILYQKKTPYQNLAIVEFAEFGRSLILDDAVQTTEKDEYVYHEMLVHPAAFTHKSPRRALIIGGGDGGTLREVLKHKTIEKVDLVEIDEEVIKASKQFLPSLSESFNDPRVEVIIDDGIRYVKKVKNYYDLIFVDASDPVGPAVVLYSEEFYRSLFDALTADGIAAVQSESPNFYPDIFVKIVTTLRDIFPKVNVALAPVPSYISGFFAFTVASKVYNPKETTPNITFPTKYYNEEIHNACFALPNFILDMLKIR

SEQ ID NO: 8171 - protein, 400 aa, Magnaporthe grisea
MNLSNLLAVLLVGAGVSALTLPQARSPAPAESSRQQQQQQQQQQQQQQARSVPAGFATTNGTRFTIDGETQYLVGTNAYWLPFLTNNADVDLALDQMAASGIKILRTWGFNDVTSIPTDPNTVWFQYLSASGSIINEGPNGLQRLDYIVAGAEKRGLKLIIPFVNNWQDYGGVPAYEAAFGRGSSTWFKHEPAQAQYQAYVKAVVSRYAASPAIFSWQLANEPRCFLCSTDDIFNWATKTSELVKSLDPNHLVSIGDEGQGLTGDVWTPYWLVFGTDFWRNLQIKTIDFGTFHMYPTTWGAPVSFAYNWIKSHGSKCVDAGKPCYMEEYGVPPSKGHCEVESQWQKWALETKGIAGDGFWQMGTRLSTGLTHDDTFTIYHDTDEWTCLVTDHVARAKNAS

SEQ ID NO: 8172 - protein, 483 aa, Chlorobium tepidum
MHTPLEQQEIRYRKGDIIELTITDHAEKDKCFGKTTEGMGVMVSGILAPGDRVSAQIYKVKSRYLEARAIEVLEASPDRVEPVCPVFGSCGGCKWMHVSYEAQLRYKHKKVTDSLEHIGGFESPDVRPVLAAPDALHYRNKVEFSCSNMRYLLQSEIDSDQLAKPKTFALGFHAPGNFEKVLDLDTCYLAKECMNRVLNVLRDFAIERGLEPYAAKAHEGYLRNLMLRYSERHEQLMVNIVTSWYDKALMQALKERLEAAMPEQQMTLLNNVTTRKNTVATGEQEYVISGDGYVTERLGDLDFRISANSFFQTNTRQAETLYDQIIAVGGITPEDTVYDLYCGTGTITLYLARHCKQAIGIEVVESAVKDAEMNAELNGLSNTVFFQADLKNFHAMQEALEPYAKPRIIVTDPPRAGMHPKALDTMLKLQPERIVYVSCNPDNLARDGKEIAARGYRMTSAQPVDMFPQTNHIETVACFERAE

SEQ ID NO: 8173 - protein, 570 aa, Treponema denticola
MLITFKELGLDDIVLQAVEAKGFEEPTPIQVLAIPRLLSGEANVIAKARTGTGKTAAFGLPLVQELRSNTGKVRALILVPTRELAVQVAGELESFRIEEYPRIATVYGGAAIGPQLRSLKTGVEIVVGTPGRIMDHLERGSLKIEDIEYFILDEADEMLNMGFIEDIENIFSKANPEARVLMFSATMPKQILSIASDFMGDYEIVEEEPQEERASLTEQFFWVVREGDKTEALVRLIDTSPNFYGLVFCQTKIDADDVAKELDERHYEAAALHGDIPQSQREKILERFRSKKTRILVATDVAARGIDIEGISHVVNYAIPYDGPTYTHRIGRTGRAGAAGVAVSFVRPNEVKRIEYLRKHARGELKEGKIPSIEQVIEIKRTRILKETAAQIEKRISEEKPEQGFAAFANKLTEYGDAQTVLSFILQMQYGSFLSPAHYKTIKPVRSEGKARKSDDDSLRLYIGVGRKDGITKRKLAEMLSRLLSIPERLVDDIEVMDKFSLATMPKNAANDALRLCKKKRGLPHMHIDVKSEAPTNYGSIGKGKRGQKRKNGTQRKKEGLSSASKYKRK

SEQ ID NO: 8174 - protein, 474 aa, Crocosphaera watsonii
MKKTLFLSPPSFDGFDGAAGARYQAKREITSFWYPTWLAQPAALVPGSKLVDAPAHYQNVEDVLKIAKDYELVIMYTSTPTLPNDVKCAEAIKAQNPDTQVGLLGAHAAVLPTQTLKDHPIIDFVCRNEFDYTCKELAEGKPYEDIKGLTYRDALGNIKHTEERELIHDWDSMPSVFPMYEQHLNFRNYFIGYLQHPYVSLYTGRGCPAQCTFCLWPQTIGGHQYRAKSPEAVGKEMALAKSIWGNEVREYFFDDDTFTIDKKRVMAISEHLKKLNLTWSCNARANLDYETLKTLRDNGLRLLLVGFESGNQGVLDGVKKGIKLEVARRFMNNCNKLGIKVHGAFILGLPNESKETIEDTIRFACDISPHTIQVSIASPYPGTELYKQAQENGWFTNKNLVASSGIQLSTLQYPNLSAAEIEEGVEQMYRRFYFRRRTIVPIVKEMLGDPQMLVRRLREGREFMAYLKNVILAV

SEQ ID NO: 8175 - protein, 398 aa, Yarrowia lipolytica
MSALLRSSLRFKHMSAVNRLTQQLRLLTASAPLSAANTAGKAPFKVAVVGSGNWGTTVAKIVAENCTAHPELFEPEVRVWVREEKVNGKNLTDIFNAEHENVRYLPKIKLPHNLIAEPDLLKAVEGANIIVFNLPHQFLAGVCKQLKGHVNPKARAISCLKGLDVTPQGVYLLSDVIENETGLHCGVLSGANLATEIALEKYSETTVAYNRPKDFFGEGDVTNDVLKALFHRPYFHVRCVQDVAGVSIGGALKNVVALCAGFVEGKNWGDNAKAAIMRRGMLEMINFSKRFFPETDINTLTVESAGVADLITSCAGGRNFKVGRAFGKESGSGKTIQDVEKELLNGQSAQGVITCNEVHELLKNKNMQKDFPLFESTWGIIHGELKIDDLPEILYHAN

SEQ ID NO: 8176 - protein, 530 aa, Unknown
  Acinetobacter sp. ADP1
MNTQRKVAIVTGANGGIGRVICQSLASAHYLIAGLDREGIDLERNMSQLGTEHRAYVCDLADDQQIQRVVKEIAAHYGHIDLIVNNAAIGPTMSATIDTSLDEFKQAMSVNWMGPLQLIRQALPWMPIHGAAIVNIASLAGVVSNPKRNAYSASKAAMISLTRSLACELAHKQIRVNAIAPGYVRTNMVAELETSGKVDLHLVRQRIPMGRLARPEEIAHVVTFLGSEQARYITGSIVPVDGGWACFNQAGNAHPAQQDIPQSELNVDSPLGRSRVVVITGAAQGIGRAIAEKFAAQGDRLILLDLNQEPLEKLRETLAGEHLSFCVDISDEQQVKQVFHSIQKLYSEIDVLVNNAGIAEQFLPLEQQSVEAIEKLFDINLNGAFCCIRECLNAMQHKAGVVINMGSINSHLAFSPRHAYGASKAAIEMLSRCLTAELAPQGIRVLTLCPGYIQTPGVVQLEQSGRINVENIRRRIPLGRLGQPEDIAEAAYFLASPQASYINGAAVYVDGGWTAFGNAGDASSPSAIYN

SEQ ID NO: 8177 - protein, 543 aa, Ustilago maydis
MRVYNSIVAVAMTAAAVTQAAQIPFSLQRSQNEQPAKLLEHANLPAHSLRVVSPPSSICDPSVKSYSGYLDVDVDLLSKHDSHSNGAISINKHEKDGHTKGAIEHFYFWAFESRNDPKTDPVVLWLNGGPGCSSFTGLLMELGPCNAVDPASRDGKPGTEKNAWSWNNNATMIFLDQPVGVGYSYVDWANKSRTDQPPSRVFSAESAAKDASAFLHLLAMHMGEEIFKGDGDAFPSFHIAGESYAGRYIPLLANQIVQDNKKILQHPEMELKPLPLESVLIGNGITSPEHQFPAYVEYTCTEKSGSKKPLLPKKTCKKMNESIPTCLTLVEKCNRKDKHGRTYDTAACQAASNYCETALSSPYDTLNKSPYDWQHAAKYAEEDWVAAFLNDNETKIGLGVDGRGPGDKHDGVFVGCSDKVYANFAKTGDGSRDSTWAVTSILENNVRVLTYSGRRDFICNYLGNRAWSEALPWSGKDEYNKVQLTDWFIGSGPNSVKAGQYKASGNLTYAIVDHAGHFVPHDKPQAALAMFNTWLHGQHPGHL

SEQ ID NO: 8178 - protein, 324 aa, Rhizobium leguminosarum
MSTPQAPIGSGFGAASTAADVIAGHDLLGKVAIVTGGYSGLGRETARVLAEAGARVVVPARNLGKAKAAVESIPGLAVEKLDLMDPGSIDDFADRFLESGEPLHLLINNAAVMANPLTRDARGYESQFSTNHLGHFQLTARLWPALVKAEGARVIAVSSRGHVFSGVDFDDPNFENREYAPYLAYGQSKTANALFAISLDALGAKHGVRAFSLHPGGIVTTNLVRHQSSDFLKASGYVDEDGKPVIDPENNKKTIEQGASTTVWCAVSEKLEGLGGVYCENCDIAAAVPGDSTEMLGVRPWATDPEFAERLWQLSERLTGFITS

SEQ ID NO: 8179 - protein, 382 aa, Campylobacter jejuni
MQMIKKMVLSETFPGILLIFFTFLALLCKNSSLSVIYTDFFHANFTVGFDHFQISKSLDLWINDGLIAIFFLCIGLELKYEILRGQLKNIRAVSLPIFGALGGMITPALIFIAINYSHDFAMKGWAIPTATDIAFAVGILMLLGNKIPTSLKLFLLSLAIFDDLGAIVIIALFYTDQLSALAIIICLFCIFALLLLNYYHITHLSLYVLVGVVLWIAMLKSGVHATLAGVIISLFIPLDTKNKKPYLHEVLKDLNPWVVYFILPLFAFANAGIDIRDMHLGSVFSPVSLGIILGLFLGKQLGVFTFCFIAIKLKLAKLPENIKYGKFYGICILTGIGFTMSLFIDGLAYKNSDIFEYADKLAILVASFLSAIVGFIYLKIVK

SEQ ID NO: 8180 - protein, 889 aa, Xanthomonas axonopodis
MAAPHPASDASRERISLNAQWRFHRGDPPANQEILDYDVRPQVVRSDDGKVADAQPEQAQLTDASAVRVLKPWILPTANGLIADPAQRHTRPPGNPGSTVAYVQPHFDDSAWETVDLPHDWAIAGPFLANGPYGGMGRLPSWGIGWYRKSLDIPASDRGRALFLDLDGAMSYATVWLNGTLVGGWPYGYSSWRVDLTPYVIAGKRNQLVIRLDNPPESARWYPGGGLYRNVWLTKTAPLHIAHWGTQLTTPHVSADAAQVQLTVTLDNAARSATQAQVSTAIYLLDDASDRPSGEAVARIPAQPIAVPAGGTAHVQGSTRIDAPRLWGPPPTQQPHRYVAITEVGQQGHVVDRYETRFGIRSIVFDADRGLLVNGEHVPIRGVNNHHDLGALGAAFNRRAAERQLQLLQQMGANAIRMSHNPPAPELLELTDRMGLLVVDEVFDSWEMKKTPLDFHLVFPQWHATDLRAMLRRDRNHPSVMLWSVGNEVGEQYTGEQGAAIARALRAIVHAEDPTRPAAVAMNYASPEMPLSAALDVVSLNYQGEGIRDAAEFEGTQRIRKPPQYPAFHARFPHKAIVSSETASALSSRGVYLFPVTPDNSAPVRDGRGGDSAAHQVSAYELHAVDFGSSADKVFAALDRHPYVAGEFVWTGFDYLGEPTPYYSSRSSYSGIFDLAGFPKDRYWLYQSRWRPELPVAHLLPHWSWPGREGQVTPVHVFTSGDEAELFVNGVSQGRKRKAPLQYRLRWDAVVYQPGELQMQAYKDGKPWASERVQTAGRAARMQLMPDRGSIRGDGQDLSFITVRLLDRDGRPAPTAGDRLRFRIEGPGELVATDNGDPTNLETFASSQRHAFNGLCLAIVRAKAGARGTITVHVESDTLQAAQTQVAVQ

SEQ ID NO: 8181 - protein, 733 aa, Rhodopirellula baltica
MPDRFVTCGFSELRRAHDGLEGPRQPNQASDSRSDLYMLMRQPCPDLQFAYSPPFGATLTEKGVQFSVFSRSATEMRLLLYNKVTDREPAQVIDFDRGTDRWGDVWSLHVPGLEAGQLYHFQASGPWEPENGHRFDSTARLIDPYAQALAGTYQKQTDGVVRPPKCVVVDGTFDWEGDRHVRRDVSESIIYEMHVRGFTKSKTAKVKAPGSYLGVIEKIPYLKSLGVTSVELMPVHEFPIRDPQGKKLSRPNYWGYDPMAFFAPHRGYAHDSAPGAQVNEFKQMVKALHSAGIEVILDVVFNHTCEGNEQGPTLSFKGLENQVYYILSEGQHYCNYSGCGNTINGNHPVVREMIFHCLRHWVHNYHIDGFRFDLASILSRDRSGNLIPNPPMVELIAEDPMLADTKIIAEAWDAAGAYQVGSFGNHRWAEWNGRYRDDVRGFWRGDAGTLGPLATRLAGSSDLYQHAGRPPSCSVNLVTTHDGFTMNDLVSYKDKHNEANGEDNNDGDNHNISDNYGVEGPTRKKAISTIRSQQVRNMLATLLTSQGVPMIVSGDEARRTQKGNNNAYCQDTDISWFDWRLVEKNADLVRFVSALIDFRKNQPTIRRREYLTGQPVDGRKVPDVSWYGPSGDPLNWDQGELAMAAYIAAPSRIDDPEGLGRDVILMFNSTGDHREFHFPAIARGTQWNLFVDTAAAPPEDIYPDVDGPMPPNNRIVEVGRHSMRIYVCNAPPK

SEQ ID NO: 8182 - protein, 521 aa, Bordetella pertussis
MPTPLPSSSAWLAFADAARHSSRRGARLRVIEAAGLRVDLTAQAHSDDLDSAAEDLLAQQDFDNARAQLFDGGPANWTEHRPAWHTALRAARPPTPVAGAILGERDRLRRFVQDADMRGAYRHVLHLGIGGSDWGPRMVTRALRHNGLKREVRFASNVDSHAVADALHHLDPHDTLIIVASKSFTTTEPLANAEVAMNWLRNAGVADPVRQVVAITANVDAALDFGISPQHIFRFWDWVGGRYSLWSAIGLPVALALGCDALDELLAGAAAMDQHFLHTPMRRNAPLQMALAGVANRSVLGYGSLAITPYDSRLTHLVPWAQQLEMESLGKVAGHDGSPAGVPTGPVVWGMTGTDCQHTFFQWLHQDTAGAPVDFIVCEQADHPYDHFHKLLIANCLAQRAALLRGKPFDEALKEARLVESDPQQAEILAHHRVHPGGRPSTLIMLPRLSAHALGALLAMYEHKVFAQGVLWGINPFDQWGVEYGKALARNIIRELENPSSEVNQQDPSTRYWIDALRKQP

SEQ ID NO: 8183 - protein, 198 aa, Bradyrhizobium japonicum
PTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8184 - protein, 433 aa, Solibacter usitatus
MALVVIGGTAAGMSAAARARRIDPRLEIIVLEKGPVISLGACGLPYFVEGKIREAKDLTVFTPERFRKERNVDVRTGARVISIAHPRREVLLESGARVAYEKLVIATGARSESLGIAGDTQEHVFHMQTLEDAQRMRGFVRERKPKRAVVVGAGYIGVEAADALRRNGLQVTILEFSPYALLRADDAFTAEVRKQLERHRVELKTGVRVTAIEPDSIAGVPCDMVVIAAGFRPAATLAADAGVELGRSGAIRTDDRMETNVRGIFAAGDCAEVQHLVSGRPTWIPLGTTANKCGRVAGANAAGARERFPGIVGTSIVGIFGMGFATTGFSAAEARAEGFTPVTARIEALSRPRYYQGVKTIVELVADKATRRLLGGSIIGEDGTAGRINVLATALTARLRVDDFEQLDLAYSPPFAPVWDPVLIAAQQLIKEL

SEQ ID NO: 8185 - protein, 253 aa, Silicibacter pomeroyi
MDLFDLKGRRALVTGSSMGIGYALARGLAQAGASVVLNARDGARLAGAAEQLRGQGIEVETLVFDVTDADAVRKAVDGFEAEIGQIDILVNNAGMQHRTPLEEFPVEAFDRLMRTNVNSAFYVGQAVARHMIGRGAGKIVNIASVQSALARPGIAPYTASKGAVSNLTKGMATDWARHGLNCNAIAPGYFDTPLNAALVADPEFSAWLEKRTPAGRWGEVEELVGACIFLCSDAASFVNGHVLFVDGGITASL

SEQ ID NO: 8186 - protein, 379 aa, Erwinia carotovora
MMKDIVIIGAGFAARQLIRQLRKLDAHCPIRLITADSGDEYNKPDLSHVMSLQQHADDLTKMQATAFAEENRIALQANTRVTAIDRNAQQVVCGTDRYDYHKLVFATGASAIVPPIPGREHMLTLNSQQEYRTHEARLWQAERVLVLGAGLIGTELAMDLSRAGKRVTLVDCASSILPALMPPEVSARLQFTLTQQGVSLLLNTTVQQLEKTETGVQARFTDGRTVEVDEIISAVGLQANTQLAKAADLAVQKGIQTNAQLQTPDPQIYALGDCAEIGGKLLPFLQPIQLSAITLAKNLLGASEALTLPPMLVKIKTPLFPLQMAGDTTGSDLHWQQEWNEQGMVAKALDSQQRLRAFVVGGERMKEAFPLLRQLSATI

SEQ ID NO: 8187 - protein, 509 aa, Erwinia carotovora
MTIHVKNNIHWVGQRDWEVRDFHGTEYKTLQGSSYNSYLIREEKTVLIDTVDHKFSREFVQNLMAEVDLNTIDYIVINHAEEDHAGALSELMARIPNTPIYCTYNAIDSITGHHHHPEWNFHTVKTGDTLDIGNGKQLIFIETPMLHWPDSMMTYMTEDAVLFSNDAFGQHYCDEHLFNDEVDQTELFEQCQRYFANILTPFSRLVTAKIHEVLGFNLPLSMVATSHGVVWRDDPAQIIHLYLKWADSYQEDRITLFYDTMSNNTRMMADAIAQGINDVDPGVAVKIYNVARHDKNEILTQVFRSKGVLVGSSTMNNVMMPKVAAMLEEITGLRFQNKKASAFGSYGWNGGAVDRVQTRLMDAGFETTLALKTKWRPDGSALEVCREHGREIARQWALHPLDNTPARRVISPVKPAATAPQVTTAAQPMSASAESACGCNEVAAPQSATQPTVQSESGCMQCSVCQWIYDPALGEPMQDVTPGTMWSDVPDSFLCPECGLGKDVFNPIR

SEQ ID NO: 8188 - protein, 641 aa, Bordetella pertussis
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGIEQTLQAAVGMFAIVLWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 8189 - protein, 224 aa, Oryza sativa
  misc_feature (31)..(31): Xaa can be any naturally occurring amino acid
MGTPETSREPCPDRILDDVGGAFGMGAVGGXSLFHFLKGTYNSPNGERLVGGAQAVRMNAPRVGGSFAVWGGLFSAFDCTMVFMRQKEDPWNSIIAGAATGGFLSMRQGPGAAGRSALMGGMLLALIEGAGLMLNRVLATPPPLPVDDPNLPAVMGGGGGIPGIPQVPVAPPEVASSSGGGSGWFGSLFGKKEEEKKASPSGGKSEMLESFDTPSTPIPTFEYK

SEQ ID NO: 8190 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 8191 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDSIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDALKAHPPKHVTEKMMLNAGNIYPHNTPKTKEAYYYRMIFERFFPQNSARLTVPGGASAACSTAKAVEWDAAWSNNLDPSGRAALGVHISAYENQNNKGVEIEKIIPMDAAPLGVAIQG

SEQ ID NO: 8192 - protein, 268 aa, Gluconobacter oxydans
MKPPRSRSGSSKDTGPKRIPGKALKSASNPGENDATLDSATARTARNKTVSLRTARGRTTAQQRWLNRQLNDPYVAAARKQGWRSRAAFKLIEIDDRFKLIGEGTRIIDLGAAPGGWTQVAVKRGAKHVVGLDLLPVDPVAGAEIIEGDFTDPEMPDRLKDMLGGPADLVMSDMAPNTTGHAATDHMRIMGLAEGALDFAFQVLAEGGSFIAKVFQGGSEKDMLALMKTAFSSVKHVKPPASRKESSELYVIATGFRPERLLESSKGA

SEQ ID NO: 8193 - protein, 122 aa, Zea mays
  misc_feature (74)..(75): Xaa can be any naturally occurring amino acid
  misc_feature (77)..(77): Xaa can be any naturally occurring amino acid
  misc_feature (79)..(80): Xaa can be any naturally occurring amino acid
  misc_feature (96)..(96): Xaa can be any naturally occurring amino acid
  misc_feature (111)..(111): Xaa can be any naturally occurring amino acid
MAYSMLSSAAVVTSPAQATMVAPFTGLKSSSAFPVTRKANNDITSIVSNGGRVSCMKVWPPVWKKKFETLSYLXXLXEXXLGKEVDYLSPEQVNPXLNSELKHGFVYRKHXGSPPGNNQGRY

SEQ ID NO: 8194 - protein, 986 aa, Zea mays
  misc_feature (510)..(510): Xaa can be any naturally occurring amino acid
  misc_feature (532)..(532): Xaa can be any naturally occurring amino acid
MAARSSAAAVAVLLLAAAGAAAAAGGAEGDGDGQALMAVKAGFRNAANALADWDGGRDHCAWRGVACDAASFAVVGLNLSNLNLGGEISPAIGQLKSLQFVDLKLNKLTGQIPDEIGDCVSLKYLDLSGNLLYGDIPFSISKLKQLEDLILKNNQLTGPIPSTLSQIPNLKTLDLAQNKLTGDIPRLIYWNEVLQYLGLRGNSLTGTLSPDMCQLTGLWYFDIRGNNLTGTIPEGIGNCTSFEILDISYNQISGEIPYNIGYLQVATLSLQGNRLIGKIPEVIGLMQALAVLDLSENELVGPIPPILGNLSYTGKLYLHGNKLTGHIPPELGNMSKLSYLQLNDNELVGTIPAELGKLTELFELNLANNNLEGHIPANISSCSALNKFNVYGNRLNGSIPAGFQKLESLTYLNLSSNSFKGQIPSELGHIVNLDTLNLSKNHLTGSVPAEFGNLRSVQVIDMSSNNLSGYLPEELGQLQNLDSLILNNNSLAGEIPAQLANCFSLVSLNXVIQQLLWARPVIEKLLKVPNGXFMGNLMLHVYCQDSSCGHSHGTKGFVILLCIVLLAIYKTNQPQLPEKASDKPVQVSQEDSSITFLDHIAGPPKLVVLQMDMAVHTYEDIMRLTENLSEKYIIGYGASSTVYRCDLKSGKAIAVKRLYSQYNHSLREFETELETIGSIRHRNLVSLHGFSLSPHGNLLFYDYMENGSLWDLLHGEAGFLSSLSFFFLNSCRFVLPITHGPRPFPGPSKKVKLDWDTRLRIAVGAAQGLAYLHHDCNPRIVHRDVKSSNILLDGSFEAHLSDFGIAKCVPAAKSHASTYVLGTIGYIDPEYARTSRLNEKSDVYSFGVVLLELLTGRKAVDNESNLHQLILSKADDDTVMEAVDPEVSVTCTDMNLVRKAFQLALLCTKRHPADRPTMHEVARVLLSLLPPAAKPPASKAAAASAAAGDYTRFLATAADLRRGGVADDDTGDNSSSDEQWFVRFGE

SEQ ID NO: 8195 - protein, 311 aa, Desulfotalea psychrophila
MEQTTHYELVILGGGPAGLSAGLYAARARLNHVLIERGAHGGQVLLTDWIDNYPGFPDGISGFDLIEKMSAQAKRFDLNSLMAEVLSVNLDDPKKKSLKLDNGQTITFDTLVICTGARANSLKVPGEEEMRGKGVSYCGTCDAPFYRNMEVAVVGGGNTAIQEAEYLTKFASKVTVIHRREELRATKVLQESALANEKLEFIWNSQVTAIEGENGVERIQLIDKDGNKSTLNAHGIFIFVGITPLNSCLPLEKLQADKWGFIPVDIETRTSVPGVMAAGDIISKDVRQVINAAGEGAVAVLAAEEYLNNLK

SEQ ID NO: 8196 - protein, 198 aa, Bradyrhizobium liaoningense
PTPNLRGKTQIKEFASFPTLEQLPLWGFDGSSTQQAEGHSSDCVLKPVAVFPDAARTNGVLVMCEVMMPDGKTPHPSNKRATILDDAGAWFGFEQEYFFYKDGRPLGFPASGYPAPQGPYYTGVGYSNVGDVARKIVEEHLDLCLAAGINHEGINAEVAKGQWEFQIFGKGSKKAADEMWMARYLMLRLTEKYGIDIE

SEQ ID NO: 8197 - protein, 257 aa, Carboxydothermus hydrogenoformans
MTRFAMNGKVYLVGAGPGDPELITVKGIKLLKEAQVVVYDRLISPELLKYVNPSAELYYAGKAPGRHSLNQEEINELLIQKAREGKMVVRLKGGDPFVFGRGGEEALALTRAGIPFEVVPGVTSAVAVPAYAGIPVTHRRIASTFTVVTGNETENKEEREVDWEKIARVGGTIVILMGLSNLPFIKGELLKYLPATTPVAVIYRGTTPSQKIVTGTLEDIVEKVLAAGIKHPAVIVVGDVVKLQGELGWYSPSALTE

SEQ ID NO: 8198 - protein, 528 aa, Citrus sinensis
MESTEAGAAAAAPTKNQSSIELRQPPPPPSSPMWKIVMVASIAAGVQFGWALQLSLLTPYVQLLGIPHKWSSLIWLCGPISGMIVQPIVGFHSDTCKSRFGRRRPFILAGAVLVAIAVFLIGYAADIGHSAGDSVTDSVKTRAIIIFVIGFWILDVANNTLQGPCRALADLSSGSSNKKTRTANSFFSFFMAVGNVLGYAAGSYTHLYHMLPFTKSKACDVYCANLKTCFFLSIALLITLTTIALFYVTEQRLEEIDDKETAPSTKDPFFSEIFGALKGLQKPMWILLAVTALNWIAWFPFLLFDTDWMGREVYGGNSKGSAEELRVYNNGVRAGSLGLMLNAIVLGFTSLGVEVLAKLIGGVKRLWGVVNFLLAVSLAFTFLITKLAESNRRSVTTAGGATHILPPPVGVKVGALAIFTVLGIPQAITFSVPFAMASIFSRTSAAGQGLSLGVLNLAIVVPQMLVSLLSGPFDAVCGGGNMPAFMVGAVAAALSGIVALTLLPSTTADVPPPITEAGTATANQTNKL

SEQ ID NO: 8199 - protein, 277 aa, Mycobacterium leprae
MAVVTMKQLLDSGTHFGHQTRRWNPKMKRFIFTDRNGIYIIDLQQTLTFIDKAYEFVKETVARGGLVLFVGTKKQAQESVAAEATRVGMPYVNQRWLGGMLTNFSTVHKRLQRLKELEAMEQTGGFEGRTKKEILGLTREKNKLERSLGGIRDMAKVPSAIWVVDTNKEHIAVGEARKLGVPVIAILDTNCDPDEVDYPIPGNDDAIRSAELLTTVIASAVAEGLQVRAGLRCGDGKPETEAVEPLPEWEQELLAGAGSSALNDSGADLSEANPTEA

SEQ ID NO: 8200 - protein, 427 aa, Roseovarius nubinhibens
MSDSGFFTESLSQRDPELHDAITQELGRQRDEIELIASENIVSAAVMEAQGSVMTNKYAEGYPGRRYYGGCQYVDVAENLAIDRAKQLFGCEFANVQPNSGSQANQGVFQALLQPGDTILGMNLASGGHLTHGAAPNQSGKWFNAVQYGVRKQDNLIDYDEVEALAKEHQPKLIIAGGSAIPRVIDFAKMREIADSVGALLHVDMAHFAGLVAAGEHPSPFPHAHVATTTTHKTLRGPRGGMILTNDEAIAKKVNSAIFPGIQGGPLMHVIAAKAVAFGEALRPEFKQYMKQVRANADALADQLIKGGLDIVTGGTDTHVMLVDLRPKKVTGNITDAALGRAHITTNKNGIPFDPEKPTVTSGIRLGTPAGTTRGFKEAEFRQIADWIVEVVDGLAANGPDGNDEVEAKVRAEVAELCARFPLYPNH

SEQ ID NO: 8201 - protein, 205 aa, Oryza sativa
MSWLGKLGLGGLGGSPRASAASAALAQGPDEDRPAAGNEFAQFGAGCFWGVELAFQRVPGVTRTEVGYSQGNLHDPTYEDVCTGATYHNEVVRVHYDVSACKFDDLLDVFWARHDPTTPNRQGNDVGTQYRSGIYYYTPEQEKAARESLEKQQKLLNRTIVTEILPAKRFYRAEEYHQQYLAKGGRFGFRQSAEKGCNDPIRCYG

SEQ ID NO: 8202 - protein, 360 aa, Arabidopsis thaliana
MPIMAGTASPWRREAVFLTAMLVVETSVVGISTLFKFATSKGLNIYPFLGYSYLLASLLLLPSLFFTNRSSSLPPLSVSILSKIGLLGFLGSMYVITGYIGIEYSSPTLASAINNITPALTFILAIIFRMEKVSFKERSSLAKLMGTILSLIGALVVIFYHGPRVFLASSPPYVNFRQFSPPLSSSNSDWLIGGALLTMQGIFVSVSFILQAHIMSVYPAAFRVSFLYTVCVSIVTSTIGLVVEKNNPSVWIIHFDITLITIVTMAIVTSVYYVIHSWTVRHKGPLYLAIFKPLSILIAVVMGAIFLNDSLYLGCLIGGILITLGFYAVMWGKANEEKDQLSFSEKEKTPLLLNRKNDQV

SEQ ID NO: 8203 - protein, 413 aa, Bacillus anthracis
MDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDAESHCINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEDMDEIASLIAYTLKNHENEAALEEARKRVEALTSKFPMYTDL

SEQ ID NO: 8204 - protein, 132 aa, Brassica napus
  misc_feature (121)..(121): Xaa can be any naturally occurring amino acid
  misc_feature (123)..(123): Xaa can be any naturally occurring amino acid
RFGAIVRECKGLRRLSISGLLTDKVFMYIGKFAKQLEMLSIAFAGDSDAGMMHVMEGCNNLRKLEIRDSPFGDAALLENVTKYDTMRSLWMSSCNVTEKGCQILASKMPMLNVEVINEVDXSXEMDENHGIP

SEQ ID NO: 8205 - protein, 112 aa, Oceanicola granulosus
MKKIEAIIKPFKLDEVKEALQEAGVQGLSVVEVKGFGRQKGHTELYRGAEYVVDFLPKVKIEVVLSDDLAEAAINAIIAAAKTDKIGDGKIFVSDISQAIRIRTGETGEDAL

SEQ ID NO: 8206 - protein, 522 aa, Vibrio vulnificus
MLDQAIKQQLTQYLTNLKQDVRLVVSLDDSKGSQDILALANEIAELSPLITVVRDDAASTRKPVMTVTNPEKSTALRFAGLPMGHEFTSLVLALLHSGGHPIKLDAETIEQIAQLDKELDVEVFISLSCQNCPDVVQAFNMMAAINPKIRATMIDGALFQDEVKQRDILAVPSVFVNGELFGQGRMSLTEILNKLDDGAAEKAAASLNDKDPYDVLVVGGGPAGAAAAIYAARKGIRTGIVAQRLGGQVMDTMAIENFISVKHTEGPKLAANLGEHLKEYGVDIITEQQAEKLMGAQYTEDGKIHVNLQSGATLKSNSVILSPGARWREMNVPGEQEYRNKGVAYCPHCDGPLFKGKKTAVIGGGNSGIEAAIDLAGIVEHVTVLEFADTLRADQVLINKANSLPNVDIITMAQTTEVVGDGKRVTGLKYKDRNTDEIKQLDLAGIFVQIGLVPNTEWLKDSDVELSARGEIEIGSRGETSLEGVFAAGDATTVPYKQIIIAMGEGAKASLGAFDYLIRKQG

SEQ ID NO: 8207 - protein, 378 aa, Novosphingobium aromaticivorans
MSAEIDFYELLEVERTADDKVLKSAYRKLAMKYHPDKNPGCADSEARFKQINEAYACLSDPQKRAAYDRYGHAAFQQGAGGGAGGGGFGGGDFGDIGDIFETIFGGAFGGGGRQQPRRGADLRYDMEISLEDAFHGKDAEIEVEVSQKCDPCGGSGATPGTSARRCNLCGGHGKVRAQQGFFMVERPCPNCHGRGEVIEKPCKHCRGEGRVDAEQRLQVTIPAGVDNGTRIRLAGKGEAGPFGAPPGDLYIFLHIQRHRVFEREGTTLLTRCPISFTTAALGGEIEIPGLDGKVHAIEIPAGIQSGKQLRKRGAGMPVLQGRGIGDLVVEIHVETPTKLSARQKELLREFQATETGEECPQSKGFFERIKDAWTDLTE

SEQ ID NO: 8208 - protein, 634 aa, Carica papaya
MESCDCIDTPCPGEELLVKYQYISDVLIALAYFSIPLELIYFVQKSAFFPYRWVLMQFGAFIVLCGATHFINLWTFSMHSKAVAVVMTIAKVACAAVSCVTALMLVHIIPDLLSVKTRELFLKNKAEELDREMGLILTQEETGRHVRMLTHEIRSTIDRHTILKTTLVELGRTLGLEECALWMPSRSGLNMQLSHTLNYHIQVGSTLPTNLPIVNEVFNNARAMRIPYTCPLARIRPLVGRYVPPEVVAVRVPLLHLSNFQINDWPDHSAKSYAIMVLILPTDSARKWRDHELELVEVVADQVAVALSHAAILEESMRARDQLMEQNVALNLARQEAEMAIHARNDFLAVMNHEMRTPMHAIIALSSLLLETELTPEQRVMIETVLKSSNLLATLINDVLDLSRLEDGSLKLDSETFNLQGIFREVINLIKPITSVKKLSMTLIMAPDLPACAVGDEKRLMQAILNVVGNAVKFTKEGYVTIVASVAKPDASRDWPECYPVSSEGHFHLCVQVKDSGCGIHPQDIPHLFTKFAQPRSGSSRKNGSAGLGLAICKRFVNLMGGHIWIESEGADKGCTATFIVKLGICNSPTDPSERKVGTKGQTTHGSGDLTRHKPLYRDNNGSTSSNPRYQRSF

SEQ ID NO: 8209 - protein, 555 aa, Prochlorococcus marinus
MSEKMSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 8210 - protein, 679 aa, Solanum lycopersicum
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEVHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 8211 - protein, 244 aa, Ficus carica
LGAAGDMTTDRHAYKIDPSNPGSDLAGETAAAMAAASIVFRRSNPAYSAVVLRHAHQLFDFADKYRGKYDSSITVAQKYYRSISGYNDELLWAAAWLYYATDNQYYLNYLANNAESMGGTGWSMTEFGWDVKYAGVQTLVSKFLMQGKAGHYASVFESYQEKAESFMCSCIGKGTKNVQKTPGGLIFRQRWNNLQFVTSASFLATVYSDYLASSGKYSQVRLWYRPIIGASLLRKIPSRINLGK

SEQ ID NO: 8212 - protein, 197 aa, Ricinus communis
HEATAKLGLLTPLHSNNIKKEFPVFDFSLFCPELRHSRFSHFNTAVKRVRYAPVVPVINAQSSPDYIPDAKFYKVEAILRPWRVSQVSSALLKIGIRGVTVSDVRGFGAQGGSTERQGGSEFSEDKFVAKVKMEIVVSKDQVEDVIEKIIEEARTGEIGDGKIFLLPVSDVIRVRTGERGDKAERMTGGRSDMSTSA

SEQ ID NO: 8213 - protein, 172 aa, Mesorhizobium loti
MATSTERAVLAGGCFWGMQDLIRRYPGVISTRVGYSGGDVANATYRNHGTHAEAIEINFDPAVISYRTLLERFFQIHDPTTRNRQGNDVGMSYRSAIYYTSDEQKRVAEDTIADVDASGLWPGKVVTEVAPAGAFWEAEPEHQDYLEKYPNGYTCHFVRPGWKLPVREKAVS

SEQ ID NO: 8214 - protein, 198 aa, Bradyrhizobium japonicum
PTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 8215 - protein, 370 aa, Pisum sativum
MASFFARTRRFSLVSLFLLELFTINLIPTTDAQIGICYGMMGNNLPPANEVIALYKANNIKRMRLYDPNQPALNALRDSGIELILGIPNSDLQTLATNQDSARQWVQRNVLNFYPSVKIKYIAVGNEVSPVGGSSWLAQYVLPATQNVYQAIRAQGLHDQIKVTTAIDMTLIGNSFPPSKGSFRSDVRSYLDPFIGYLVYAGAPLLVNVYPYFSHIGNPRDISLPYALFTSPGVMVQDGPNGYQNLFDAMLDSVHAALDNTGIGWVNVVVSESGWPSDGGSATSYDNARIYLDNLIRHVGKGTPRRPWATEAYLFAMFDENQKSPELEKHFGVFYPNKQKKYPFGFGGERRDGEIVEGDFNGTVSLKSDM

SEQ ID NO: 8216 - protein, 461 aa, Escherichia coli
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLVVTAIYKVFGLNRHGKAHKLEE

SEQ ID NO: 8217 - protein, 115 aa, Unknown
  uncultured crenarchaeote
MKRIEAIIASEKISELNAALKQMGVGGCTILDAKGRGKGEKPMVEAQRGTARFAAEFSVRANVVTVVEDSQLEKVIKTILDTISTGSAGDGKIFVSTVIDAIDIGTKARGEEAIG

SEQ ID NO: 8218 - protein, 198 aa, Unknown
  Bradyrhizobium genosp. beta
PTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPSSGYPAPQGPYYTGVGYSNVGDVARKIVEEHLDLCLAAGINHEGINAEVAKGQWEFQIFGKGSKTAADQMWMARYLMLRLTEKYGIDIE

SEQ ID NO: 8219 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 8220 - protein, 206 aa, Zea mays
SRSKSSGSFRIGEVKRVTKETNVHVKINLDGTGVAECSTGIPFLDHMLDQLASHGLFDVYVKATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 8221 - protein, 135 aa, Haemophilus ducreyi
MRILHTMLRVGNLERSIKFYTEVLGMRLLRTSENEQYKYSLAFLGYADESENAVLELTYNWGVDHYDLGNAFGHIALGIDNIYTTVEAVRLAGGKITREPGPVLGGKTVIAFAEDPDGYKIEFIENKNAQVALGN

SEQ ID NO: 8222 - protein, 139 aa, Colwellia psychrerythraea
MKFLHTMVRVRDLDQSLDFYINKLGLIETKRIEVPAGKFTLVYLATEIGGPEVELTYNWGSTEDYTAGRSFGHLAFEVDNIYQTCQTLQDGGITINRPPRCGHMAFVNSPDGISIELLQKDGSLEPQEPWLSMENSGSW

SEQ ID NO: 8223 - protein, 548 aa, Pseudomonas fluorescens
MQDWQHSVIYQIYPKSFHSHAGNATGDLLGIVDKLDYLQWLGVDCLWITPFLRSPQRDNGYDISDYYAIDPSYGTMADCDLLIGEAAKRGIKLMLDIVVNHTSIEHEWFQQARSSLDNPYRDFYIWRDQPNNWESKFGGSAWEYEAQTGQYFLHLFDHTQADLNWDNPKVRAEVYKLMCFWRDKGVGGFRLDVINLISKPADFPEDNSDGRRFYTDGPHVHEYLQEMHREVFEGHDLINVGEMSSTSLEHCIRYSRPESKELSMTFNFHHLKVDYPNLQKWVRADFDFLQLKQILSDWQLGMQAGGGWNALFWCNHDQPRVVSRFGDDGEYRVVSAKMLATALHFLQGTPFVYQGEELGMTNPGFDQIGQYRDVETLNIYRLKRDAGESQASSMAAIMQKSRDNGRTPMQWNGQANAGFSSGEPWIGIPANAAQINVQSQLDDPDSVLHHYRALIALRRLEPLIQQGVYRQLLCDHAKVWAYLREGHGERLLVLNNFYGQPCEIQLPGQVISAASAQRLLISNYPDCPVRTDSITLRPYESFVLHLTD

SEQ ID NO: 8224 - protein, 401 aa, Unknown
  Mycobacterium sp. MCS
MYNDHVSTSGGIVIVGGGLAAARTAEQLRRSNYSGPVTIVSDEDHLPYDRPPLSKEVLRSETDDVTLKPAEFYQENDITVLLGAGAASVDTVGKKVTLTDGREIGYEELVIATGLVPKRIPSFPDLTGIHVLRNFDESLKLREEAGSARSAVVIGAGFIGCEVAASLRKLGVDVVLVEPQPAPLASVLGTQIGELVARLHRAEGVDVRCGVGVAEVKGQDVDGQEKVQSVVLSDGAEVDADLVVVGIGSRPSTDWLEDSGITLDNGVVCDAEGRSSAPHVWAIGDVASWLDTIGNQVRVEHWSNVADQARVLVPAMLGQDVPGVVSVPYFWSDQYDVKIQCLGEPEADDTVHIVEDDGRKFLAYYERDGVVAGVVGGGMPGKVMKTRNKIANGAPIADVLG

SEQ ID NO: 8225 - protein, 198 aa, Bradyrhizobium yuanmingense
PTPNLRGKTQIKEFASFPTLEQLPLWGFDGSSTQQAEGHSSDCVLKPVAVFPDGARTNGVLVMCEVMMPDGKTPHPSNKRATILDDSGAWFGFEQEYFFYKDGRPLGFPTAGYPAPQGPYYTGVGYSNVGDVARKIVEEHLDLCLAAGINHEGINAEVAKGQWEFQIFGKGSKTAADQMWMARYLMLRLTEKYGIDIE

SEQ ID NO: 8226 - protein, 788 aa, Arabidopsis thaliana
MGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDNSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 8227 - protein, 459 aa, Cryptococcus neoformans
MTGGAFFAPAADNDEEYDMGPVGEAHAVQWIGTAGVKGPKWARLPLLTVGMLGIQCVWSIEMGYASPYLLELGLSKSFMSLVFMAGPLSGLIVQPLVGIFADRSRSPLGRRRPFMLAGCLICVSAMMLLGWSREVAAIFGGGQWLAITLAVWAIYCIDFSINAVMSTDRALVVDTLPPREQEEGSAWAGRMFGFGSVAGFFVGNLDLAPVLPFLGKTQLQILSFLTSAVLMVTHSFTSWAVSERVLLRDDRPQSKSSLKSNLKSIWENMFSLPPGIRTVCIVQFFASLGWFPILFFTTVWVSEIYKSSVPSDGIDPATFDSRAVRSGARALLLQALVNIITSIGMPFLVAESGVQPSESVDGYEAIEGSSSRRVGLETANGDGRSPQASVATPPNSALWKRAREDLENGTVFRRFLHSVQSMVNNVKKGELGIPIKGLTLVKVWWISQFVFAAAMAGSW

SEQ ID NO: 8228 - protein, 72 aa, Unknown
  Oceanobacter sp. RED65
MSREDHIEMDGEVIDTLPNTMFRVKLENGHVVTAHISGKMRKNYIRILTGDKVKVELTPYDLSKGRITYRAR

SEQ ID NO: 8229 - protein, 312 aa, Streptococcus pneumoniae
MAEIYLAGGCFWGLEEYFSRISGVLETSVGYANGQVETTNYQLLKETDHAETVQVIYDEKEVSLREILLYYFRVIDPLSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 8230 - protein, 476 aa, Silicibacter pomeroyi
MAPKNEPSFRQSVDMMFNRAVALMDLPPGLEEKIRVCNATYTVRFGVRLRGQIQTFVGYRSVHSEHMEPVKGGIRYAMSVNQDEVEALAALMTYKCALVEAPFGGSKGGLCIDPRQYEEHELEQITRRFAYELAKRDLINPSQNVPAPDMGTGEREMAWIADQYARMNTTDINARACVTGKPLNAGGIHGRVEATGRGVQYALQEFFRDRVGVGKSGLDGKLDGKRVIVQGLGNVGYHAAKFLSEEDGCVITGIIERDGALVSDEGLDVEAVHNWIVKHGGVTGFPDGTFVAEGAKVLEEPCDILIPAAMEGVINLANADRIKAPLIIEAANGPVTAGADEILRKKGCVIIPDMYANAGGVTVSYFEWVKNLSHIRFGRMQRRQEEARHQLVIDELERLDRYLGDAWSMTPQFKEKYLRGADELELVRSGLDDTMRIAYQAMRDVWHERGDVEDLRTAAYLVSIDRVAKSYRAKGL

SEQ ID NO: 8231 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLRHPNVVLFMGAVTRPPNLSIISEFLPRGSLYRILHRPNCQIDEKQRIKMALDVARGMNCLHASTPTIVHRDLKSPNLLVDNNWNVKECDFGLSRLKHNTFLSSKSTAGTPEWMAPEVLRNEPSNEKCDVYSFGVILWELATLRLPWSGMNPMQVVGAVGFQNRRLEIPKELDPLVARIIWECWQQDPNLRPSFAQLTVAFKPLQGLVIPSHQDQVASPLPQEISVNSTP

SEQ ID NO: 8232 - protein, 239 aa, Yarrowia lipolytica
MENTEGYIEEREGDLEYDRMMEYEQGQEGDHEHDPHGEHGGAADNGLDQMTGTFNNVAQGLSGHYRSIMLAYWQEIISSIEHDEHEFKVHQLPLARIKKVMKADEDVKMISAEAPILFAKGCDIFITELSMRAWIHAEEHKRRTLQRSDIASALQRSDMFDFLIDIVPREEATLPPGARSRQTQSAAAAAAAAAAMYMGDEEEEYLQESLEEGHQMEGGVPGVIPTHPLQEQMGMFQQE

SEQ ID NO: 8233 - protein, 168 aa, Zea mays
MGKSGKKTKESHRQGRGRRGSQLGDDDLPSSAYDAPPRRQEDSDGDDSDEATAEGEHDGGAEEGDLQGQWQVGSMPSKFHLYQLSVQSPKGDISYLQKFFLMYVGGRVPLHLQEDFCGTALLSTEWLRTDTRRTAVGLDFDRESLEWCLENNLSKIGADGYSRLLLFN

SEQ ID NO: 8234 - protein, 827 aa, Burkholderia xenovorans
MTLSRRAFIKQTAAATAASAAGVVLPGVDALAASDSLTWSKAPCRFCGTGCGVSVGVKNGKVVATQGDPQAEVNRGLNCVKGYFLSKIMYGQDRLTTPLLRMKDGKYAKDGEFAPVSWDQAFDVMADHFKRTLKEKGPTAVGMFGSGQWTVWEGYAAVKLMKAGFRSNNLDPNARHCMASAVTGFMRTFGMDEPMGCYDDIEQADTFVLWGSNMSEMHPILWTRITDRRLSTPTTRVVVLSTFEHRSFDLADQTIIFTPQSDLAILNYIANYIIRNGNVNRDFVNRHTVFKQGNADIGYGLRPDNPLQKTARNAGDPNGSQPITFDEFAKFVSKYDAAYVTKLSGVPQNKLDQLARLYADPKVKVMSFWTMGFNQHTRGTWANNMVYNLHLLTGKIATPGNSPFSLTGQPSACGTAREVGTFSHRLPADMVVTNPKHREEAEHIWKLPAGTIPDKPGYHAVLQNRMLRDGKLNAYWVQVNNNVQAAANINGEALPGYRNPQAFVVVSDVYPTVTAVAADLILPSAMWVEKEGAYGNAERRTQFWHQLVDAPAGARSDLWQLVEFSKRFKVEEVWPADLLAKKPEYRGKTLYDVLYRNGQVDRFALTETDSHYRNDEAKAFGFYIQKGLFEEYASFGRGHGHDLAPFDAYHKARGLRWPVVNGKETRWRYKEGSDPYVKTGTGWQFYGNPDGRAVIYALPYEPPPEVPDKEYPFWLATGRVLEHWHSGSMTRRVPELYRAFPNAVCFMHPDDAKAMGVRRGVEVKVMSRRGYILTRVETRGRDKPPRGLVFVPWFDSSQLINKVTLDATDPISLQTDYKKCAVKIVKV

SEQ ID NO: 8235 - protein, 521 aa, Hyphomonas neptunium
MNSTGRPTAPTSVSAAAIETISGSRGLLQHEDLLFEIGTPETTGVDLPKPKGLKSRLGGVARKVDTGLAGLSEPQAVRHYMRLSQKNYAIDLGLFPLGSCTMKHNPRLNEKMARLPGFGDIHPLQPQATVQGALQLIDELATWLKTLTNMPSVAMSPKAGAHGELCGLLAIRQALIARGEGDVRKRMLVPESAHGTNPATAAQCGFTVDEIKANKRGRVDMADLKAKLEKSEDVAGIMLTNPNTCGLFETDIREIADLIHKAGGYFYCDGANFNAIVGRVRPGDLGVDAMHINLHKTFSTPHGGGGPGSGPTVFSDALAPYVPVPFVTKDDDGIYRLVEQVDGEASESFGRMVAFHGQMGMFVRALAYILSHGADGLKQAAEDAVLNANYIQARLKHVMSPAFDGYCMHEALFSDAFTADGIETIDIAKALIDEGYHPMTMYFPLVVHGAMLIEPTETESKAELDRFCDALESIARRAAQGDDTLKGAPYLAPMRRLDETRAARKPVLKWTAEDTSKVAAE

SEQ ID NO: 8236 - protein, 203 aa, Unknown
  Synechococcus sp. WH 7805
MSMRSGEIHRVTGETDVQVRLNLDGSGQCQASTGVPFLDHMLHQISSHGLIDLVISAQGDTHIDDHHTNEDVGIAVGQALAQALGDRRGIHRFGHFLAPLDEALVQVALDCSGRPHLSYSLSIPSQKIGTYDTELVKEFFVAVVNNSGLTLHIRQLDGANSHHIVEACFKAFARALRQATEIDPRRANAVPSSKGVLEQAGLN

SEQ ID NO: 8237 - protein, 304 aa, Schizosaccharomyces pombe
MGRAEAGTPKAISNALKSKGLQRLRWYCSACQKQMRDENGFKCHTQSEGHIRQMNVIAMNPGKRIQDFSNQFLRDFISLLRTAHGEKKIHFNQFYQEYIRDKNHVHMNATRWHTLSEFCKFLGRQGMCRVEENEKGFFISYIDKNPANILRNEANKKRERQEKSDEEQRLRLLDEQIKRAYESAQNNEDNKDGSSREQPVLHEIDLSKKGNPIQLNLSSSSDSHSAQNEFFQTRNTPTFSFSSSSSQTSLKHKPKNVFAELNKSRKKNNKDSLDQGQNVKRPRSAVEDIIAQETMREKRRNIKL

SEQ ID NO: 8238 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 8239 - protein, 73 aa, Ralstonia eutropha
MAKEELVEFGGRVSEVLPDSRFRVTLENGFEVWAYSSGRLKKNRIRILAGDRVTLEMSPYDLTKGRINYRHKV

SEQ ID NO: 8240 - protein, 604 aa, Escherichia coli
MLRPVETPTREIKKLDGLWAFSLDRENCGIEQRWWESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQRGTSGTLQVVNPHLWQPGEGYLYELYVTAKSRTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 8241 - protein, 486 aa, Oryza sativa
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 8242 - protein, 143 aa, Medicago truncatula
MSKFAGKDTFHLRVRVHPFHVLRINKMLSCAGADRLQTGMRGAFGKPLGTCARVSIGQVLLSVRCKSGNGDHAQEALRRAKFKFPGRQKIIVSRKWGFTKLSHAEYLKLKSENRIVPDGVNAKVLGCHGPLANRQPGRAFLPA

SEQ ID NO: 8243 - protein, 153 aa, Oryza sativa
MAPKAEKKPAAKKPAEEEPAAEKAEKAPAGKKPKAEKRLPAGKAEKGSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 8244 - protein, 1568 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSTVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGDGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 8245 - protein, 783 aa, Xanthobacter autotrophicus
MGPAAGPRTKDRSWQDRRTQPSEPPLEGAASRGASGRLAHGLPASRLNQERTLMFDIHREELDWGGRTLTLETGKMARQADGSVLATYGDTKVLATVVSAREPKPGQDFFPLTVNYQEKTYAAGRIPGGYFKREGRPSEKETLVSRLIDRPIRPLFPEGYKCDTQVVITVLAHDLENDPDVVAMVAASAALTLSGVPFMGPVGAARVGFIDNEYVLNPTVDEVKESALELVVAGTGDAVLMVESEAKELPEEIMLGAVMFGHRHFQPVIEAIIKLAEKAAKEPRNFQPADVSEVESKVREIAEADLRAAYKIKQKQDRYAAVGAAKSKVKKYYEELALDGTKVPTAQVVSDVLKALEAKIVRWNILDDGIRIDGRDVYTVRPIVSEVGILPRAHGSALFTRGETQALVVATLGTGEDEQFIDSLEGTYKEHFLLHYNFPPFSVGETGRMGSPGRREIGHGKLAWRAIHPMLPAKHEFPYTLRVVSEILESNGSSSMATVCGTSLALMDAGVPLRRPVAGIAMGLILEGEKFAVLSDILGDEDHLGDMDFKVAGTEQGVTSLQMDIKIAGITEEIMKVALTQAKDGRVHILGEMAKALTTARAELGEHAPRIEVMKIAVDKIREVIGSGGKVIREIVEKTGAKINIEDDGTIKIASASGDAIKAAINWIKSIASEPEVGQIYEGTVVKVVDFGAFVNFFGSKDGLVHVSQMANERVAKPSDVVKEGDKVKVKLMGFDERGKTRLSMKVVDQTTGEDLEAKAKAERDAARAAAPAATGDEAGAAE

SEQ ID NO: 8246 - protein, 441 aa, Carboxydothermus hydrogenoformans
MEEILEIIDLTEEGLGVGKKEKRVYFVSGDVTVGDVVKVKVTSEKRGVILGEALEILTNSPYRDVPRCPHFGYCGGCSLQNLDYEQQLVLKKTKVYNIMKKIGRIDAPINSVLPNFAFYRYRQKVHFTFGSSQNKLAIGYFDRKNNWFPVTDCLIADKSLVEVAHYVTEILDAFKLKAYFNDAGVLRHLVVRKSSTTGEIQVVITAVKLNFNVKEIAAKILLNPEIQSLTFHENPKKTREVFGKGTAVTFGTRYITEELLGISYRLTPLSFFQINPVQAEKIYRIALDYLDLGKTDMVFDGYSGVGSLTLPAARIAASVVGVEEIRDAVEVAKTNAKLNGIANVNFFAGKVEEKLPWLLKKGYRFNKIILDPPREGVKKEVLEEIIKLNPERIVYVSCNPATQARDLKILAETGYYPVEITPVDMFSQTMHVENVVLLKKK

SEQ ID NO: 8247 - protein, 416 aa, Medicago truncatula
MENLFRLADHQDFLSRRCIWVNGPVIIGAGPSGLATAACLREQGVPFVVLERADCIASLWQKRTYDRLKLHLPKQFCQLPNLPMPEDFPEYPSKKQFISYLENYANKFEINPQFNECVQSAKYDETSGLWRVKTNEVEYICRWLVVATGENAECVTPEIEGLSEFKGEVVYACDYKSGKNFEGKKVLVVGCGNSGMELSLDLSNHHALPSMVVRSSVHVLPREIFGISTFELAVMMLKWLPLWIVDKLLLILTWFILGDMEKYGIKRPSMGPLQLKNTVGKTPVLDIGALEKIRSGDINVVPGIKRINKNGEVELVNGEKLDIDAVVLATGYRSNVPSWLQEGEFFSKNGYPKMPFPHGWKGNSGLYAVGFTKRGLSGASSDAVKIAQDIGKVWKQETKQKKQRTTACHRRCISQF

SEQ ID NO: 8248 - protein, 1480 aa, Arabidopsis thaliana
MLNKLTHGVFTYRASLTAMLSSSTSAGLSSSFVSSRFLSSGIFSSGASRNRVTFPVQFHRASAVRCFASSGGSDRIQVQNPIVEMDGDEMTRVIWSMIKEKLILPYLDLDIKYFDLGILNRDATDDKVTVESAEAALKYNVAIKCATITPDEGRVKEFGLKSMWRSPNGTIRNILDGTVFREPIMCSNIPRLVPGWEKPICIGRHAFGDQYRATDTVIKGPGKLKMVFVPEDGNAPVELDVYDFKGPGVALAMYNVDESIRAFAESSMAMALTKKWPLYLSTKNTILKKYDGRYEHRLIDDMVAYAVKSEGGYVWACKNYDGDVQSDLLAQGFGSLGLMTSVLLSADGKTLESEAAHGTVTRHFRLHQKGQETSTNSIASIFAWTRGLEHRAKLDKNEKLMDFVKKLESSCVNTVETGKMTKDLALLIHGPKVSRDLFLNTEEFIDAVASKLKTQFKELPLSSLHRCVKPFSVLIPSLLRISHSLCVCVMSSIVNRASSASLPNFLAWRALGFRTICSGRLGFAPSVPDSPVSAGTKILESFKEEFEVGSRVVSFETGKIARFANGSVVLGMDETKVLSTVTCAKTDSPRDFLPLTVDYQEKQYAQGLIPNTYMRREGAPKERELLCGRLIDRPIRPLFPTGFYHEVQIMASVLSSDGKQDPDILAANASSAALMLSDVPWGGPIGVIRIGRICGQFVVNPTMDELSSSDLNLIYACTRDKTMMIDVQSREISEKDLAAALRLAHPEAVKYLDPQIRLAEKAGKQKKEYKLSMLSDKTLEKVADLAATRIESVFTDPSYGKFERGEALDNIGKDVRKVFEEEGDQESLSILPKAVDTVRKKVVRSRMISDGFRVDGRHVDEVRPIYCESHYLPALHGSALFSRGDTQVLCTVTLGAPAEAQSLDSLVGPPKKRFMLHYSFPPYCTNEVGKRGGLNRREVGHGTLAEKALLAVLPPEEAFPYTIRINSEVMSSDGSTSMASVCGGSMALMDAGIPLRAHVAGVSVGLITDVDPSSGEIKDYRIVTDILGLEDHLGDMDFKIAGTRDGVTAIQLDIKPAGIPLDIVCESLENAREARLQILDHMERNINSPRGQDGAYSPRLATLKYSNDSLRTLIGPMGVLKRKIEVETGARLSIDNGTLTIVAKNQDVMEKAQEQVDFIIGRELVVGGVYKGTVSSIKEYGAFVEFPGGQQGLLHMSELSHEPVSKVSDVLDIGQCITTMCIETDVRGNIKLSRKALLPKPKRKPASDAGKDPVMKESSTVYIENSSVGEIVASMPSIVTPLQKSRLSVPAVVIRTAVECNEAEKSSPVNDNDKPRRAATSKPDRKPKSTASKLIATQKEEEALESIAPEETSAECGEILKQDGKLKSVSPKNNSTASNLVSFSKAKKSTMKENLSENKAEESASVSTRKLKIGTEMTATVDHVRALGLVLDLGGEIRGMYIFQGDKDKFKKGDTLRVKCTSFNTKGVPVMALVDEEGEE

SEQ ID NO: 8249 - protein, 389 aa, Zea mays
MEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGGVLREIARHDSVETIDICEIDQLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISSAENEKPKESVSEPQKIKILSNNAILTAS

SEQ ID NO: 8250 - protein, 345 aa, Arabidopsis thaliana
MDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHISDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 8251 - protein, 406 aa, Burkholderia xenovorans
MHAVPPLEQDTGDATVDVSPAQAASQKSAHAPAQAANDAPVRDLRRVGIHPDYWYPLAWSHEVKRGKTHGVTFAGDPIVLARTEGGKVFALEDRCAHRQVPLHQGVVDGESIRCGYHGWTYDCSGKCIDVPYLGRERLPNGVRSYPCREVEGLIFVFPGNAALAEQRPLPDLSSVSDKKYKTRRFGRPVNCHYSFMHENLMDMNHQFLHRKQMGQMRARSLGRRTGEGWVEVDYTFARMAGQQPIGEAIVFGQSRKTGGDNDKDVMTIRTEYPYQTLQIRTSEQTLVMNLWIVYVPLDREQRTNRTFGLLSIRKPGVPGVLNLAWPLLVWFTERIFKEDREIVEAEQRAHDSQGADWNHEVFPVINELRALLRERGAPDQVVGAGTGDTEVIRFWDSRNGSPLAKS

SEQ ID NO: 8252 - protein, 360 aa, Arabidopsis thaliana
MALSTTPSQVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 8253 - protein, 569 aa, Coprinopsis cinerea
MFVAALWPVALGALAVLATAKPTRTSPLAKRQAPSDIRFVTTDNGRFVVNGAPINFVGTNAYWLHTLNSEQDIDYTLGNISAAGIKIVRTWAFNEVTSVPETGTWFQLIKDDGTVEINEGPNGLQKLDAVVRLAEKHNIYLLLALTNNWSPDPLFDDITIGAGPVRRSDITPPANGSLPRNFLSNDYGGMDTYVRQFGLDNHDEFYTNPKVINAFKNFTATIAKRYTNSPAVFGWELANDARCSSTVGATTCNPKVITKWHSNIAQHIKEVDPNHLVASGTGGQFCVDCPKLFPRVVPPPPAVSPVPGLRRRGRTGFLTKSRIIQDRLAARKRNMKRNKTKGGVKIRGRWTSSVTRRQEDLQTLGPAFDGSSGVDSEDILNIPEISFSSFQLFPDQNEYGQPDPDLSDFENTMQRGVEWIQYHAESALAFGKPATLNGFGLVTQEHVPNYVPFNSSEAPYASDTETPTEEQPYGVTNEQRDEAFSTWLNVGFRSGLSSMIHYQWGQTGLTVQPGTTVSQSVPGTGLVENDGITGVSPNDGYSSNGVGRDSVIEVLQESVQEYASDSTLR

SEQ ID NO: 8254 - protein, 142 aa, Glycine max
VAFTEKQDALVSSSFEAFKANIPQYSVVFYTSILEKAPAAKDLFSFLANPTDGVNPKLTGHAEKLFALVRDSAGQLKASGTVVADAALGSVHAQKAVTNPEFVVKEALLKTIKAAVGDKWSDELSRAWEVAYDELAAAIKAK

SEQ ID NO: 8255 - protein, 421 aa, Carboxydothermus hydrogenoformans
MTHLNLRLKDVDPEIFEAMEKELSRQREKIELIASENFVSRAVMEAMGSHLTNKYAEGLPGKRYYGGCEYVDVVENLARERAKKLFGAEHVNVQPHSGAQANMAAYMAFLEPGDTVLGMNLAHGGHLTHGSPVNFSGKLYNFVSYGVEPDTEKINYEKVFELAYKHKPKMIVAGASAYPRVIDFKHLKEIADEVGAYLMVDMAHIAGLVAAGLHPSPIPYADVVTTTTHKTLRGPRGGVIFCKAEHAAKIDKTVFPGVQGGPLMHVIAAKAVAFKEALSPEFREYQQQVVNNAKALAEELKKQGLRLVSGGTDNHLMLVDVRPVGLTGKRAEQLLDEIGVTVNKNAIPYDPESPNVTSGIRIGTPAVTTRGMKEGEMAEIAEIIALVLKNPENEDKHREAARKVRDLLNRFPLYDKLPYND

SEQ ID NO: 8256 - protein, 472 aa, Arabidopsis thaliana
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVFILPRVVVDNEVLIHFKKEIVFLFGSVVFEMEKVSSPSSSFSRRSAYLEALTQEIKKKLTRAVVSPAQTRNLLQDLFADIALEVDDRAKDVILSKEEDLITSDEADADGPLCFFDVLADYYVKVSERGKDILDLMLFEVELDNQEILLRYSSALVQGATNVFWIDIQTNTRRFQSLFRYLLEEVALEQIRLKKIPIQAQRELYLLLSRFIFFYNSVDKLDSFLRNFPEFPNAFLIGGPGDFLVIELTDQLQKLKVEPVLLHYLSQMKILQGMELRMTTSTRLKACLYSFTSPGGPMYPTRAVRHAAWDALDSLFPVGRYPRHLISLFFRLLYPWYWPSSCWNFVVSCIKAVLYSIVRLIFSRREKPRQS

SEQ ID NO: 8257 - protein, 339 aa, Triticum aestivum
MPPNLECRMYEPRFPEVDAAVMIQVKHIADMGAYVSLLEYNNIEGMILFSELSRRRIRSISSLIKVGRQEPSMVLRVDRDKGYIDLSKRRVSEEEAATCEDRYNKSKLVHSIMRHAADTLGVDLEPLYQRIGWPLYRRYGHAFEAFKLIVTDPDGVLDVLTYEETVVGPDGEEVTKVVPAVTPEVKDALVKNIRRRMTPQPLKIRADVEMKCFQFDGVLHIKEAMRKAEAAGNADCPVKIKLVAPPLYVLTTQTLDKDQGIAVLTNATKICAEAIEKHKGKLVVKEAARAVSERDDKLFADTIEKLKLAGEEVDGDDDSEEEDSGMGDVDFTKAGAGAD

SEQ ID NO: 8258 - protein, 194 aa, Yarrowia lipolytica
MPLITISAALTEGFKKHEVVPDVIDEFDPNTLLEITYGGENVVAVGNTLAVADTQHKPSIHASFPKDTEGTYTLVLTDPDAPSRTDNKWSEYCHYIVTGLKPGVVAEAEGAAVELDLSKGKELIPYMGPGPPPKTGKHRYVFVLYKEGAKSPEAPADRPTWGTNVPGSGTREWAKKNDLTLVTSNFFFAQNTEQ

SEQ ID NO: 8259 - protein, 463 aa, Unknown
  Oceanobacter sp. RED65
MKFLPLFVELKDRSVLIVGGGEVALRKARLLQQAGAKVSVISPEVDPHLRSIAEKSGGECRLETYQIQDLTPYVIVVAATNHADVNKAVAEHAHQVGVSVNVVDKPDLGNFIFPAIVDRSPVIAAVSSGGASPVLARLLRTRLESLIPAGYGKLAALAEKYRSKVKAKFSDVNRRRGFWETVLHGKVANLVFAGQDTQAESTLQALLEDAADEAKAQGEVYLVGAGPGDPDLLTFKALRLMQQADVVLYDRLVSEPILKLCRRDAKMINVGKARSNHTVPQDGINQMLVDYAKKGHRVLRLKGGDPFIFGRGGEEIERLSDNGVDFQVVPGITAASGCSSYAGIPLTHRDYAQSVRFVTGHLKDNSANLPWSELAYKNQTIVFYMGLMGLPIICEQLIAHGMGNETPIALVQQGTTLNQKVIIATLDTMVDVLSTQQIKAPTLIIVGDVVKLHDQLKWFNPQA

SEQ ID NO: 8260 - protein, 685 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPERKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 8261 - protein, 552 aa, Shigella flexneri
MIMFCVQCEQTIRTPAENGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLNA

SEQ ID NO: 8262 - protein, 143 aa, Triticum aestivum
  misc_feature (23)..(23): Xaa can be any naturally occurring amino acid
  misc_feature (76)..(76): Xaa can be any naturally occurring amino acid
  misc_feature (84)..(84): Xaa can be any naturally occurring amino acid
  misc_feature (93)..(93): Xaa can be any naturally occurring amino acid
  misc_feature (107)..(107): Xaa can be any naturally occurring amino acid
  misc_feature (113)..(113): Xaa can be any naturally occurring amino acid
MSAAEDKQDRNVVEHTACETAAXFSMQELVVWGRSDLRSGTVPGVFLFHAPISLLPLGLPESFWRQACDLAPLLIXLADRVSLXDGDFLQDSXFHPRQVDHFPYRLXLLTHSXMDANTKQNIFRRNHRSDNMMNSQTYSFHPI

SEQ ID NO: 8263 - protein, 384 aa, Prunus dulcis
MEGGSNGTCSMMAFGENSSSNGGGLCPMMMVPALMTSHHSHHHHHQHHHPTNSTNADPNTTTPFQLPQLPPSNHNRNSSTSSFIFNDHHPNNNNNHHPATAAACYFMDNNNSNHDGSSSSSSSVKAKIMAHPHYHRLLASYINCQKVGAPPEVVARLEEACASAASIGQMMSSSSGSGCLGEDPALDQFMEAYCEMLTKYEQELSKPFKEAMIFLQRIESQFKALTLSSSSDSAVCGDGLDRNGSSEEEVDVNNNFIDPQAEDRELKGQLLRKYSGYLGSLKQEFMKKRKKGKLPKEARQQLLDWWSRHYKWPYPSESQKLALAESTGLDQKQINNWFINQRKRHWKPSEDMQFVVMDATHPGHYYMDTVLGNPFPMDISPTLL

SEQ ID NO: 8264 - protein, 90 aa, Zea mays
  misc_feature (29)..(29): Xaa can be any naturally occurring amino acid
MTLYISDYTISYTISFFIPGWIFYIIPMXPIKAHSFNEYNVLFQCKLYYQNVMVFQFFTYGKVLFLDLIIHVTERDEFSYQEIITHLPLC

SEQ ID NO: 8265 - protein, 492 aa, Unknown
  Synechococcus sp. WH 7805
MASARTLFWHRRDLRLADNTGLQAAVALGPAVTGVYVLDPSIITPPPQLPPMAPARLWFLVESLIELQERWREAGSRLLVLQGDPLTLLPQLAALLDSSTVVWSRDVEPYARERDRGVAKALQADGRQVLVDWDQLLVAPELLKTGNGDPYRVYGPFLRNWRGQVERLRPSTVAAPTDLQDLTAEQQQAIRSTETALGRLWADGQQALQRLQTEHGFAGMDLCPCRPGEVAAVDQLAVFADGPLLGYEPDRNFPGTAGTSGLSAALSVGTLSPRQAWCAAQAAKDLARSDEQRQAIAVWEQELAWREFYQQALFHFPELADGPYREQWRRFPWENNEDWFDFWKDGQTGMPIIDAAMRQLQQSGWMHNRCRMIVASFLVKDLICDWRWGERAFMELEVDGDLAANNGGWQWSASSGMDPKPLRIFNPATQASKFDADGDYIRRWVPELRHVSTKDLLSGEIGALERRGYPEPLVNHKIQQAKFKVLYATIKA

SEQ ID NO: 8266 - protein, 179 aa, Triticum aestivum
LRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEAYDCNNVVEQELPCGGVLIYQSFAANEEVAVSAGSPRSVFHCFEAESVQSHPLVKEGKLANLLAWRAEEDSLEEGAVLCE

SEQ ID NO: 8267 - protein, 319 aa, Rhizobium leguminosarum
MSDKQVPIGSGFGAHTTADEVLAGLDLSGKRVIVTGGHSGLGLETTRALAGAGAQVTIGARSIEAARRAVAGIDGVEIDRLDLSDLESVRVFAERFVASGRSIDILINSAGIMACPETRVGDGWEAQFATNHLGHFALVNRLWPAISPGARIVAVSSGGHHNSAIRWEDVQFETGYDKWRAYGQSKTANALFAVHLDRLGRDTDIRAFSLHPGKIFTPLQRHLAKEEMVSAGWIDADGNPIDPTFKTPAQGAATQVWAATSPQLDGMGGLYCEDCDIAIRATDGAPGGVSDHAADPEEAARLWILSARLTGIDAFAAHA

SEQ ID NO: 8268 - protein, 436 aa, Prochlorococcus marinus
MTDIFEVPSPDNNLLDKAEQLRLASIKTSQTNNNERIRALNLMADSLEKNSKEIIDSNFEDYKKAEIKGISKALLSRLKLSKEKLNLGIEGIRKVGDLSDPLGQIQIKKELSKGLILERKTVPIGVLGVIFESRPDAVMQISSLAIRAGNGVMLKGGSEANFTNQAIVSALKKGLQKSNIDDNAICLLTSRKDSMAMLNLEKFINLIIPRGSNELVKFIQENTGIPVLGHADGICHLYIDDEVNLDIALKVALDSKIQYPAACNAIETLLIHKSIAPAFLKKAIPIFNSNNVKLIGDKKAVKLGVAFEANYEDWQTEYLDLILSIKIVDDLEEGIAHIQKFSSKHTDGIITENISNANKFMSEIDSAGVFHNCSTRFADGFRYGFGAEVGISTQTLPPRGPVGLEGLVTYKYFLRGEGHSVDDFSSGKSIYTHKDL

SEQ ID NO: 8269 - protein, 293 aa, Saccharomyces cerevisiae
MAQEITHPTIVDGWFREISDTMWPGQAMTLKVEKVLHHEKSKYQDVLIFKSTTYGNVLVLDNVIQATERDEFAYQEMIAHLALNSHPNPKKVLVIGGGDGGVLREVVKHDSVEEAWLCDIDEAVIRLSKEYLPEMAASYSHPKVKTHIGDGFQFLRDYQNTFDVIITDSSDPEGPAETLFQKEYFQLLNSALTEKGVITTQAESMWIHLPIIKDLKKACSEVFPVAEYSFVTIPTYPTGTIGFMVCSKDKTCNVKKPLREISDEKEAELYRYYNKKIHEASFVLPTWAAKELN

SEQ ID NO: 8270 - protein, 176 aa, Bacillus halodurans
MEKRLERAMFAGGCFWCMVQPFDKQPGIESVVSGYAGGTVENPTYEQVKTGTTGHYEVVHITYVPELFPFEKLLSLYWPQIDPTDPDGQFHDRGPQYRTAIFYENEEQRALAERSREALEKSGKFKKPIVTSILPMATFYPAEEEHQQFYKKNPMAYKEDREKSGRDEFIYKHWGK

SEQ ID NO: 8271 - protein, 382 aa, Magnetospirillum magnetotacticum
MSKQDYYDLLGVEKGASPDDIKKAYRKQAMQFHPDRNPGNAEAEQKFKEINEAYDVLKDEQKRAAYDRFGHAAFEQGGPGGGGGGGFGGFGGGGFSDIFDEMFGEFMGGGRRGQSTGRGADLRYNMDISLEDAFAGKTTTVKVPSSAPCEDCKGTGGKDGAAPVTCSACHGHGKIRQQQGFFTIERTCPTCQGMGKIIKDPCRSCGGSGRTRKEKTLQVNIPAGVEDGTRIRLAGEGEAGMRGAPPGDLYIFLSIAAHRIFQRDGANIFCRVPIPMTTAVLGGTIEVPTIDGSKAKVTIPEGTQTGNQFRLRSKGMSVLRSPARGDMFIQAVVETPVNLTKRQKELLHEFNEAGEGEKAKNSPESQGFFAKVKELWEDLKEG

SEQ ID NO: 8272 - protein, 307 aa, Sorghum bicolor
MSAELKRDYEIGAEIGRGRFGVVHRCTSRATGEAFAVKSVDRSQLADDLDRELAELEPKLAQLAGAGNPGVVQTHAVYEDETWTHTVMDLCAGPDLLEWVRLRRGAPVPEPLAAAIVAQVAQALALCHRRGVAHRDVKPDNILIDTAPAGSDDGEDEEEDSGEAEEAETAPRARLADFGSAAWVGAGGLGRAEGLVGTPHYVAPEVVGGGEYGAKADVWSAGVVMYALLSGGALPFGGETAAEVLAAVLRGSVRFPPRLFSGVSPAAKDLLRRMICRDEWRRFTAEQVLAHPWIVSGGGARAIERPT

SEQ ID NO: 8273 - protein, 138 aa, Cucurbita maxima
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 8274 - protein, 170 aa, Medicago truncatula
MQNLQEKASEWSGVETNHAFAIDDTNLFQKLGLQTFINLSTNFYNRVYVDDEEWFRSIFAKSDKDKAIQNQYEFLVQRMGGPPLYSQRRGHPALIARHRPFPVTHEAAERWLLHMQQALDNISDIDHDSKIMLMNFFRHTAYFLVAGVEQKNQSLHPCKDADGRHPCKNF

SEQ ID NO: 8275 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 8276 - protein, 356 aa, Unknown
  Rhodococcus sp. DK17
MSTIARNQWYVAAYGREVGRELFSRTICEEPILFWRTEAGEAVAMSDRCVHRRYPLSEAPSRLDGDKVVCGYHGFTYGSDGGCVFVPGQARVPRTARLRSYQVVEQDSFVWVWIADPQNPQQGDPTRIPRAPWMDSPDYTVVSGMEPIDCNYGLLVDNLMDLSHETYLHGGYIGTPEVAETPITTEIDEDRNVIYVSRHMDDAECPPFYSKSTGIEGRITRWQDIEYTPPCLYLLHSRIAPIGAPLPGDDGSDPHAFHSEIVYAITPSTENSTLDFWAVARDFALGDDAVTTFLAENNRTVVMQDVVALNILQKALDTEKDGYQELSINIDAGGLGARRILKKLVDAPQAVTAAVG

SEQ ID NO: 8277 - protein, 618 aa, Unknown
  Candidatus Desulfococcus oleovorans Hxd3
MAGEKTKAKASGYDKYVDWKVFIFPVVLCAVILLLPTPYGMKDVGMEYRVGPGAVINYVTTTLFETSSSDVEQWQLLTARIMEQNMNMGALTKERFLNRDAKWCRGYKIPVVESHLAKAREFIDTQVTPERFKEIMASAMELRKDGLTYETLNEKDRVLADKGAWHIKAAIVMMVFVVGCFLTECIPLPGVAFCIGIFLVVTGLVTRHEVAMLYWSDACWFIMGSLMFAAAFVKTGVDKRLCLMMFKKLAKPNVKWITLIFFLIITPLAAFISDHALAAMFLPIGILLYQNSLTEEVPEDPELAKLLMIAIAVACNIGGPGAPSGGARNVIMMTYLNDMFGFDIGYFQWVTYCFPFLLIMIPVSWLLVNASFKPKIKSLAPAMDHLQVQIAKMGGWNRTQIAALVIFVVMVFGWFTEKSFYQMGIYPVRLGIGVIAVAGAVAYLLAGVVNWRDYQEKVDWGVVWLYAGAIIFGRVLDETGAAYWLARSVLDAMAPLGIDAGLPLLALSNGLTAVLTNFMADGPAAAAVGPIALNMAGLAHPGTSFLPFITMTTAMASSFAYCLIIGTPPNAIVYASGYLEPKDFLRAGIPLWFLGNIVLMALSGIYWMARGFAGLPGF

SEQ ID NO: 8278 - protein, 250 aa, Oceanicola granulosus
MSRPVAIVTGAAAGIGQAIAARLLADGFAVVACDLSAFADAAEGREDVVADIADPETPARLVAAAQRAGRLAALVNNAGIGGAKAAAETDDASWSRILDVNLGAGFRLARAALPEMIAGGGGSLVNVASVYGQLGFRTTAAYAASKAGIEGLTRQMAVDYGPRGVRANAVAPGLIETALTRRLLEDPAYRLLMLDGTPLPGPGRPEDVAGAVSFLCSPDARFVSGVTLNVDGGWATTRSRFPHDPTGEPT

SEQ ID NO: 8279 - protein, 362 aa, Burkholderia vietnamiensis
MATPQFHPLRIRDVRPETADAVTVSFDVPPELRDAYRFTQGQFVTLKTHIDGEETRRSYSICVGTTDYDRDGELRIGIKRVRGGRFSNFAFDTLKPGHTIDVMTPDGRFFTHLNADHGKQYVAFSGGSGITPVLAIVKTTLELEPRSTFTLIYGNRSVDAIMFAEELEDLKNRFMNRFVLYHVLSDDQQDVELFNGVLDQAKCAQFLATLMPADAIDEAFICGPAPMMDAAEAALKAAGVSPEKVHVERFGTPLPQAGAPVVEITEQTPAADLEIVLDGKKRKLRLPYEGVSLLDVGLRAGLALPYACKGGVCCTCRAKVVEGEVRMDKNYTLDEREVKDGFVLTCQCHPVSDKVVVSFDER

SEQ ID NO: 8280 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 8281 - protein, 738 aa, Coccidioides immitis
MSDADEREPQQDSVPIAAPSASPGLPSESPASTSLPRHVATARLASPIPNNAELQDASSRRAATPLQAVAEREPDFKGKAVASSPNKPGDSILTSGLRNVSSSPAPEEPPSRSGSPPSAETGPKFNLTGEENSPRNTPAPTENPQIIRRHLVQPQGNTSEVNNENSSESEDSTVKNPADVDEFSSLQLQGGDITRPVYRWTEEAEAQEASRRRRSFDVPRPEPESATLDIGSIKIPGGFRRDYLRRAAGGAESNGLHSSTGRDGPQLPTRSFLEFLTLYGHFAGEELEEDDEALGPDEYFVPELWREGEEEIGEETALLPPGAPGKHPRRHRDRAPKATNSATGAMLLLLKSFVGTGILFLPRAFLNGGMLFSSVVLVTVSLLSYYCFILLISTRSKIEGSFGDIGGALYGKHMRRIILGSIALSQFGFVSAYTVFVSTNLQAFVLAVSKCKTFISIQFLILMQLIIFLPLSLIRDISKLAFTALIADAFILLGIVYLYGVDIKTIIDQGGVADIKAFNPQSWQLLIGTAIFTYEGVGLIIPIQESMKRPQQFPRVLALCMIVITVIFLSSGVLGYATFGSATETVVLLNLPQDDKFVNGVQFLYSIAILLSTPLQLFPAIRIMENGLFTRSGKYNPGIKWKKNIFRFFLVVICAVVAWGGAADLDKFVALVGSFACVPLVYVYPPLLHWKAVATTRFRRWSDIALAVFGTLIRKSTSILLRRFATFNQPFSRLPSQF

SEQ ID NO: 8282 - protein, 154 aa, Bacillus cereus
MGYVEELRKIVGHRPLILVGAVVLVINENGYVLLQQRTEPYGKWGLPGGLMELSESPEETAYREVYEETGIKVKNLQLINVFSGANYFTKLANGDEFQSVTTAYYTDEYEGDFVMNKEEAVQLKFFSVTELPDYIVGSHKKMIAEYMKIMEKKI

SEQ ID NO: 8283 - protein, 502 aa, Gibberella zeae
MMNMRLLRQQCLRTKPSLATRISTRGFASQKDLLGSSLEQGDPEIHAILKREEKRQNHFINLIPSENFTSRSVLDALGSVMQNKYSEGYPGARYYGGNEHIDEAERLCQSRALETFRLDPEKWGVNVQPLSGSPANLYAYSAILNTHDRIMGLDLPHGGHLSHGYQIPGKKISMISKYYETFPYRLNEETGLIDYEKLRENALLYRPKVIVAGTSAYSRLIDYERMRAIANEAGAYLLSDMAHVSGLVAAGVIGTPFDDSDIVTTTTHKSLRGPRGAMIFYRKGVRSTDKKGKQIMYDLEGPINASVFPGHQGGPHNHTITALAVALKQAQTPEFKDYQEKVLANSQAMANQLTDLGYSLVSGGTDNHLVLVDLKPKGIDGARVERVLELVGVASNKNTVPGDRSALKPGGLRLGTPAMTTRGFNGEDFKRVADIVDRGVKITLAVDKDARAAAEAKGAKNPGTVKNFLEFLGDGSSVKEIAALRDEVAEWVGGFPQPWLKS

SEQ ID NO: 8284 - protein, 285 aa, Unknown
  uncultured crenarchaeote
MNPMKKKFRAAIVQMKSSEEKEHNLAYSVKLINEAAKRKARLICFPEFQMAYSPAEQKTESLHRIAEKICGNFVSTLSNSARQNKINVIATMYEIINANEKSQKVFDTGIIINELGKVQSIYRKVHLYDALGFKESKKLLAGSIIEKPSKTSVGNLGLLICYDMRFPEISRILTVNGANILVSPSAWVAGFMKKVHWEVMVRARAIENGVYVLAPNQVGNIYCGHSMAIDPFGATVLDMKNRQGIEYVDIDTAKIDTTRRTLPLLMNRRTDVYRNHIDVFGSKLR

SEQ ID NO: 8285 - protein, 467 aa, Listeria monocytogenes
MTSVMWFRRDLRVNDNKALYHACKEDDLLLLFQVNPAQFITGSPSHQAFFASVAHFKQEIDKTAHLQIMFGEPIECFQQLKDSLPSWDKVYFNRDETGYGAKRDEAAQAFFDEQKIEVQAFHDSYLHSAEEVKKSPTEYYKIFTPYYKKWREEIKETPFKVTLKHENIRKESLFLKYEEQFAEMTSDLPILDIGERAANTRLANFIKHDVADYDKARDFPELDKTSHLSRYLRTGEISIRTIWQTLQETEATEGRATFEKELCWRDFYNMIYVSFPNQKNEPIQENYRFIEWENNREYFKAWQEGKTGFPLVDAAMRQLKETGWMHNRLRMITASFLTKDLLIDWRFGEKYFQQMLIDYDPASNIGGWQWAASTGTDAVPYFRIFNPTTQSQKFDSTGKFIRKYVKELANLPDKYIHQPEKMSETEQKEHGLLLGKDYPFPIVDHKERRKLAIARYEFSKEHSRGNI

SEQ ID NO: 8286 - protein, 1053 aa, Gibberella zeae
MSATRIGQRLARQSRRSPITLQPRLTQTIRLNAVSSRAFSVTATTQAPRFVESQSSTKLHEHELFSRRHIGSESSEQTEMLKMLDPPVSSMEEFLEQTIPPQVRRKQKGLNLVEQWYEGGAETAVPVNGRTEHYIQKEMRKLAKNNKVYESFIGAGYYGTLVPAVIQRNVLENPAWYTSYTPYQAEISQGRLQSLLNFQTLITDLTGLDIANASVLDEATAAAEAMTMSMANAPKGKGQKTFVVSENCHPQTISVLQSRAEGFNIKLVIGDVLADNSKLVREVEGDLIGTLIQYPDTHGGVHDYQALADIVHEKKALLSASTDLLALTMLKPPGDFGADIAIGNSQRFGVPLGYGGPHAAFFATSEKYKRKIPGRLVGVSKDRLGKPALRLALQTREQHIRREKATSNICTAQALLANMSAFYAVYHGPKGLKTIAEDIWSKTRLAQSLILEKGEFKLHTEGLREDGSVLFDTVTLKGSPEAIAKVHEKADSQSINLRRVADDKVGFSLHEGVTLESLGNLVKIFGVSESDFNAALESDKAKFLNDEIPASLQRKSAYLEQPVFNQYHTETELLRYIYHLQSKDVSLVHSMIPLGSCTMKLNATTEMLPVSDPGINNIHPFAPVEQASGYQALISSLAKNLSEITGMDATTLQPNSGAQGEFAGLRCIKAYHEARSGEKRKVCLIPVSAHGTNPASAAMAGMKVVTVKCDGKTGNLDIEDLKAKCVKHADELAAIMVTYPSTFGVFEPEIKQVCDLVHEHGGLVYMDGANMNAQIGLCSPGDIGADVCHLNLHKTFCIPHGGGGPGVGPIAVKKHLAPYLPGHPEIDPQRIGAERDSTAVAPISAAPWGSASILPISHTYILMMGGDGLTKQTGTALLNANYIMSRLLPHYKVVYTNAQGRCAHEFILDVRPFKDTAGVEVADIAKRLADYGFHSPTMSFPVSGTLMIEPTESESRAELDRFCDALIQIRKEIADIESGKVPRKNNILTNAPHPQEDLLSSEWDRPYTREEAAYPLPWLREKKMWPSVGRVDDAYGDTNLFCTCPPVEGSEDL

SEQ ID NO: 8287 - protein, 339 aa, Lactococcus lactis
MKRIAVLTSGGDAPGMNAAIRAVVRKAISEGIEVYGINHGYAGMVAGDIFPLTSASVGDKIGRGGTFLYSARYPEFAQVEGQLAGIEQLKKFGIEGVVVIGGDGSYHGAMRLTEHGFPAVGLPGTIDNDIVGTDFTIGFDTAVSTVVDALDKIRDTSSSHNRTFVVEVMGRNAGDIALNAGIAAGADDISIPELEFKFENVVNNINKGYEKGKNHHIIIVAEGVMTGEEFATKLKEAGYKGDLRVSVLGHIQRGGSPTARDRVLASRMGARAVELLRDGIGGVAVGIRNEELVESPILGTAEEGALFSLTTEGGIKVNNPHKAGLELYRLNSALNNLNL

SEQ ID NO: 8288 - protein, 340 aa, Mycobacterium tuberculosis
MQLGMIGLGRMGANIVRRLAKGGHDCVVYDHDPDAVKAMAGEDRTTGVASLRELSQRLSAPRVVWVMVPAGNITTAVIEELANTLEAGDIVIDGGNTYYRDDLRHEKLLFKKGIHLLDCGTSGGVWGRERGYCLMIGGDGDAFARAEPIFATVAPGVAAAPRTPGRDGEVAPSEQGYLHCGPCGSGHFVKMVHNGIEYGMMASLAEGLNILRNADVGTRVQHGDAETAPLPNPECYQYDFDIPEVAEVWRRGSVIGSWLLDLTAIALRESPDLAEFSGRVSDSGEGRWTAIAAIDEGVPAPVLTTALQSRFASRDLDDFANKALSAMRKQFGGHAEKPAN

SEQ ID NO: 8289 - protein, 102 aa, Unknown
  Synechococcus sp. WH 5701
MGNSELFPAMASFTITLEDGKSFSCPDDQYILDAAEEQGIDLPYSCRAGACSTCAGKILSGSVDQSDQSFLDDDQIGEGFALLCVSYPLADCTIKPNVEDDL

SEQ ID NO: 8290 - protein, 169 aa, Triticum aestivum
  misc_feature (147)..(147): Xaa can be any naturally occurring amino acid
  misc_feature (154)..(154): Xaa can be any naturally occurring amino acid
  misc_feature (159)..(159): Xaa can be any naturally occurring amino acid
  misc_feature (161)..(161): Xaa can be any naturally occurring amino acid
MERCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEELDWEMGLIRTQEETGRHVXMLTHEIXSTLDXHXILKTTIVE

SEQ ID NO: 8291 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 8292 - protein, 799 aa, Zea mays
MASSLPAPPASPSSSWRGLTPRCPPPRCGPLLARAAARSYRYRFRTDDDGVVDVAVAGKDGDAGYVVAIEAPTHGQRGGLVLRPAGSGEGVPLAPAAPGGALVAELSYDVARAPFHVSFTLADAMGAEIRTHRGTSFRVPVGVGRGCPSPLGLSQSKDGAANFAVYSKIAKGMVLCLFGGGGGDGPALEIELDPYVHRTGDVWHVSMESVEGYARYGFRSGLFAMFGIDRPLLDPYAKVIGDFVAGDSVDEDGLAVPSIRCLASLKNAPNYDWGRDKHPCLPLEKLVVYRANVALFTKDRSSRLADNAAGTFSGMSAKVEHFRHLGVNAVLLEPVFPFHQVKGPYFPYHFFSPMSLYSSECSSVSAIKSMKDMVKTMHRNGIEVLLEVVFTHTAEGGAECQMISLRGIDGSSYYIADGIAGCKASVLNCNHPVTQKLILDSLRHWVLDFHVDGFCFINAPFLVRGPRGEGLSRPPLLEAIAFDPVLSKTKIIADPWSPLDISNVQFPFPHWKRWAEMNTRFSMDVRKFLKGEALISDLATRLCGSGDLFSSRGPAFSFNYVSRNSGLTLVDLVSFSSDELASEFSWNCGEEGPSENNAVLQTRLRQIRNFLFILFISLGIPVLNMGDECGNSAAGSTSYKDRGPLNWKALKTAFVKEVTGFISFLSALRSRRADIFQRCEFLKLENIHWYGSDLSEPCWEDPTSNFLCLHINAELDEKLPDSTGGDLYICFNANEESASATLPAIAEGSMWLRLVDTSLAFPGFFSRGSSHETHQVLGFSSYQVKAHSCVLFESKRVLS

SEQ ID NO: 8293 - protein, 474 aa, Rubrobacter xylanophilus
MRNDHRVSPALGDRGGAAANRRASAGGASFGLPGGYMTAPLAEVDPEIQEVLERELERQRNTLEMIASENFVPQAVLEAVGSVLTNKYAEGYPGRRYYGGCHEVDVAEQLAIDRAKELFGAEHVNVQPHSGAQANNAAYMALLEPGDTFLGLALDHGGHLSHGMKLNVSGRLYNPVPYHVRREDSLVDMEEVERLANEHRPKLIVAGWSAYPRQLDFAAFREIADSVGAKLMVDMAHFAGLVAAGIHPNPVEYADVVTTTVHKTLAGPRSGMILCREEHAKKIDSAVFPGQQGGPLMHVIAAKAVALRIAHTEGFRARQRQTVANAKALAEALMQNGIEVVSGGTDVHLVLVDLTSTGLDGKTAEDRLEKVGITVNRNTIPFDPRPPMNPSGLRIGTPALTTRGLLEEDMREIAGIIAGALSDNFEAEHKALLERSRALMQKYPLYPDSQRPTPADGEGKEAPAPPPPTRPSWL

SEQ ID NO: 8294 - protein, 633 aa, Coprinopsis cinerea
MMNSIPVERAADAATSGVGKIWLSLDDPCLILGDGTQFTKDFTPRMQIMLPKSVNSALAEVSEVISDTELRIKREFGGESGKGTARIREKVEELRKEGVQGLEYKKLPFVDQQEMYRHVYQALKNGGSIGIFPEGGSHDRTDLLPLKAGVSIMALGAMANDPSVQVKIVPVGLSYFHAHRFRSRAVVEFGAALDVPTEYVEMFKEGGAKKREAVANFLELIYNSLKTVTVRAPDYDTLMLIQAVRRLYKTPGQHLTLGQVVTLNRRLLEGYTHFKDEPRVQKLRGDVLKYNRMVRDLGLRDHQVPRAKKAGWKSFGLLTYRLEALAASVVKVAGRDVLATWKVLIALGVTPILYTIYAIIATIIAIRAKAPLKWRILTPFITIFSLPFMNYASLKFGEAGMDVLKSLPPLIVALVPGQQRSLDKLKATREHLSNEVASLINDFGPRLYEDFDETRIVVPSASAPPSGGSSGIWRRKSSVGAVDAQGLGLTHPMTWLDERLFGWSQSARRGTSAWGGHDDISRVATPDESEEEDNGDYDNVVGILHDDGLARTRSRNSSYADLQRLRMSGMISAKSAEATSTAVPQPKAASHRTRRPSLSNDVPVERLAQIPGEEPFPEVTKDLNKEMTRSKST

SEQ ID NO: 8295 - protein, 163 aa, Arabidopsis thaliana
  misc_feature (21)..(21): Xaa can be any naturally occurring amino acid
  misc_feature (50)..(50): Xaa can be any naturally occurring amino acid
  misc_feature (81)..(81): Xaa can be any naturally occurring amino acid
  misc_feature (140)..(140): Xaa can be any naturally occurring amino acid
MASSMLSYAAVATSPAQATMXAPFTGWKSSAGFPATRRTNTDITSIASNXGGRVSCMKGWPPIGKKKLETLSYLPDLNDVXLTKEADYLLRNTWIPCAEFKLQHGYAYREHGYTPGCYDGPYWTKWKLPLFGCTDCAQVXNEAEECKREYPGACIRIIGCDNT

SEQ ID NO: 8296 - protein, 417 aa, Arabidopsis thaliana
MSDLQANKDETTVDRQSSSSVDLDGPSPLRKMISVASIAAGIQFGWALQLSLLTPYVQLLGVPHKWPSFIWLCGPVSGLLVQPSVGYFSDRCTSRFGRRRPFIATGALLVAVSVVLIGYAADFGHSMGDKIDKPVKMRAVVIFALGFWILDVANNTLQGPCRAFLGDLAAGDAQKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLADFL

SEQ ID NO: 8297 - protein, 233 aa, Prochlorococcus marinus
MAVVSLSEMMEAGAHFGHQTRRWNPKMSKYIYCARNGVHIIDLVKTALCMNNAYKWTRNAAKGGKRFLFVGTKKQASDVVAQEATRCGAAYVNQRWLGGMLTNWTTMKARIERLKDLERMESSGSIAMRPKKEAAVLRRELERLQKYLGGLKGMRRLPDVVVLVDQRRETNAVLEARKLDISLVSMLDTNCDPDLCEVPIPCNDDAVRSVQLILGRLADAINEGRKASNNEKN

SEQ ID NO: 8298 - protein, 766 aa, Vibrio fischeri
MTFRLKTIIGISIIQCIMLLILVFSSVKFISDSNEQRLIARANASVHMFSNAIKDSILNNQYDKVASLMDDFITLEKICYIRIFREDGSLIVEGGPKLHEVANPDSSILHNASDGTYDVILPIITNDKTLGKVEIGFGTHGENTFLSQAKSWIYAIASIELIFVIGLSFLLGNALTRNLHKLKKAVNTVASQGPGAQVDISSIGDLGDVAQAFNNMSLKLEQNYQDLQQARNEAEAANKSKSRFLASMSHEIRTPMNAVLGLLAILKDTTLKPNQKELVNTATDSSELLLSIINDILDFSRMEANTFYLENHIFNIHKSLNSVLKTFHPQAQNKQLELSLFIADNVPTYVQGDAHRLRQILLNLVGNSLKFTDDGQVQILVNAEEHEGRIQLHCSVQDSGIGIQQEQLEYLFDEFTMADNSFSRTHEGSGLGLAICQRLVHMMDGTITVNSQYGLGSEFSFNIQLDKATTKEINYLLSKEKIEQQKDIEQQKNCVFSDANILVVEDNHANQIVIKNTLNYAGYSIDIAQNGKEAITKAINTQYDLIFMDISMPEMDGMTATKKIRSLSDTHQNMPIIALTAHALSGDKERFIEAGMTDYLSKPFNRSDLLECLAKYLFKQGKQDPSFCQECDLCEFNESTEEPKSMDNELLLVDEQIIQQIIADTDASVMPELIRFYIIESKERVETISNAAKNKDLYALEFEAHTLGSSALTLGNVALSTLAREIEIHCINQQFDDALEKTAHLPDLATLSLDALEKRNKQGFSK

SEQ ID NO: 8299 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKTVANHFDGKLNILVNNAGIVIYKEAKDYTMEDYSLIMSINFEAAYHLSVLAHPFLKASQRGNVVFISSISGASALPYEAVYGATKGAMDQLTRCLAFEWAKDNIRVNGVAPGVIASSMVEMTIQDQEQKENLDKLIDRCALHRMGEPKELAAVVAFLCFPAASYVTGQIIYVDGGFMANGGF

SEQ ID NO: 8300 - protein, 188 aa, Triticum aestivum
  misc_feature (26)..(26): Xaa can be any naturally occurring amino acid
  misc_feature (93)..(93): Xaa can be any naturally occurring amino acid
MSTSSGAKEAPANNPGLQAEADPATXKGYIMQQTMFRVKDPKVSLDFYSRVMGMSLLKRLDFPEMKFSLYFLGYEDLSAAPADPVQRTGWTFXQKATIELTHNWGTESDPEFKGYHNGNSDPRGFGHIGVTVDDVYKACERFERLGVEFVKKPDDGKMKGIAFIKDPDGYWIEIFDLKRIGEVTATAS

SEQ ID NO: 8301 - protein, 484 aa, Francisella tularensis
MSQKLKRGLHTRHMSMIALGGCIGTGLFVALGGAIADAGPGGTVLAYVIIAIMVYFLMASLGEMAAHSPVSGTFCEYATRYVDPALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKAGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMEGRTWFSVIIEFLSTYIGFFAFVILYFVYKFIKKTKLIRLEDCDLTRES

SEQ ID NO: 8302 - protein, 187 aa, Yarrowia lipolytica
MTASQEPGISPTIKFGPSKLDVITVAGGCFWGIEHMYRKHYTDKGLVDCKVGYSGGSIDNPDYKSVCAGSTGHFESLQVTFDSAQVSYEELADFFFKIHDPTQTDGQGPKNIGTQYLSGLFTHNEDQQARALAVKKKLEDQWFAKPIATVIQPIENFWDAEDYHQNYFVSNEGYHCPTHFLRTTPEK

SEQ ID NO: 8303 - protein, 865 aa, Oryza sativa
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTVIKALRTHPRIRRLVYISCNPDSLVANAIELCTPSSEKQEKNKGNRGWRTMSSAGLARQRTKSMPNSEPFVPKRAMAVDLFPHTSHCEMVMLFER

SEQ ID NO: 8304 - protein, 312 aa, Helicobacter pylori
MEIAVFGGGAWGRALAFAFGEKNEVKIISRRDLNEPLKKLNDALISKGSAPIEQVDLQRGLKATLYVIAISVQHLREWFQNASLPKNAKVLIASKGIEVLNKAFVSEIAKDFIDPNSLCFLAGPSFAAEIIQGLPCALVIHSNNQALALEFANKTPSFIRAYAQQDIIGGEIAGAYKNVIAIAGGVCDGLKLGNSAKASLLSRGLVEMQRFGAFFGGKTETFLGLSGAGDLFLTANSILSRNYRVGLGLAQNKPLEVVLEELGEVAEGVKTTNAIVEIARKYGIYTPIASELALLLKGKSVLESMNDLIRRA

SEQ ID NO: 8305 - protein, 53 aa, Pisum sativum
VDRREAALLKFRQKRKERCFDKKIRYVNRKQLAERRPRVRGQFVSKLNGINVD

SEQ ID NO: 8306 - protein, 342 aa, Brassica rapa
MLASSPMLLFLLSLLMAYNFDTTAGQIGVCFGQMGNNIPNPSEVVAMFKQYSIPRMRMYGPNPDALNALRGSNIEFILDVPNGDLKRLADSQAEANTWVRDNVQKYNDVRFKYISVGNEVKPGEPGAAALIQAMQNIDRALSAAGLSNIKVSTTTFMGPSRNTYPPSRGRFKDEYRNFLQPVIGFLVNKRSPLLVNIYTYFGYMNRDVSLQFALLQPNSNNEFTDPNNQLRYLNFFDANLDSVYAALEKSGGGSLDVVVSESGWPTQGGPGASVPNAEAYVNNLRLHVNKNGSPKRQEAIETYIFAMFDEAPRQTSPNDEYEKYWGMFSPTTRQLKYGVKFN

SEQ ID NO: 8307 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWEE

SEQ ID NO: 8308 - protein, 594 aa, Unknown
  Synechocystis sp. PCC 6803
MISPIGGLSQALHSPSDSIFVASLPRDIQVAEIAPQTKVLRSRLWDRLKFEVEYGRRRGTTSNSYLIQADHTALIDPPGESFCDLYLAELPKYLDLAQLDYIVASHVNPNRMVTLEQLLRRATKAKLICSRPAAKVLKATFPHWEERFQTVRSQDMLDLGRGHKLQLMTLPTPRWPDGLCAYDAGSQILFSDKLFGTHVCGDAIFDEDWRQLGGDRRFYFDCLHAPQTRQVETALDQFDPLTLKMIAPGHGPLVRFSLSRLYSDYRQWCQQQPSQTLKVALIYASAYGNTATMARAIAQGLVKAGVAVETINCEIAEPNEIVEAIQACDGFIVGSPTLGSHAPVQIQTALGIVLSSATKTKLAGVFGSYGWSGEAIDLIENKLKDGGYRFGFEAIRIQFSPNLDALDVCTTSGANFARQLRTHKRQRIARQATTETQADRTQQAVGRIIGSIGVVTTQTTGRHQGILTSWVSQASFTPPGIMLAIPGEFDAYGLAGQNKAFVLNLLQEGRSVRRHFDHQPLPKDGDNPFSRLEHYSTQNGCLILAEALAYLECLVQSWSNIGDHVLVYATVQAGQVLQPNGITAIRHRKSGGQY

SEQ ID NO: 8309 - protein, 279 aa, Oryza meridionalis
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPPYAAAAAAPSSVQYGGVGAAPHIGSYGHHHHHHHHHGHGAAASGASSMGECSTMPVMVPVDPHRSSMSSSLLDMDRNDHDFLFSSADDNSGYLSSVVPESCLRPRGGGAAADHQDMRRYSDADAYGMMGLREDVDDLAQMVAGFWGGGDAADQLGACGFPASGGGADMVASSQGSDS

SEQ ID NO: 8310 - protein, 372 aa, Sinningia cardinalis
MAPIATTLTALAEENSLHQKFIRDEDERPKVAYNQFSTEIPIISLAGIDETNGHHREEICKKIVEACEDWGIFQVIDHGIDSKLINQMTCLAREFFALPSEEKLRFDMSGGKKGGFIVSSHLQGEAVQDWREIVTYFSYPIKARDYSRWPDKPEGWKATTEAYSEQLIKLASKLLEVLSEAMGLEKDALTKSCVDMDQKVVVNFYPKCPQPELTLGLKRHTDPGTITLLLQDQVGGLQATKDGGKTWITVQPIEGAFVVNLGDHGHYLSNGRFKNADHQAVVNSNCSRLSIATFQNPAPEAIVYPLKIRDGENSIMEKPITFLEMYKRKMSNDLELARIKKLSKQNNVKEEELVENSHGSEKSSKDLEQILA

SEQ ID NO: 8311 - protein, 261 aa, Pyrobaculum aerophilum
MELKIGRAIISHALKDLDEYSDVDVAIVGAGPAGLTAARYLAEKGLKVVVYERRFSFGGGIGPGGNMLPKIVVQEEAVPILRDFKVRYKPAEDGLYTVDPAELIAKLAAGAVDAGAKIILGVHVDDVIFRGDPPRVTGLLWIWTPIQMSGMHVDPLYTQAKAVIDATGHDAEVVSVAARKVPELGIQVVGEKSAWSEVSEKLVVEHTGRVAPGLYVAGIAVCAVYGLPRMGPIFGGMLMSGKKVAEVVYKDLMAEAHAVRA

SEQ ID NO: 8312 - protein, 578 aa, Unknown
  Synechocystis sp. PCC 6803
MVTLIDSPTSAAVQPRLTLQTADIAAHTTAIRCLDWDRDRFDIEFELRHGTTYNSFLIRGEKTALIDTSHRKFEAVYLQLLQDLVDLRSLDYLIVNHTEPDHSGLIPDLLELAPQVTVVGSKVAIQFLEKLVHRPFESQIVKSGHSLDLGQGHELQFISAPNLHWPDTILTYDSGTQVLYTCDVFGMHYCDDSLFDETPERLEPDFQYYYNCLMGSNARSVLMALKRIAPLQVVLVATGHGPLLQHHISHWLGQYDAWSQNQVKAETFVALFYVDGYGVSDRLVQTIADGISKTGVAIELVDLSVADTHEVRTLAQCAAGLVVGMPPQSSTSTTLDPLLGTILAAVHPKQVIGLFESGGGQDEPIYPLRNRFQELGLQEAFEPILLKTEPTAATDQLCREAGTDLGQYLTQKQSQQANTDLDPELNQAIGRLSTGLYILTAQKGDVRSAMLASWVIQGSFEPLGIVIAVAKDRAIESLLHPGDTFVLNVLEEDNYQSLMRHFLLRFPPGADRFAGVNTYPAQNGSPILLETLAYLECEVTSRLDGNDHWLVYSTIQTGRVAKLNALTATHHRKLGNHY

SEQ ID NO: 8313 - protein, 319 aa, Bordetella pertussis
MSTPKHAKVLILGSGPAGYTAAVYAARANLSPALITGLAQGGQLMTTTEVDNWPADVQGVQGPDLMQRFLQHAERFNTEILFDHIAKVDLSRRPFTLTGDTGNLYTCDALIIATGASAKYLGLASEQAFMGRGVSGCATCDGFFYRNKDVVVIGGGNTAVEEALYLSNICRKVTLIHRRDKFRAEPILVDKLMDKVANGNMELKLFHTLDEVLGDDSGVTGVRIRSTETDATEDLDVDGCFVAIGHQPNTGIFEGQLEMKDGYIITKSGLSGMATMTSVPGVFAAGDVQDHVYRQAITSAGTGCMAALDAQRWLENAGQ

SEQ ID NO: 8314 - protein, 279 aa, Oryza longistaminata
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPPYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 8315 - protein, 449 aa, Chlamydomonas reinhardtii
MATMLARRASLLPRGARPCFVASRVAPRLASRGVPVVFAAKQGSPAASKSQQYQPTSARDAIERGTEVFKNQNNLDEAVRLYRVGLEMQPNDDEARAALYNLGCALTKQKKFSEAVEAIERAINDYGLKLIVALRDDDLRLLRERREWMDALGRMKGGMSRQTKADLRTEAKAPFRLPRLILFGGLLAGAGLGLMVILTRLAKSLQGGPDAPDLNESLTNLGINVTAVAVLSWLVYRDVSSKQAELRITTREEGLGRLQVDLGKDRVLPLLKFRGQVRPVIVAGSRSFVEKAIKEAEGQYLNLRDRAVSVVPIIFEKAQAVELDPEDKLRLLKKEFAKEGAKGFGDESAKKAASEPKAKKVSVLGGLVEADKKWRLEAYDTDEWKAWILEQKEFSGLSTTEPNCYIQVQLDGTVRSSGTGSPPWDKLVEELPLLSDFRTRLTDGVGPQE

SEQ ID NO: 8316 - protein, 114 aa, Zea mays
MPPIATAIKSRKETPPPPRLPFQYSRRKGTPASAMVTSTTAAAVLSPPSVAGLRLAPSPRARVAFRAVRAQGSVAARAELNPSLVISLSTGVSLFLGCIVVVNFQGENMCNQVP

SEQ ID NO: 8317 - protein, 367 aa, Sinningia cardinalis
MAPSPRVEILASSGNQSIPMEYVRSKEELKSMCTDIFLEEKSNEGPQVPIIDLKAISAEDEDTRKKCHEELKKAAMEWGVMHLINHGVSEEIISRVKIAGKEFFELPVEEKEKYANDQAAGNLHGYGSKLANNANGMLEWEDYFFHCIFPEEKRDFSIWPENPTDYIPSVSQYGKQLRGLATKILSVLSLGLGLEEDRLENEVGGMEELLLQHKINYYPKCPQPELALGVEAHTDISALTFILHNMVPGLQLFYQGKWVTAKCIPNSIIMHIGDTVEILSNGKYKSILHRGSVNKEKVRISWAVFCEPPMEKIVLKPLPETVSQDKPPLFPPCTFAEHVKHKLFRNGSEDAAVDKKSIGDECKEARG

SEQ ID NO: 8318 - protein, 279 aa, Oryza glumipatula
QPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDS

SEQ ID NO: 8319 - protein, 616 aa, Streptomyces avermitilis
MALVLRPRGVRLMSGDQPLPGEEPVPEEADEAVFLETPDIYGAYPRLTEDQIARLAEHGQRRSMAPNDVLIREGERCETLFVVLSGSVAVVEDHGTPEEHVLRVHGPGRFIGELGLLYGQVAFYTAVAREPGEVLVVSLDQLRRLVSQDSTLGDLVLRACLGRRALLVGQGAGFRIIGSRYSPDTRRLREFAVRNRLPHRWIDLETDEEAEDLLRRFGVGPEETPLVIWRDTTLLRNPSNAELARLIGLPSLPAGNRHGDVLIVGSGPGGLAAAVYAASEGLSTTVVEAMATGGQAGTSSRIENLLGFPAGISGAELTERAVLQADKFGARISIPVEASGLHPKDEDHYVVAFADGSEIAARAVVLATGARYRRLQVPGIERLEGTSVHYSATVYEAQQCRTDPVAVVGGGNSAGQAVLFLAGYAPKVHLLVRGPSLEANMSRYLVDQVERHPRVEVMLHTEVTEVIGQEVLEELDVVDNRTGGHRRLAVRGLFVFTGADPHTEWLAGIIALDSRGFVLTGPEAQEACAHPEVWHGRGRSCMTLETSLPGVFAVGDVRSGSVKRVASAAGEGAMAIHFVHRHLGHSAAPGPTGTSAAAGGSDVSPRIRHKESAWLA

SEQ ID NO: 8320 - protein, 145 aa, Leptospira interrogans
MSFFIPPGGPPGPIPGLQLVFGSVGENSLRKLVSDFYDQIPSSSISFMFQENLEDSKIKSADFLIQVTGGPPLYSQNYGPPKMRARHLLFPIDEKARRVWLSCYRKVLDDWDAEVSAKEVLWIFFKDFSTWMVNLESKTEESNGI

SEQ ID NO: 8321 - protein, 976 aa, Oryza sativa
MSMAVASLRLLARGGRRRARFPAPLSVPGGRAAFLSGAAEEVAQADAPPPPPPGRKVLESFREEFEIGGRVISFETGKMARFANGSVVISMDDTHVLSTVAAAKSSEPVRDFLPLTVDYQEKQYAQGVIPTTYMRREGAPKERELLCGRIIDRPIRPLFPPGFYHEVQIMVNVISSDGKQDPDVMAANASSAALMLSDIPWNGPIGVIRVGRIDGNFVLNPTVDELGLSDLNLVYACSRDKTLMIDVQAREITERDLQAGMKLAHAEAVKCINPQLRLAKRAGKKKKEYKISLISDKSYEKIRTLSEAPIEEVFTDSTYGKFERGEALENITQSVKAKLEEECDEDSLKFLHKAVDTVRKQVIRKRIIEKGLRVDGRQLDEVRPLYCESSTYPILHGSALFSRGDTQVLCTVTLGAPGDAQRLDSIVGPPTKRFMLHYSFPPFSINEVAKRGGLNRREVGHGTLAEKALLAVLPPEGEFPYTVRVNSEVMASDGSTSMASVCGGSMALMDAGIPVREHVAGVSVGLVSEVDQTTGDISSYRILTDILGLEDHLGDMDFKIAGTRRGITAIQLDIKPAGIPLDIICESLEPARKARNQILDRMDQEISSARAFNDGSSPRLATLSFSSDSLRKLLFHRKKIEQETGARVSVSDGTVTIVAKTQPIMDKAIEKVEFLVGREIEVGRTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPVFSLLD

SEQ ID NO: 8322 - protein, 104 aa, Streptococcus pyogenes
MALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 8323 - protein, 415 aa, Ostreococcus tauri
MVAQTASVTMVDGLYPSPHFEGAEKRIEIDFHLNKENPRGLREITRTQLDECMTAARCEIVSVRTNVKFDAYVLSESSLFVFPTKLVLKTCGTTHLLAGVPAILKYAKEVGMEPRRVKFTRSSFDKPDLQPALHASFDDEVDFLEKHFGGLSIEGGSSYILGSKLKGVQWHVYVAGDACPVQDARPKASLEVCMTQLNREHCDEHFYRTDKFVSSAQTTTDSGIRSIFEEFDIDDYVFEPCGYSMNGLNEHGSIDGQYSTIHITPEEGFSYASCELSNVECEDLDAFAYVRKVANVFKPGKMIFAISVDGLNAAEVANDVLGNGSFIPGYTRVQATRQEFDVEGVVAYFTYEHNDRLRQSFSMPNLAGGTSFTSSHPFSFADAKMALDRPATPSCVMEFPESSAESSDHTSEEEI

SEQ ID NO: 8324 - protein, 320 aa, Zea mays
MSSSSSSSSAATVFPPSPQLPPPLLVENLPPLHQLTPPVAAAAAPASEQLCYVHCHFCDTVLVVSVPTSSLFKTVTVRCGHCSSLLTVNMRGLLFPGTPANTAAAAAAAPPPPPAAAVTSTTATMTTAPPPPPATSVNNNGQFHFIPHSLDLALPIPPHQSLLLDEISSAANPSLQLLEQHGLGGMITSGRNAAAPHPHPPQPQAPAAGKGAKEPSPRANSAINRPPEKRQRVPSAYNRFIKDEIQRIKAGNPDISHREAFSAAAKNWAHFPHIHFGLMPDHQGPKKTSLLPQDHQRSDGGGLLKEGLYAAAANMGVAPY

SEQ ID NO: 8325 - protein, 946 aa, Clostridium stercorarium
MRKFWSFAIIISLLVTGLFIHTPKAEAAGYNYGEALQKAIMFYEFQRSGKLPENKRDNWRGDSGLNDGADVGLDLTGGWYDAGDHVKFNLPMAYSQTMLAWAAYEAEEALERSGQMGYLLDAIKWVSDYLIKCHPSPNVFYYQVGDGHLDHSWWGPAEVMQMDRPAYKVDLANPGSTVVAEAAAALASAAVVFADRDPAYAATCIQHAKELYNFAEITKSDSGYTAASGFYDSHSGFYDELSWAGVWLYLATGDETYLNKAEQYVAYWGTEPQTNIISYKWAHCWDDVHYGACLLLAKITGKQIYKEAIERHLDYWSVGYNGERVHYTPKGLAWLDSWGSLRYATTTAFLASVYADWEGCSREKAAIYNDFAKQQIDYALGSSGRSYVVGFGVNPPKRPHHRTAHSSWADSMSVPDYHRHVLIGALVGGPGKDDSYTDDINNYINNEVACDYNAGFVGALAKMYEDYGGSPIPDLNAFEEITNDEFFVMAGINASGQNFIEIKALLHNQSGWPARVADKLSFRYFVDLTELIEAGYSASDVTITTNYNAGAKVTGLHPWNEAENIYYVNVDFTGTKIYPGGQSAYRKEVQFRIAAPQNTNFWNNDNDYSFRDIKGVTSGNTVKTVYIPVYDDGVLVFGVENGIKYGNTYLREGTDYTVSGDTVTILKSFLNSFDTSTVQLIFDFSAGRDPVLTVNIIDTTTSASIVPTTADFDKNPDASRDVKVKLVPNGNTLLAVKKDGEALVLGRDYSIDGDEVTIFREYLADQPVGRVTLTFDFDRGTDPVLTINITDSRQVETGVIQIQMFNGNTSDKTNGIMPRYRLTNTGTTPIRLSDVKIRYYYTIDGEKDQNFWCDWSSVGSNNITGTFVKMAEPKEGADYYLETGFTDGAGYLQPNQSIEVQNRFSKADWTDYIQTNDYSFSTNTSYGSNDRITVYISGVLVSGIEP

SEQ ID NO: 8326 - protein, 367 aa, Flavobacteria bacterium
MIKIHDLYFKPFLTATQISDAVNNLAYQLNRDLADKKPVFLGILNGSYMVMADLTRKFNHDCEIAFLRASSYEGTSSTGELVETLNVDIDLTDRTVVIVEDIVDTGLTVDMLSRKLLKHNPTALHVATLFLKPEVYNRELKIDFVGLNIENKFVVGYGMDYDNLGRNLPELYVQTQRMKNIVLFGPPGAGKGTQAERLKEKYGLVHISTGDVFRYNIKNGTELGTLAKSFMDKGNLVPDEVTIKMLNAEVEKTPDAAGFIFDGFPRTDAQAKALDELLASKGSEIAGMVALEVDDEVLVERLLERGKASGRADDANEGVIRDRIAVYYKQTAPLKDYYTAQDKYHGVDGVGALDEITARLSVEFDKL

SEQ ID NO: 8327 - protein, 456 aa, Arabidopsis thaliana
MSDLQANKDETTVDRQSSSSVDLDGPSPLRKMISVASIAAGIQFGWALQLSLLTPYVQLLGVPHKWPSFIWLCGPVSGLLVQPSVGYFSDRCTSRFGRRRPFIATGALLVAVSVVLIGYAADFGHSMGDKIDKPVKMRAVVIFALGFWILDVANNTLQGPCRAFLGDLAAGDAQKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLAYSVRTSFYNIKQLRRRSKTFSRSFKHGNCHTTNDCIVWSWSY

SEQ ID NO: 8328 - protein, 117 aa, Arabidopsis thaliana
  misc_feature (83)..(83): Xaa can be any naturally occurring amino acid
GKQIEKWVALLVRVPPAPARRPGLLLKPNGGISGPGLGLAPMGKKKGGVGCSMEKKEGNVSVMGGGVSAGATGGLKGVMSNPXMGLVDERMSTEGKGLTFGLSNNLLGWILVGVFGL

SEQ ID NO: 8329 - protein, 355 aa, Elaeagnus umbellata
MSLLSDLLNLNISESTDRIIAEYIWIGGSGLDLRSKATLPKKVKNPSELPKWNYDGSSTNQAPGDDSEVILYPQAIFRDPFRRGNNILVMCDAYTPAGEPIPTNKRHNAAKIFSHPDVDAEEPWYGIEQEYTLLQKEVNWPLGWPLGGFPGPQGPYYCGVGADKAFGRDIVDSHYKACLYAGVNISGINGEVMPGQWEFQVGPTVGIAAGDQVWVARYILERIAEIAGVVVSFDPKPIKGHWNGAGAHTNYSTKSMRIDGGINVIKKAIEKLGLRHKEHIAAYGEGNERRLTGRHETADINTFSWGVANRGASVRVGRDTEKDGKGYFEDRRPASNMDPYVVTSMIAETTILWKP

SEQ ID NO: 8330 - protein, 491 aa, Solanum lycopersicum
MSDLEFFLFLIPPILAVLIILNLFKRKHNFQNLPPGDMGWPFLGETIGYLRPYSATTIGDFMQDHISRYGKIFKSNLFGEPTIVSADAGLNRYILQNEGRLFECNYPRSIGGILGKWSMLVQVGQMHRDMRMIPLNFLSNARLRNQLLSEVEKHTLLVLGSWKQDSVVCAQDEAKKLTFNFMAEHIMSLQPGNPETEKLKKEYITFMKGVVSAPLNFPGTAYRKALQSRSTILGFIERKMEERLKEMNRNENDLLGWVLKNSNLSKEQILDLLLSLLFAGHETSSVAIALSIFLLESCPAAVQQLTEEHLEISRAKKQSGETELNWDDYKKMEFTQCVINETLRLGNVVRFLHRKAVKDVRYKGYDIPCGWKVLPVISAAHLDPSLFDRPHDFDPWRWQNAEESPSGKGGSTGTSSTTKSSNNFMPFGGGPRLCAGSELAKLEMAIFIHYLVLNFHWKLAATDQAFAYPYVDFPNALPINIQHRSLNKLHD

SEQ ID NO: 8331 - protein, 249 aa, Aeropyrum pernix
MARCRGKVVIVGGGPGDPGLITVKGMKALEEADAILYDRLAPKGLVEKLQTPALKIYVGKKPGEGMSQEEINRLMEILACRGMTVARLKGGDPYTYGRGEEECMYLMEKGVECIVIPGVPSYIAASALHGIPLTSRGISSSFAVITGKEAPGKPAGKRVKLEDIARSVDTLVILMGASTSAELAERLIKVLPPETPVAIASSVSTPEAETLVTDLRGLRELGRQGRVKSPAVIIVGEVVKLRDRLYKEA

SEQ ID NO: 8332 - protein, 501 aa, Vitis vinifera
MAVPGGHRQRGRPRALIGEPVRPRVPLRRLLRVASVACGIQFGWALQLSLLTPYVQELGIPHAWSSIIWLCGPLSGLLVQPLVGHLSDRCNSRFGRRRPFIVAGATSIVVAVLIIGFSADIGGLLGDGADRRPRAVATFVVGFWLLDVANNVTQGPCRALLADLTEKDHRRTRVANAYFSLFIAVGNVLGFATGSYSGWFRIFWFTSTSSCNADCANLKSAFLLDIIFIAITTYISITAAQELPLSSSSRSTHISEEMAESTHAQEAFLWELFGTLRYLSGSIWIILFVTALTWIGLLPFLLFDTDWMGREIYGGKPNEGQNYNTGVRMGALGLMLNSVVLGITSVLMEKLCRKWGAGFVWGLSNILMSLCFLLMLILSAVVKHMDFLGHDLPPSGVVIAALIVFSILGIPLAITYSVPYALISTRIESLGLGQGLSMGVLNLAIVIPQVIVSLGSGPWDQLFGGGNSPSLAVAAVAAFASGLVAILAIPRSSADKSRVHT

SEQ ID NO: 8333 - protein, 172 aa, Capsicum annuum
MASKGIALICMTLVTIMSTMISVEVMAQSDCTSTLITMASCLSFVTGSAKTPPASCCSSLSGVLQSNPRCLCVIVNGGGSSLGVQINQTQALALPSACNLQTPPVSRCYAGNAPVMSPEGAPTEGTPDSSTGVAVTGSKASGSSTSDGSSLKVPVRAAVAIVIFMASYISMI

SEQ ID NO: 8334 - protein, 206 aa, Neisseria gonorrhoeae
MAVRSKSSKAWLHEHINDQYVHMAQKDGYRARAAYKLLEINEKDKIIKPGTVLADLGSAPGSWSQVAAKLTGTSGAVFALDILPMEAIGGVSFIQGDFRENDVLAQFETLLDNRPLDLVICDMAPNMSGNAVSDQARSFYLCELALDFASQHLKTGGSFLVKVFQGAGYQEYMAAMREIFGTVQTRKPEASRNRSSEIYLLGKNKR

SEQ ID NO: 8335 - protein, 172 aa, Capsicum chinense
MASKGIALICMTLVTIMSTMISVEVMAQSDCTSTLITMASCLSFVTGSAKTPPASCCSSLSGVLQSNPRCLCVIVNGGGSSLGVQINQTQALALPSACNLQTPPVSRCYAGNAPVISPEGAPTEGTPDSSTGVAVTGSKASGSSTSDGSSLKVPVRAAVAIVIFMASYISMI

SEQ ID NO: 8336 - protein, 125 aa, Bacillus cereus
PFEAIGGEQCIAILVDTFYSYVSKHPDLSPIFPEDLTETARKQKQFLTQYLGGPNLYTEEHGHPMLRARHLPFEITPKRAEAWLSCMEQAMDDTGVHGHIREFVFERLALTAQHMVNTPNETGEV

SEQ ID NO: 8337 - protein, 364 aa, Oryza sativa
MMEVNKEEDIRLGLHRSDYMLDSGTNSLLQIELNTISSSFPGLSSLVSELHRTLLNRHGKVLGLDSKRIPQNWAATQFAEALSMAWTEFNNKSAVIMMVVQPEERNMYDQYWLINHLKESHGVKTIRKTLAQVEAEGQVLPDGTPVVDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDRTISELGIFGAYLRNKDKVVLNNQCGYLMRTKVSSSNEGGVAAGFAVLDSILLTDE

SEQ ID NO: 8338 - protein, 211 aa, Unknown
  Synechococcus sp. WH 7805
MRLVLPLLMVGALLLGAPGSVFAAVENAVLAGGCFWCLESDLEKLPGVLSVESGYSGGTVARPTYRQVTSETTGHQEVVEVRFDPAKISYPRLLQSYWRNVDPFDGGGQFCDRGDSYRPVIFINSEAQAQSARASRAAVARELGVPESKLKVEIKPLKTFWPAESYHQNYAKTNTLRYRFYRFSCGRDRRLDEVWGSKARSGGPWSTPAKR

SEQ ID NO: 8339 - protein, 479 aa, Streptomyces avermitilis
MSTTAQIGVTGLAVMGRNLARNFARNGYTVAVHNRTASRTRDLVEEFGHEGDFVPAETAKDFVAALERPRRLVIMVKAGAPTDAVIEEFAPLLEPGDMIIDGGNAHFADTRRRERELREQDIHFVGTGISGGEEGALHGPSIMPGGSPESYDSLGPMLEKISAKAADGAPCVTHVGPDGAGHFVKMVHNGIEYADMQLIGEAYQLLRDVAGYTPAQIADIFRTWNTGRLDSYLIEITAEVLSHVDAATGKPFVDVVQDQAEQKGTGRWTVQIALDLGVPVSGIAEAVFARSLSGHQELREASRGLAGPKAAPLGESEAAAFADRVEQALYASKIVSYTQGFHEIAAGSDEYDWNIDLGKIASIWRGGCIIRAAFLDRIREAYDARADLPSLLSDDTFAQEIAAAQDDWREVLIAATRQGVPTPGFAAALAYYDALRAERLPAALTQGQRDFFGAHTYRRTDREGSFHTLWGGDRSEVTA

SEQ ID NO: 8340 - protein, 483 aa, Sorghum bicolor
MSSSGQYSSPRRAATATLLLALAAGSFLLLPALARGSSSSSSFEEDRISALPGQPNDGVAFDMYGGYVTVDEHAGRAFYYWLQEADRGEVEDPDTAPLLLWLNGRPGCSSVGYGAMEELGAFRVHTDGHRLLLNEYAWNKVANVLFLDAPAGAGFSYSNTSSDLLVAGDISTAHDSYTFLVKWFERFPQYKYRDFYIAGESYGGHYVPQLSQLVYRNNIGVEKPVINLKGFMVGNGLTDDRADMVGMFEFWWHHGLIADETLDTGLKVCPGSSFIHVTPECRKIWDKALEEQGHIDGYSIYTPPCDKGSPYAHRLQSRPHPLMMLPAYDPCTAFYSTKYLNLPEVQTAMHANVSGSMEYPWVVCSNLLFDNWTDAATSMLPIYRELIEGGLKVWVFSGDTDTVVPLSATRRSLAALSLPVKTSWYPWMIVGCYEHELASDMAKSRALGKDILCRGPPAETLGKEKPSAKTPSAILFLNRRSMS

SEQ ID NO: 8341 - protein, 160 aa, Colwellia psychrerythraea
MSNIYQFTVKNNKEETIELNQFTDKVLLIVNTASNCGFTPQYQGLQSLHDSFQTNGFEVLAFPCNQFKQQESGNNEEIQQFCDLHFNIKFPLFDKIDVNGSNAHPLFSFLKQQAPGILGSKSIKWNFTKFLVNRKGEVVKRYAPTTKPEAITADIEKLLV

SEQ ID NO: 8342 - protein, 657 aa, Sorghum bicolor
MHEGLAVVELAVGTHRPVRARTHEFVSPAHKFATRPGEEAVVDEGLKGMGIFEALGGICSGATAEEQELAADSMAGHDEGRGNTDSEGGYRGRGGKQMATLEEYEEARNLRMGDRPRSTFRVHMGEDKVCRKDWCWSVRADYILEKLPDVSGPSFVQFHGRVCRSCAGIVHMSGVDLKWSYNMALDTRTWPREDVPGLGLTDEDVSLLWRTSRRQPPPGTGVGARVLEEQDHQQREDDLIRGLPGLPPNDDVPFDMYGGYITVDEQAGRALYYWFQEADRTEVEDPDAAPLLLWLNGGPGCSSIGGGALEELGAFRVHTDGERLLRNEFAWNRAHDAYKFLVKWFERFPKYKYRDFYIAGESYGGHYVPQLSQLVYRNNIGVENPSINFKGFMVGNGLTNDRTDMIGMFEFWWHHGLISDETLESGLKICPGSSFIHIEPECQKIWDKAVEEQGNIDGYSIYTPPCDKGTPYARRRLRRSRRPLMLPAYDPCTAFYSTKYLNLPEVQTAMHANVSGIIDYPWVLCSDPLYYNWTDTPASMLPIYKELIGAGLKVWVFSGDTDTAVPLSGTRRSLAALGLPVKTSWYPWYIVSTETRVLLSSPIRSSCPPMVMTAESYAEPVVMIMVFTTGSDGHYFHLPSNQRWNFFLPPVWFYNSN

SEQ ID NO: 8343 - protein, 335 aa, Oryza sativa
MPIPEKDGVEDNQEDDTFSRLQLLAQQRHAMEKFWRMSQEQIEESAGNEELILPISRVKNIIHAKEGGMMLSADTPAFVTKLCELFVQELILRAWVCANSHNREIILGTDIAEAINTTESYHFLANVVHGHQALGSNIPEIGVSAWKRHKLDEMTSLCHPPQAVQVTDLANHPPNIPVCPPIGQSGTQHTTSTHVLMMQGESIHKASKEKSPLKEVMVPTNKVGMTNSSYAVPNGGGATSSKVVIDSPKGETAQVFSSQHACPSLEDNYVIPIPAGHGDSFRTLDEANIPQLHQEQKNFISQDAIVGENIPLNESLEKSKHKDEDLLFPDKDLPE

SEQ ID NO: 8344 - protein, 406 aa, Streptomyces avermitilis
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 8345 - protein, 472 aa, Candida albicans
MSLSPKLEEIVSSIEKSFEIKDDFLVKATEYFIESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLFENHSEACTAKNTEPLKLGFTFSFPVNQTALNRGTLIRWTKGFDIPDTVDRDVVELLQANLTILEVNVKVVAIANDTVGTLLTAAYSNDSAKTNRNTIIGCIFGTGTNGAYFESKIPKLSSSTSKSQGMVINTEWGSFDNGLKILPSTEFDEIVDSETANPGYHLFEKRISGMFLGEILRVALIHLFKKGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIYLKIAKDGSGVGAALCASTA

SEQ ID NO: 8346 - protein, 749 aa, Oryza sativa
AREINSPFCSRTIRVTSAALVSNAGGHGQIRVSSGKARRIPPPPPLTPRGGKGRSCLPPLQPLNITRRSLDEWPRAGSDDVGEWPNPTTPGASKAEGAGSAKPGEGLRLDLSSLRSQGRKDQIAFFDKECSKVADHVYLGGDAVAKNRDILRKNGITHVLNCVGFVCPEYFKSDLIYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRSLARVYSDSALIRDLDPRVDRVQHLAAEASTSPPFLSPSSLSSDSSISSKYSSDSPSLSPSTSSPTSLGLSPASSNFSHTLVPSSRSPLHQSSNEEPSKSGLGSIRSPSKTSSIAERRGGFSSLKLPSFQKDLVLPPRVPTSLRREEEVTDKSNNNSVKQLTGVCCPEKCTGNTSTVHTKTGITERTDSISEACGNLQLLVYRWPSKEKLTTFTRKDLDPKSVLIFVTPEDSRSEAVKTVHIWVGGEYESSKCVDTVDWQQVVGDFFHLKELGNTLPVKVFKEHETENLLEVLNAR

SEQ ID NO: 8347 - protein, 565 aa, Leptospira interrogans
MRLLLIQPPVEDFYDTDIRLQPIGLCYLKGAIQKFLPNVEVIIRDFHRGLGNKLAGRRTIPIPNELKYLKEYYPVPDRSPFSTFFEYFHFGASYEDISKEVKYLNPDLVGISSLFSPYYREALKTAEEIKKVLNVPVLMGGSHVSACPELMLSNPYVDFIIRGEGEKAICDFLNEFQNEKRYALVGSLGWKESGKMYLNPIGENFPIQDLPPPDLSYLSKIHYLFEGKPMRFIITSRSCPHRCSFCSVHTTFGTKYRRNTVERVLSEIKKSYELGYRVFDFEDDNLTFFRPEMKQLCEELIDAFPKKDVRFVAMNGISYISLDPELLRLMKEAGFTNLNLALVSSDKLVRETTKRPHTVEKYIQIVQEGFKLGFQITSYQILGLPMETLESMIQTLQFNAGQPVLMGASLFYLTPNSPIASNFPERNESDIFLARLTSMAIPSEHFDREDIYSLFIITRMLNFLKSAQIPKDNLASLNDTFRILENYDSRSFLGVKLFKKLLEEKKLYASAPQGLIFLDKFRYKVFEMVFSGLDKITTLSGGNIDLKDLNSFMSLKEPNLELNSY

SEQ ID NO: 8348 - protein, 316 aa, Leptospira interrogans
MAHKIVIIGSGPAGHTAAIYAARANLNPVMYEGFMAGGIAAGGQLTTTTEVENFPGFPEGIDGTKLTQLFREQSIKYGTKIITQTITKVDFSSKPFKLWSDDELIEAQAVIIATGATAKRMNVIGEDIYWQRGISACAVCDGALPIYRNKELVVVGGGDSAVEEASHLTKFASKVYLVHRRDSLRASKIMQKRATTHPKIEIIWNSQVKEAKGDGKSLTSLTLENTTNGQKKELPVGGLFYAIGHKPNTDIFQGILDLDESGYIKTVPGSTKTNIEGIFAAGDVQDKIYRQAVSAAGSGCMAALDAERWLESREEE

SEQ ID NO: 8349 - protein, 584 aa, Magnaporthe grisea
MSLTNCRFYEEKYPEIDSFVMVNVKQIADMGAYVKLLEYDGIDGMILLSELSRRRIRSIQKLIRVGRNEVVVVLRVDKEKGYIDLSKRRVSQEDIVKCEERYNKSKMVHSIMRHVAEKTLVPIESLYEAIAWPLNRKYGHAIDAFKLSITNPEVWEDTTFSSEAVAEELKSYISKRLTPQPTKVRADVEVTCFAYDGIDAIKTALRTAESRNTQDNQVKVKLVSPPLYVLTSTCLDKSLGIARLEEAIVDIRTSIESAGGKLIVKMEPKAVTESDDAELQALMEKRERENAEVSGDESVSDSDDNMPETMGSCGGGLAAIIEAEGDIGFQRKSVEDEVDLDITVAFAGKKYISRKTINIAAVTEIVGDIYVSDCLSSHVNPLKPTLMAPGFAWARARARAWAARPGFTFAQNFSTSLLRYLTWLPVAIVFTSNVAEPYKIAGPSMYPFFNKERNETRLQDWCMNWKLNAQDDLRRGMIVVFWNPLKPESRSVKRIVGLEGDIVRNRDSDVWVRVPVGHIWVEGDAGSRDSRDSNYYGPISARLIIGRLTRILFPFHRSGSINWRDHPENPRVIKTQDMVPQLLL

SEQ ID NO: 8350 - protein, 351 aa, Mycobacterium leprae
MEMAGIVVRSESAVAVMGAGAWGTALAKVLIDAGGPEAGVVLWARRPDVAERINTTRCNRAYLPGTLLPPGIRATADPADALRGASTVLLGVPAQRMRANLERWGGLVADGATLVSLAKGIELGTLMRMSQVIVSVTGVDPAQVAVLSGPNLASEIAQCQPAATVIACSDLGRAVALQRMLSSGYFRPYTNSDVVGTEIGGVCKNVIALACGMAAGVGFGENTAATIITRGLAEIIRLGMALGAQVTTLAGLAGVGDLVATCTSPHSRNRSLGERLGRGEIMQSILHGMDGSDGGDGYVVEGVTSCASVLALASSYDVEMPLTDAVHRVCHKGLSVEKAMALLLGRSTKSE

SEQ ID NO: 8351 - protein, 276 aa, Brassica napus
STHASASLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGNMDVYNILKARGAKVPKTKKTPMVVANPRHVPDYELNPQELQVRKADGISKGIYQVAKWNGTKVSVKILDKDLYKDHDTINAFKHELTLFEKVRHPNVVQFVGAVTQNVPMMIVSEYHPKGDLGSYLQKKGRLSPSKVLRFALDIARGMNYLHECKPEPSIHCDLKPK

SEQ ID NO: 8352 - protein, 514 aa, Camptotheca acuminata
MEMDALRQVLHPMPTALFFIAPLFFLFILSRLRRKLPYPPGPNGLPLVGNMMMMDQLTHRGLAKLAKQYGGIFHLRMGFLHMVAVSSPEIARQVLQVQDNIFSNRPATIAISYLTYDRADMAFAHYGPFWRQMRKLCVMKLFSRKRAESWESVRDEVDSMVRVVVSHTGKSVNIGELVFSLTRDIIYRAAFGSSSHEGQDEFIKILQEFSKLFGAFNIADFIPGLGWVDPQGLNARLVQARASLDGFIDSIIDDHIEKHRRRNVVDSDGDMVDDLLAFYSDEAKVTESDDLQNAIRLTRDNIKAIIMDVMFGGTETVASAIEWAMAELMKSPEDLKRVQQELAEVVGLDRRLEESDFDKLTYLKCALKETLRLHPPIPLLLHETAEDTEVAGYYIPARSRVMINAWAIGRDKNSWDEPETFKPSRFLKEGVPDFKGSNFEFIPFGSGRRSCPGMQLGLYALEMAVAHLLHCFTWTLPDGMKPSELDTDDVFGLTAPRATLFVAVPSPRLLCPLY

SEQ ID NO: 8353 - protein, 957 aa, Pseudomonas putida
MSQSPSLHQLQELNPFLRRHLGPDATEQQAMLNALGIASRNELIEQTVPPDIRLNRPLDLPAALDEQAALAKLAGYAEQNQVWTSLIGMGYHGTITPTVILRNVLENPGWYTAYTPYQPEIAQGRLEALLNFQQMVIDLTGLPLANASLLDEATAAAEAMALAKRVARNKSNAFFADEHCHPQTLSVLKTRAEGFGFELIVDSVDNLAKHSVFGALLQYPDTHGEVRDLRPLIDQLHSQQALACVAADLLSLVVLAPPGELGADVVLGSTQRFGVPMGYGGPHAAYFACRDDYKRAMPGRIIGVSRDARGNTALRMALQTREQHIRREKANSNICTAQVLLANIAGFYAVYHGPEGLQRIAQRVHRLTFILAAGLEAKGIKRLNQHFFDTLTLNVGGAQAAIIESAEAAHINLRILGRGHLGVSLDETCTEQTVLRLLDIFLGVDHGLEITALDQLALPEGIPASLVRRTPFLAHPVFNLHHSETEMLRYLKQLENKDLALNQSMIPLGSCTMKLNATSEMIPITWPGFAQLHPFAPAAQAAGYKAMIDELESWLCAITGFDAICMQPNSGAQGEYAGLMAITRYHCSRHQPMRTLCLIPSSAHGTNPASAQMAGMEVVIVDCDNDGNVDLADLKAKAHAAGERLSCLMITYPSTHGVYEEGIREICDVVHQYGGQVYMDGANLNAQVGLARPADIGADVSHMNLHKTFCIPHGGGGPGMGPIGIRAHLKPFVASHPVVPVPGLDPNNSAVSAAPWGSASILPISWMYIAMMGPQLADASEVAILSANYLASQLGAAFPVLYRGRNQRVAHECILDLRPLKALTGISEEDVAKRLMDYGFHAPTMSFPVPGTLMVEPTESESKAELDRFVEAMLAIRAEIDEVQQGNWPAENNPLKHAPHTLADVLGVWDRPYSLEQAVAPSAHVRQHKYWPAVNRVDNVYGDRNLFCACVPVEAYR

SEQ ID NO: 8354 - protein, 990 aa, Pichia pastoris
MPEPSISALSFTSFVTNDDKLFEETFNFYTKLGFHATRSYVKDNRSDFELTGISTDSIKEIWLESFPLSEVVETSAGRELRKPLQESVGYQSEALLGYSPYQSDGVVIKLRLSNHDLQKNKDLPGEVTFFTASIDKLRAKLIEIGAEIIPSEIDLVEFSTKDPMGDVISFSSYPSLSSKKKITSPDFFLHPKKEVRSQESIVEQVKSEEGKKKIAIITSGGDAPGMNAAVRAVTRAGIFYGCKVYACYEGYTGLVKGGDMLKELQWQDVRGLLSIGGTIIGTARSKEFRERWGRLQACYNMVSNGIDALVVCGGDGSLTGADLFRNEWPELIKELLGEGKITKEQYETHRNLTIVGLVGSIDNDMCGTDSTIGAYSSLERIIELVDYIDATAASHSRAFVVEVMGRHCGWLGLMSGIATGADYIFIPERPPSETNWKDDLKKVCLRHREKGRRKTTVIVAEGAIDDQLNPITSEEVKDVLVEIGLDTRITRLGHVQRGGAPCAFDRFLATVQGVDAVRAVLESTPAIPSPVISILENKIVRQPLVESVAQTKTVSDAIEAKDFDKALKLREQEFATSYESFLSVSKYDDGSYLVPESSRLNIAIIHVGAPTSALNPATRVATLNSLAKGHRVFAIRNGFAGLIRHGAVRELNWIDVEDWHNTGGSEIGTNRSLPSDDMGTVAYYFQQYKFDGLIIIGGFEAFTALYQLDAARAQYPIFNIPMCCLPATVSNNVPGTEYSLGSDTCLNTLSGYCDAVKQSASASRRRTFVVEVQGGYSGYLASYAGLITGALAVYTPENPINLQTVQEDIELLTRTYEEDDGKNRSGKIFIHNEKASKVYTTDLIAAIIGEAGKGRFESRTAVPGHVQQGKSPSSIDRVNACRLAIKCCNFIEDANFQVKHNANLSADERHLRFFCDDGVKTSAVSGKSSVIDDNTSVVIGIQGSEVTFTPVKQLWEKETHHKWRKGKNVHWEQLNIVSDLLSGRLSIRTT

SEQ ID NO: 8355 - protein, 698 aa, Erwinia carotovora
MQKVLTVCPYCGSGCKINLLVENGKVVGAEGANGVTNEGELCLKGYYGWDFLNDTKLLTPRLKQPLIRRQKGAPFEAVSWDEAIGFASSRLKGIKEKYGAESIMHTGSSRGPGNETNYVMQKFARAVTGNNNVDCCARLCHGPSVAGLQVTLGNGAMSNSICEIEKTDCILIFGYNAADSHPIVARRILKAKARGAKIIVCDPRRIETARIADLWLPLKNGSNMALVNAFANVLINEGRYDKAYVARHTEGFEEFSQTVAKYTPEYVADITGLSPKLIRDAMRMYAAAPSATILWGMGVTQWGQGVDVVKGLSGLALLTGNLGRPNVGVGPVRGQNNVQGACDMGALPNMFPGYQNVTDKAVLAKFADAWGVPELSDKIGYSLTDLPHKIKEGKIRANYVMGEDPLQTEPDLSMLRDAFNELDLLIVQDIFMTKTAAIADVILPATSWGEHEGVYTAADRGFQRFYKAVEPQGDVKPDWEIISLMATALGYPMHYNNTQEIWDELRQLCPLYYGATYEKMAGLGYVPWPCPTEDSPGTPWLYANNHFDRPGGKGLLLTAEWRPPMELVDEDYPLVLCTVREVGHYSCRSMTGNCTALQTLADEPGYVQVNPHDAERLGICDQQLVWISSRRGKVISRVAVSERINKGAVYMTYQWWIGACNELTLDHLDPVSKTPEYKHCAVKLEAIDDQQAAENYVQ

SEQ ID NO: 8356 - protein, 397 aa, Clostridium tetani
MIGGYNMSSFKIRDNIYSVGVKDPDLRVFDIIMETNGGTTYNSYLIDDEKVAIIDTVKDGFYDKFYSNIKEVIGERKVDYIIVQHTELDHSGSLINLLRDYPEAQVICSMAASVYLKNILNKEFNHQVAPKELSLGNTTLNFITAPNLHWPDTMFTYVPEKKALFTCDFLGAHYCPSTNIFDGESEDSYEEMVYYFDVIMSPFKKFVLAGLDKIKDLDFDLVCTSHGTVHTKENIKKYMNMYREFATGNNEEEKKIEIFYISAYNQTKAVADYFYKQLNNMGIKADIHEITESGIDKCAELIEKSKGFLIGSPTINQDAVKPVWDVLSLVSPIVNRGKPAGAFGSFGWSGEGVPMMTERLKSLKLKVVEEGFKFKFVPSSEDYKNADTFLEDFKNLL

SEQ ID NO: 8357 - protein, 402 aa, Arabidopsis thaliana
  misc_feature (95)..(95): Xaa can be any naturally occurring amino acid
  misc_feature (174)..(174): Xaa can be any naturally occurring amino acid
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPXAVNIHGSTRISAFGILAGIKTIAGLFGTLVARFLPIALTFQVSAISFFVGLVYMRVFLKEKLNDDEDDDLHHGTYHQEXDHDSINTTMLAEPILNDRPIKTQVFHKKYSSLKDMISLMKTSTIFFQALYFLKARFGFDKKQFADLLLLITIVGSISQLFVLPRFASAIGECKLLSTGLFMEFINMAIVSISWAPWVPYLTTVFVPGALFVMPSVCGIASRQVGPGEQGKVQGCISGVRSFGKVVAPFVFSPLTALFLSKNAPFYFPGFSLLCISLSSLIGFFQSLLIKDVPTPPLNKAINKTSGEEV

SEQ ID NO: 8358 - protein, 472 aa, Prochlorococcus marinus
MSKAHFGLVGLGVMGENLVLNAERNGFSSVVFNRTYSKTEEFLQGRGLGKNIEGAETLQEFVNKLERPRRILMMVKAGPATDAVIENISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEITGDDVVEKILDKAGQKGTGLWTVVSALELGVSVPTIYASLNARVMSSLKEQRSEIEKTIPSKEIEDFDLGNISDGMKPLFDAVVLATIASYAQGMDILREASTVYNYGLNMPSIAQIWKGGCIIRSKLLSKIQDAYNKDPNLKNLIFDDWFNNEIATRLDNLAKVVSLSTKAGIPVPCLSSTLDYLNSYRTNRLPQNLVQAMRDCFGSHTYQRIDKEGSFHTEWMK

SEQ ID NO: 8359 - protein, 196 aa, Burkholderia vietnamiensis
MENQQVISGGETGKRTEIATLAGGCFWCTEAVFLDVDGVTAVQSGYAGGHTRNPGYRDVCDGDTGHAEVVNVTFDPARIGYREILEIFFATHDPTQLNRQGNDVGTQYRSVVFTHSDAQRDTALDVIAELEREQVFGQPIVTQVVPLDGNYWPAEDYHQNYYARNPEQGYCSVVIGPKLAKFRQKFAHRLKSQRGA

SEQ ID NO: 8360 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALNGVLALTMLPAPPPDVPNTKDERTQPSS

SEQ ID NO: 8361 - protein, 275 aa, Bacillus anthracis
MELWFTEKQTKHFGITARINRTLHTEQTEFQKLDMVETEEFGNMLILDGMVMTTEKDEFVYHEMVAHVPLFTHPNPENVLVVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 8362 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGKSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 8363 - protein, 546 aa, Staphylococcus aureus
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQGGKYVHHSLGEGTFDDYRKMFAHITVAQGYITPENATTEIPRLINTAIAERRPVHLHLPIDVAISEIEIPTPFEVTATKYTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMAVEDAPKKLIDIAKAFSQQNK

SEQ ID NO: 8364 - protein, 952 aa, Unknown
  Photobacterium sp. SKA34
MKLTKRSDKVSKVENQLGISRRSFIRNTSLAAAGGVAGVSMFAPGMMKKAQAASEDVYDAPKVVKRTICSHCSVGCGIYAETQDGVWTHQEPAFDHPFNAGGHCAKGAALREHGHGARRVKYPMKLVNGKWKKLSWEQALDEVSQQVLKIREESGPDSVYFLGSAKHNNEQAYMFRKMVSMWGSNNVDHQARICHSTTVAGVANTWGYGAMTNSLNDMHNCKSMLFIGSNPAEAHPVAMQHILIAKETNSCKIVVVDPRRTRTAAKADHYVSLRPGTDVAFVWGVLYHIFNNGWEDKEFIRQRVYGMDEVRAEVAKWNPKEVERVTGVPEEQVYQTAKMLSENRPGCVVWCMGGTQHTTGNNNTRAYCILELALGNMGKSGGGANIFRGHDNVQGATDFGVLSDNLPGYYGLSEGAWKHWAQVWDVDYSWLQGRFDQNTYNGKKPMNSAGIPVSRWIDGVLENKDKIEQRDNIRAMFYWGHAVNSQTRGPEMKTAMEKLDMMVIVDPYPGVAAVMNGRTDNVYLFPATTQFETYGSVTATNRSIQWRDQVIEPLFEAKPDHEIMYLLSKRLGFADQLFKNIKVENNRPHIEDITREFNKGMWTIGYTGQSRERLKEHQQNWHTFNRTSLEAIGGPANGETYGLPWPCWGTPEMKHPGTHILYDTSKTVAQGGGNFRARFGVEHNGVSLLADDSYSLGCELEDGYPEFTAKMLKQLGWWDDLTAEEKVAAEGKNWKTDLSGGIQRVAIKHGCIPYGNAKARTVVWTFPDAVPIHREPLYTPRRDLLPEYQTWDDKAHLFRLPTLYKSIQDKDMSKEYPIILTSGRLVEYEGGGEETRSNPWLAELQQEMFVELNLKDANDRGIKDGEMVWVEGAEKGRIKVKAMVTPRVREGLAFLPFHFGGEFEGESLRSHYPEGCSPYVSGEAANTATTYGYDPVTQMQETKVTLCKITKA

SEQ ID NO: 8365 - protein, 357 aa, Zea mays
  misc_feature (116)..(116): Xaa can be any naturally occurring amino acid
MPCVQKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRXRAGMPLDSLVCNAAIYRPTARTPTFTADGYEMSVGVNHLGHFLLARLLLDDMQKSDYPSRRLIILGSITGNTNTLAGNIPPKAGLGDLRGLAAGLRGQNGSAMIDGSESFDGAKAYKDSKICNMLTMQELHRRYHEETGITFASLYPGCIATTGLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 8366 - protein, 448 aa, Candida albicans
MSEKIVQSSNDEAATLTAVDYIQNQEELEKEARELMPYDPNECTYEMGELRQPLFACLTCSAENENQPIGVCYSCSIQCHSQHELVELFTKRSFVCDCGTTRMKNTKDGACKLRRHGKKESSGRKLSNSSATHSTYLELAAEDIPSSSNTYNQNYHGRFCGCKQVYNPLEETGHMIQCYFGFTCGEDWYHDRCVMGITFADEKANQKHGNSQEESVPDGTNIKTDISKAQSESADIDSIEKLQYFPKLETFDEFICWRCVTSFKDVFEDLDKHFPGVILSKLPRFSNTSTVEDWYAKREKLLEPCFKKIKIEESSGKLGKFHNQEYSLFLSNDFRFKLIDNYESLDHESKLYKFLLNNSFLFKDDPIFKPPEDDSEEDCYSSSNAGTGRALETLPRDKAIESIQAYDKIKSKLKDFFKPFAEQGKVVTEEEVRNFFGHIDDKNNDSGQ

SEQ ID NO: 8367 - protein, 566 aa, Streptomyces coelicolor
MIVNEPVPDTFEDTPAKDRDPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRRNPDGPYGDYYVWADDDKQFQDARIIFVDTEASNWTYDPVRKQYYWHRFFSHQPDLNYENPVVQEEMISALKFWLDLGIDGFRLDAVPYLYQEEGTNCENLPRTHDFLKRVRKEIDAQYPDTVVLAEANQWPEDVVDYFGDYAAGGDECHMAFHFPVMPRIFMAVRRESRYPVSEILAKTPAIPSGCQWGIFLRNHDELTLEMVTDEERDYMYAEYAKDPRMRANIGIRRRLAPLLDNDRNQIELFTALLLSLPGSPILYYGDEIGMGDNIWLGDRDAVRTPMQWTPDRNAGFSSSDPGRLFLPTIMDPVHGYQVTNVEASMASPSSLLHWTRRMIEIRKQNVAFGLGTYTELPSSNPAVLAFLREHEDDLVLCVHNFSRFAQPTELDLSAFDGRHPVELFGGVRFPAVGDLPYLVTLGGHGFYWFRLRKDAA
